United States Patent 9,567,581 (SELECTIVE REACTIVATION OF GENES ON THE INACTIVE X CHROMOSOME) - sequence listing, part 45

SEQ ID NO: 4687 - DNA, 379770 bp, human
gtgcgctgtggacggaggttgtggagagagcagggcggcattggtggctgcggctgaggtgagtggtttagtgggcaggaaggggtagaataggcttcaagcacaagttagttgggtagtttataactagcaagaatatattatagccattaggccaaaactttttagagcggccctaaggcagtgactttgtactacagaactgctcgtcgctctcaaggcgaacgaagatgggcaaatgtaatgtttttggacgaggattgaggagtatggggagcggtggtgggccactgaaaaccggagatagtagttactgtagtttagatgctaaaggacctaaattacgttgaagcgggactgttgatgaccgttgggggcaatgtaatgttttttgatgaggatggaggagtatggggagttgtggtgggccactgaaaaccggagatagtagttattgttgtttagatgctgaaggacctaaattacgttgaagcaggactgttcatgaccgttgggggcaggatactgaaggtgctagcgttctcacagagcgggaaaaaggaccgtgagtgattggatgctttgaatgtgcggttggtagcggaagcggattttgagccaattaggaagaagcagcgagacccagccagaccaataacagggtaccactcagctccatttcccccgttgccaggcagacttatggtaagaaaaggtcccttttatgtaacttggcagcctggccctgcccctcacaaaagccctttcatgggcttttaactttactcagcctttttttctccctttggataacaagtaacgggaaacatttcactggaaagaaatttgttgagaaactagaggataaaacagagtattaaaatatgttattatttcacaggcttgagccagagatttaaaaatggacaatgatgattttttttccatggactttaaaggtacgtagctctacgtggtagtacaaaatagtgtcaaactgctgctttaagatctaaatattgctgggcgcggtggctcacgcctgtaatctcagcactttgggaggccgaggcgggcggatcacgaggtcaggggctcgagaccagcctgaccaacatggtgaaaccgcgtctctactaaacatacaaaaattagttgggcgtggtaatcccagctactcaggaggctgaggcaagagaatcgcttgaacctgggaggcagagtttgcagtgagcagagactgcgccactgcgctccagcctgggcgacagagtgagactccgtctcaaaaaaaaaaaaaaaaatctaaatattttgtttctgagttttgtctttctgcagtgtccatagcaccaggttttctcatttatgtaccagaaacaatgtctatttttaacacattgggaacctttttatgaactagtgtagggagacagaattcacaattcataacttgtttttttttcaggatttttatggcatgcaaaataaaacgtttaatctggaagataaatctattgcaataaaaataagtttaaaaaattactgcaagatcttggagttcctttccataatcatccgtgaaaaataaattatatcctgtgtagttttagacttaagtacattttattgtgtcttaattcttttgaaaattggtaatccatgtttgctatttatgggaactctcaataaacaaaagcaatttgactgaccagaacaccagattcctcaactgtgctagatataggagagtttgtggtactatctttgtttttggggaataatgagacctgtggtaccttcacattcatataataatgaaatatgtggtaagaaatgtggctacaaatctatgattttaaaaagtttaggtcaacattttgttaatacttttttttgtttgcttgttttgtttgtttgtttgttgagacagttttgctcttgttgcccaggctggagtgcagtggtgccatcttggctcactgcaacctctgcctcctgagttcaagcgattcttctgcctcagcctcccaagtagctgggactacaggcccgcgccaccatgcctggctaattttttgcatttagtagagacagggtttcaccatgtcggtcaagctggtctcgaactcctgacttcagttgatacacctgcctcggcctcccaaagtgctgggattacaggtgtgagccaccatgccaggccaatatttgttattttaaaacaataacaataaagcctgctactatctactttaagttttaaattaggataaaatatcttaaaggtataaagatggaatagggattatgactcttaagttgataatatttgagactttgtatttacataaatatttgaatcacacagaaaagtatagaaaataatataatgaacatctgtgtacctaccactgagttttgtcaaatcttaagcttgccatatgcttcagatatttcaaagaactaaaagattacatgtaccatttttctttttaaattttatataaatagttattttatatttctttttcctgcagcttgtcttcttttttcctttttttgctcagcattgtgatatatatatatatatatatatatatatatatatatatatatattttttttttttttttttttttttttttttttttttttgagacagagttttgctcttgttgcccaagctggagtgcaatggtgtgacctcggctcactgcaacctctgccttccaggttcaagcgattctcctgcctcagcctctcgagtagctgggattacaggcacgtgccaccatgcccggctaattttttgtatttttagtagaaacggggtttcaccatgttggccaggctggtctcaaactcctgacctcaggtgatctgcctgcctcagcctcccaaagtcttaggattacaggcgtgagtcactgtgccaggctgtgtttttaatatttacccatatgaatacttttagttcatttatttccactgctgatgagtagtatttcattgaacctaaatgtaccacaatttattcattcagtctcctttgttggacataaaaatggtttcaaatatttgctgttaaaaacaacaatgctacaacgaacactgtgtttctgagagtttaacagaaactttcaaaaacatctttgactaccactcatggcaagaaaatgttttgattacatcccagtacatacatactgtgtcaaaagtttaataaaacaaaattttatcctcattacatgcagtacactatgatattttctattctatttttctcattaaaaaaatgctgggtattcagcaaaggtctgactgaaaagaaatgctgggtatgactcactacctcaatacattgactgattttttttttcttttgagacagagtctcactctgtcgtccaggctggagtgtagtggcacgatctcggctcactgcaacttccacgcctcccgggttcaagcaattcttccgactcagcctcccgcgtagctggggctacaggtgcatgccgccacgcctggctaattttttgtagtttagtagagatggggtttcgctgtgttgcccaggctggtctggaactcctgagctcaggcaatctgcccgcctcggcctcccaaagtgctaggattacaggtgagagccactgctcctggccttgagccactgcacccggccttgatttatttcttgagctactggtaggtgaggctctagggcagtgccgtccaactgacatggtgcaaaaacaaaaaattttatattttctagtagtcatattaaaaatgtttaaacagatgaaaataattttaatgatctaatttttttaactcagtgtatcaaaaatgttattataacataatcaatatacaaattattaataagttattttacattctacattttttggtacaaagtctttgaagtctggcatgtattttatacttaaagcacatctcattttggatcagccacatttcaagtgctcaatagtcacatgtggctagtggctaccatattggacagtgcagttctagagtttacatttgggagtgtaactgctgagtcaaaagctatgagcatctttaactttatagatattgccaaattgctgtccaaaatggtcttaattcaaactcccttttccccatatccttactaatatttgatattgtcagacttttaaaattttacaattttgaagactgttgtcatttttatttaccattttactttggaataattttagatttacagaaaagttgcagagatagtgcagagagttcccatatactcttcaggcagtttcattttcccaaatgttatcatcttacatgggtgttgttttgacttatattttcctgataactagtgaagttggtgtactttcatagatttactggctgtttgagttttctcttatgcacacataaactttttagtcaagttttataaaaatggagcataaaagcctatccaatggcttttagcaatggctatagttcattccttcttagggagaattgacataacaccagtcttttttgtatcaccaatctcaataaattttcaagaccaaggccaggcctggtggctcacgcctgtaatcgcagcactttgggaggctgaggcgggaggaatacttgagcccatgagtttgagaccagcctgggcaacagagaccctgtcttcaccaaaaaaaaaaaaaaaaaaaaaaaagctggatgtggtgttgcatgcctgtagtagtctcaggagccagaggtgggaggatcgcttgagcctaggaggtggagcctgcagtgagccttgattgctccagcttgggtgacagagtgagatcctgtcttaaaaaaaaaattcaagaccaggaaggaatagaaatttgtctagataattacacccactggggctaaataaatgtaactccttttctgcatgtcatcttcaactatttgaagataacttatcttgtaccccggaaagtgtcttcagattgagcattctcagtttgttcaaacattcctgatattacctggtttctagtccccttatcattttgtgtgctatcctttaaacatgctctatccttttcgtgttatttcttaaagtgtggtacccagaatagaacacaattctctatgtttgatatgatcagcataaaatacagtcatgtgctgcataatgacatttcagtcaataaaggacagcatatacaacagtggtcccagaagattttaatggagctgaaaagttcctatcccctagtgatgtcagagctgttataaagttgtagagcaatgctttattcatgtgtttgtggtgatgctggtgtaaacaaatctactgtgctgccagttgtttaaaactatagcacgtacatttatgtacagtacataatacttgatggtgataataaatgactatgctactggtttatgtattcactataccatactatgctatcttatactatttttttatcatcatcttagagtgtactccttctatttataaaaaataaagttaactgtaaaatggcctcaggcagttccttcaggaggtattccagaaggcactattatcgcagtaggtgacaggtccatgcattttattgcccctgaagaacttccagtgggacaaaacgtggaggtggaagacagtgatagtgatgatcctgagcctgtgtaggcctaggctaataatgtatgtgtttgtgtcttagtttttaacaaaaagtttaaaaagtaaaattaataatgttaacagaaaaaagcttatagaatagggatataaagaaagaaaatatttttgtacagctgtataatgtttgtgctttaagctaagtgttactacaaaagcgttaaaaagttaaaaataattaaaaagtttgtactttgggaggttgaggcgggcagatcacttgagctcaggagttcgagactggcctgggtatcatggtgaaaccctgtctctaccaaaaatacaaaaaattatcatggcatggtggcacgtgcctgtggttccagctactctgtggtcccagctactccataggttgaggtgggaggattgcttgagcctgggaggcagaggttgcagtgagccgagatcgcaccactgcattgcagccccagtgacagagtgagaccccatctcaaacaaacaaacaaacaaagcttataaagtaaaaaagttacagtaagctaaggtaaatttattattggagaaagaaacatattcttttataaactgagtgtagcctaagtgtgcagagtttataaagtctacagtagtgtacagtaatgtcctagaccttcacatatattcaccactcactcactgactcacccagagcaacttccaggtctgcaagctccactcatggtaagtgccctatacaggtgtacctttttttatcttataaaaatttattattatgttatttgaggtagggtctcactctctcacccaggctggtgtgcagtggtgtgatcgtggctcaccacagcttctacctcctgggcccaagtaatcctcccacctcaacatcttgagtagccgggaatcacaggcatgcaccaccatgcccagataatttttaatttttctgtggagacgggatctccctatgttgcccaggttggtttcgaactcctgggctcaagcgatcctccttcctcggtgtcccgaagtgctaggattacagctgtgagccaccgtacccagtcatttttaatcttttatatttttacttaccttttctaggtttagatatgtttaaatacacaaatacttatcattgtgttacagttgcctgcagtattcactacagtaacatgagttataggtttgtagcctagaagcaataggctataccatatagcctagatgtgtagtaggctataccatcttgtgtaagtacactctatgacggggtcctcaacccctgggccacggaccattacctgtctctggcctgttaggaacctggctgcacagcaggagatgagccctgggccagcaagcattaccgcctgagctccgcctcctgtcagatcagtggccagtggcattagattctcacaggagcctgaactgcccacacgagggatctaggttgcatgctccttatgaaaatctaactaatgcctgttgatctgaggtagaacagtttcatcccgaaaccatccccccaccatccgtggaaaaattgtcttctacaaaactggtccctggtgccaagaaggttgaggaccactgctctatgatgttgggacaatgacaaaaatcaccaaattacacatttctggaatgtatccctgtccttaagtgatgcacgcctgtaatctttctctttagatttaggactgatgatttttctctttagataataatatagctaagactgaatttgctttttctttctttcataccacgctagttattcattttgaactttttgccccccaaatccctcagtcttttttaagtatttatttatttatttagacaaggtctcactctattgccaggctgtagtgcagtggcgctatcctcctaggttcaagcgatcctcccgcctcagtttcctgagggaatataggcatgcgccaccattcctgactaatttttgtatttttggtagagacagggtttcaccatgtttcccaggctggtctcctgagctcctgagctcaagcgatctgcctgcctactggccttttttctagatttttctttctttctttttttgaggcagagtctcactccattgcccaggctggagtgcagtggcataatctcagctcactgcaacctccacctcccaggcgcaagcaattcttgtgcttcagcctcctgagtagctatgactgcaggcatgccaggctaatttctgtatttttagtagagacagggttttgctgtgatggccaggctgctctcgaactcctggcctcaagtgatccacccacctcagcctcccaaactgctgggattataggcatgagtcaccactactgggcttcactgatcttttatatatatatattttcattttaatttcgtttatttctattctggtctttattatttcttttcttcaactaactttgggtttggtttgcttttgcttttctagttgtttaagatgcatcattaggttgttcggagtttttcctcttttttgatgtaggcactcatagtgataaacttcactctgtatcccatacgttttggtatgctgtgtttccattatcatttgtttcaagaaaattttcaattttcttcttcttcttctttttttttttttttttttgagatagagtctccctctgtagcccaggctggagcgcagtggcacgatctctgttcactgtgaccctgcaacctccgcctcccgggttcaagcgattctcctgcctcagcctcccaagtagctgggattacaggcacccaccatcacacttggctaatttttgtatttttattttaactaattaattaattaattttttgtttgttttgagacagagcctcactctgttgcccaggctggagtgcagttgcaccatctcggctcattgcaacctctgcctcccaagtttaagtgattctcgtgcctcagcctcccaagtagctgggattacaggcgtgcaccaccactcctggctatttttaaaaaaatatttttagtagagaccgggtttcaccatgttggccaggctgttctggccaacatggtgaaactcctgacctcaggtgagctgcctgcctcagcctcccaaaatgctgagattacaggcatgagccaccacacctggtcctttttttttttttttttttttttttaatacaggacctctctttgtcacccaggctggagtgcagtggcatgaacgtataggtatgcaccaccacgcctggctaatatttgtatgttttgtaaagactggattttgccatgttgcccaggctggtcttgaactcctgagctcaagtgatctgcttgcctcggcctccagattacaggaggtgctgggattacaggtgtgagccacggtgcccagcctctatattttctttttctattatatttatgatgattgttagggaggtagacattagctaatttgtttcatcaagtcttcagaatatagttccaatgtatactcaataccagccctgtccagtagaaatataatgtgagttagaaatgtaacttaaaattttctagtaatcacgtttaaaaagtaaaaataaataggtgaaattaatttttaatataataataattttaatgctatagcccagcatattcatacatttttgttccagcatataatcagtatacaaaattgctgagatattttactttcttattttaaactaagtctttgaaacccatgtgtattttacaattaaagcacatcccaatttgaactagccacattttaagtgctcagtagccatatattgctaccatattagagagtgcagatctagactaaaaagtttagtagtaaaactcagtcaagataattggctttcattgaatctcaaaggactttatttgtaatcttccctgaactatcttttcctttaaatacaacaatgggatcctcagattaagaatgacagagttattaggaaatatcccaagacagggccacatagtttagaatcatgagcatacttattttacagcctgtacagaaatcttacagataatcagtgagataatcactgatgccacctggtatgcacctattagggggaatagtacagtttatggccgggtgccgtggctcacgcctgtaatcccagcactttgggaggccgaggctggtggatcatgaggtcaggagatcgagaccatcctggctaacactgtgaaaccccgtctctactaaaaatacaaaaaattagctgagtgtgctggcgggcacctgtagtcccagctactcgggaggctgaggcaggagaatggcgtgaacccgggaggcggagcttgcagtgagctgagattgcgccactgcactccagcctggccgacagagtgagactccatctcaaaaaaaaaaaaaaaatacagtttataaaataaagacattgagtgacccacagaattgaactttcttagtatgccatacagtgtcttccaagttctggcccctgtatacctttctaatggtgttttctccagccatacataactgcttatgcttgtttgaattcattgtgctttttcacacctctgtgctttgccctctggcgtgttcctttccctcagtatctgcctggaaatctctaactcatccttcagccccacctcaagtaacacttcagtgaagcttatcctgctattcctatattccatccctcaaatgggcatttatgcaatccttttacattgctgtagcgtcttccactcacagcacttattacattatattataatttttaaatttttatttatttttaattttttcccttcatcctactttgatctcatgactgattactactataatttttagaatgtaattacctttggtagtgcaatcctcatgatggcatagactgcttcactcatctttatattcctagcaagacaccaggcattcaagaaatgtttgttgaactaaattttacaaggagacacgtagacatcagccaaagcagaaagggtgcagtttccttggattctgttcagggctgagttgctaatagctttgatcttggccaagttagttaacttctccatgctttattttaatcaattataaaattagagtgtattactggaattttaaggtgatttagaactttaaaaagttggttcattgatgcatgtatgagactgtgtcttgttcatgtcatatctttggtgcttaacaaagtacttggttatcattaaagttttattgaatgattgaataaaataactcttgtctcttttctttctttctttctttctttctttctttctttctttctttctttctttctttctttttctttctttgttttccttccttccttccttccttccttccttccttccttccttccttccttccttccttttttctttctttctttccttagatggagtctgtctctgttgtccaggctggagtgcagtggcatgatctcggctcactgcaacctccgcctcctgtgttcaagcgattcttctgcctcagcctcccaagtagctgggactacaggtgcatgccactacgcccagctaatttttgtatttttagtagagacggggttttaccatattggccaggctgctttcgaactcctgacctcgtgatctgcctgcctcggcctcccaaagtgttgggattacaggcatgagccactgtgccaagccaactcttgtctgtttcattcatattgcccacaaggatagcaacactatcaccaagagttactctctgtatatatatataaaacatatatatatgttatatatatataatatataacatatattatatataacatatatataaaaatatatatgttatatataatatatatctatttttgagacggagtcttactctgttgcccaggctagagtgcagtgtcgtgatctcggctcactacaacctctgcttcttgggttcaagcgatcctcttgcctcagcctcctgagtagctgggactgcaggtgcacgccaccacatctggctatttttttttgtatttttagtagagatggggtttcaccacgttggccaggctggtcttgaactcctgacctcaagtatttgtcctaaggctctccctccctttggcccccaccacctgatgggccctggtgtgtgatgttcccctccctgtgtccatgtgttctcatgcttaactcctacttatgagtgagaacatgtggtgtttggttttctgttcctgtgttagtttgctgagaatgatggtttccagcttcatccatgtccctgcaaaggacatgaactcattctttttttatgactgcatagtattccatggtgtagatgtgctacattttctttatccattctatcattgatgggcgtttgggttggttccaagtcttcgctattgtaaatagtgctgcagtaaacatacatgtgcctgtggctttatagcagcatgatttataaccctttgggtgtataatcactaatgggattgctgggtcaaatggtatttctggttctagatccttgaggaattgccacattgtcttccacaatggttgaactaatttacactcccaccaacagtgtaaaagtgtacctatttctctgcatcctctccagcatctgttgtttcctgactttttaataatcgccattctagctggtgtgagatggtatctcattgtggttttcatttgcatttctctaatgaccagtgatgattaactttttttcatatgtttgctggccgcataaatgtcttcttttgagaagtgtctgtttatatcctttgcccactttttgatggggttgtttttttcttgtaaatttgtttaaggtccttgtagattctggatattagacctttgtcggatggatagattgcaaaaattttctcccaattctgtaggttgcctgttcactctgatggtagtttctttggctgtgcagaaactctttagtttaattagattcaatttgtcaattttggcttttcttgccattgctttggtgttttagtcatgaagtctttgcccatgcccatgtcctgagtggtattgtgtaggttttcttctagggcttttatggttttaggttttacatttaagtctttaatccatcttgagttaatttttgtataaggtgtagggaagggatccggtttctgttttctgcgtatggctagccagttttcctggcaccatttattaaatagggaatcctttccccattgcttgcttttgtcaagtttgttgaagatcagatggttgtagatgtgtggtgttatttctgaagcttctgttctgttccattggtctatatatctgttttggtaccagtaccatgctgttttggttattgtagcctattagtataatttgaggtaagacagcgtgatgcctccagctttgttctttttgcttaggattgtcttggctatacaggctcttttttggttccatatgaaatttaaagtagtttttctaattctgcaaagaaagtcaatgatagcttagtaggaatagcattgaatctataaattacttaggtcagtatgcccattttcatgatatttattcttcttatccatgagcatggaatttttttccatttgtttgtgtccccgcttatttccttgagcagtggtttgtagttctccttgaagagatccttcacattccttgtaagttgtattcctagatattttattctttttgtagcaattgtgaatgggatttcactcatgatttggttctctgcttgtctattattggtatataggaatgcttgtgatttttgcacattgattttatatgctgaagttgcttatcaccttaaggagtatttgggctgagatgatggggttgtctaaatatacaatcatgtcatctgcaaacagagataatttggcttcctctcttcctatttgaataccactaatttctttttcttgcctcattgacctggccagaacttccaacactatgttgaataggagtggtgagaaagggcatccttgtcttgtgccagttttcaaagggaatgcttccagcttttacccattcagtatgatattgactgtgggttgtcataaatagctcttattattttgagatatgttccatcaatacctagtttattgagagtttttagcatgaagggctgttgaattttattaaaggctttttctgcatctattgagataatcatgtgctttctgtcattggttctgtttatgtgatggattatgtttatcgatttgcgtatgttgaaccagccttgcatccccgggatgaagccgacttgatcgtggtggataagcctttttgatgtgctgctggatttggtttgccagtatttttttttttttttagacggagtctcgctctgtcgccaggctagagggcagtggcgcaatcttggctcactgcaacctcttcctcccgggttcaagtgattctcctgcctcagcctcccgagtagctgggactacaggcatgcgccaccacgcctagctgatttttgtattcttagtagagacggggcttcaccaggttggccaggatggtctcgatctcttgacctcatgatctgcttgccttggcctcccaaagtgctgggattacaggtgtgagccactgcgcctggcctggtttaccaatattttattaaggatttttgcatcagtgttcatcagtgatattggcctgaaattttcttttttcgtgtgtgtgtctctgccaggttttggtatcaggatgatgctggcctcataaaatgagttagggagtagtctctctttttctattgtttggaatagtttcggaaggaatggtaccagctcctctttgtacctctggtagaattcagctgtgaatctgtctggtcctgggatttttttggttgctaggctattaattactgcctcaatttcagaacttgttattggtctattcagggatttgacttcttcctgatttagtcttgggaggtgtatgtgtgcaggaattcatccatttcttctagattttctagtttatttgtgtagagatgtttattgtattctctgatggtaatttgtatttctgtgggaccagtggtgatagcctctttataattttttattatctatttgattcttctctcttttcttctttattagtctagctagtggtctatctattctgttaatcttttcaaaaaaccagctcctggactcaatgattttttgaagggttttttgtgtctctatctccttcagttctgctctgatcttagttatttcttgtcttctggtggcttttgaatttgtttgctcttgcttctctagttcttttaattgtgatgtttgggtgtcaatttcagatctatccagctttccgatgtgggcacttagtactataaatttcccacttaacactgctttagctgtgtcccagcacaacaaccctggtatgttgtctctttgctctcattggtttcaaacaacttcattatttctgccttaatttcgttattacccagtagtcattcaggagcaggttgttcaatttccatatagttgtgtggttttgagtgagtttcttaaccctgagttctaatttgattgcactgtgttctgagagactgtttgttatgatttcctttcttttgttatgatttccgttcttttgcatttgctgaggagtattttacttccaattatgtggtcaattttagaataagtgctatgtggtgccgagaagaatgtatattctgttgatttggggtggagtgttctgtagatgtctattagctccacttggtctagagttgagttcaagtcctgaatatccttgttaattttctgtctcgttgatctgtctaatattgacagtggggtgttgaagtctcccactattattgtgtgggagtctaagtctctttgtaggtctctaacaacttcctttatgaatctgggtgctcctgtattgggtgcatatatatttaggatagttagctcttcttgttgtattgatctttttaccattatgtaatgccctcatcttttttgatctttgttggtttaaagtgtgttttatcagagactaggattgcaacccctgctttttttttgctttccatttgcttggtaaataaccctccatccctttattttgagcttctgtgtgtctttgcacgtgagattgatctcctgaatacagcacagtgatgggtcttgactctttatccaatttgccagtatgtgtctttttttttttttgagactaagtcttgctttgtctcccaggctggagtgcagtgggtcgatctcatctcactgcaacctccgcctcccaggttcaagggattctattgcctcagcctcccaagtagctgggattacagacgtgtgccaccacgcccagcaattttttgtatttttagtagagacagggtttcactatgttggcccagctggtcttgaactcctgacctcttgatccacccgcctcagcctcccaaagtgctgggattacaggcgtgagccactgcgcctggctagtctgtgtcttttaattggggcatttagcccatttacatttaaggttaacattgttatgtgtgaatttgatcctgtcaacatgatgctatctggttattttgctcattagttaatgcagtttcttcatagtgttgttggtctttatattttggtgtgtttttgcagtggctggtaccagtttttcctttccatatttagtgcttccttcaggagctcttgtaaggcaggcccggtggtgacaaaatccctcagcatttgcttgtctggaaaggattttatttatttttatttatttatttatttttgcttatgaagcttattttggctggatatgaaattctgggttgaaaattattttctttaagaatgttgaatattggcccccactctcttctggcttgtagggtttctgtagagagatccactgttattctgatgggcttccctttgtgggtaacctgatctttctctctggctgcccttaacatgttttccttcgtttcaaccttggagaatctgacgattgtgtgtcttgatgttgctcttctcaaggactatcttagtagtgttttccatattttctgaatttgaatgttgggctgccttgctaggttggggaagttctcctgggtaatatcctgaagtgtgttttccaacttggttcctttctccccatcactttcaggtacaccaatcaatcgtaagttggatcttttcacatagtcccatatttcttggaggctttgttcattccttttcactcttttttctctaacctttttttcttgctttatttcattaatttgatcttcaatcactgataccctttcttctacttgatcggatcggctattgaagcttgtgcatgcatcacgtagttctcgtgccatgttttcagctccatcaggtcacttaaggtcttctctacacagtttattctagttagccattcatctaatctttttttcaaggtttttagcttccttgcgatgggtttgaacatcctcctttagcttggagaagtttgttattactgaccttttgaagtctacttctgtcagctcgtcaaagtcattctccatccagctttgttccattgttggtgaggagctgcgatcctttggaggaggagaggcactctggtttttagaattttcagcttgtctgctctggtttctccccatctttgtggttttatctacctttggtctttgatgttggtgacctacaaatggggttttggtgtagatgtcctttttgttgatgttgatgctattcctttctgtttgctagttttccttctaccagtcaggtccctcagctgcaggtctgttggagtttgctggaggtccactccagaccctgtttgcctgggtatcagtagcagaggctgcagaacagcaagtattgcagaacagcaaatattgctgccttatccttcccctggaagcttcatcccagaggggcacccgcctgtatgagatgtcagtcggcccctactgggaggcatctcccatttaggctacacgggggtcagggacccacttgaggaggcagtctgtccattctctgagctcaaacactgtgctgggagaaccactgctctcttcagagctgtcagacagggacgtttaagtgtgcagaagtttctgctgccttttgttcagctctgccctgcccccagaggtggagtctacagaggcagccagccttgctgagctgcggtgggctctgctgagttttagtttccccagctgctttgtttacctactcaagcctcagcaatggcagacccccctccccctgctaggctgctgccttgcagtttgatctcaaactgctgccctagcagtgatcaaggctttgttgtcgtgggacctgccaagccaggcatggaacacaatctcctggtgtgctgtttgctaagaccgttggaaaagcagagtagttgggcaggagtgtcccgtttttccaggtaccgtctgtcatggcttcccttggctaggaaagggaaatcccttgccctttttgggtgaccccttgccctttttggtgaggtgatgccctgccctgctttggctcaccctccgtgggctgcacacactgtccaaccagtcccaatgagatgaaccaggtacctcagttggaaatgcagaaatcacccgtcttctgtgtcgatcacgttgggagctgcagaccagagctgttcctatttgaccatcttggaatggaatcctgaattaacctctttatcagtatataatgacctttgtctctttttagtttttttcatgaaatctgttttttctgacataagtatcggtactcctgctcttttttggtttccattggcatggaatatctttccatccctttattttcagtctgtgtgtgtctttatatgtgaagtgtgtttcttgtaggcaagggatcaatgggttttgttttctcaatttagccactctatgtcttttgatttgagaggttaatccatttacattaaatgttattattgataagaacttactcatgccattttgttatttattttctggttgttttgtggtcttctcttccttctttccttcctgtcttccttcagtgaaggtgattttctctagtgatatgatttagtttcttgctttttattttttgtgtgttcattgtatatttttaggtttgtagttaccacgagtcttgcaaatactatcttataacccattattttaacttgataacaacttagcactctgcataaacaaacagggaaaaagaaaactaataaaaaccttatgccttaacttcatcctcctgctttttaacttttttgttgtttttatttatatcttattgtactatttctggaaaagttgtagttgttatttttcattggttcattgtttattcattctacttagagtagtttacacaccacagttacagtgttataataattgtgttataacagtgttactttttttttgtacttactattaccagtgaggtttgtacctcaagataatttttttttttgagatggagtctcactcttgtctcccaggctggagtgcaatggtgcagactcggctcactgcaaccaccgcctcctgggttcaagcgattctcctgcctcaccctcccaaatagctgggattacagatgtctgccaccactcctggctaatttttgttctttttagtagagatggggtttcaccatgttggccaggctcgtctcaaactcctgagctcaggtgatccacccacctcggcctcccaaagtgctgggattacagggatgagccactgtgcctggcccagatgattttttattgctcattattattataagagaggatcaaaatcctctctttagcatttcttgtaaggcaggtctggtgttgatgaaatccctcagcttttgtttgtctgggaaagtctttctccttcacatttgaaggatattttcactggatatactattctagggtaaaagtttttttcccacagcactttaaatatgtcatgccagtctctcctggcctataaggtttccactgaaaagtctgctgccagacatattggagctccatttcatgtgatttgtttcttttctcttgctgcttttaggatcttttctttatccttgagctttgggggtttgattattgttacatgccttaaggtggttttcttgggttaaatctacttggtgttctataacctttttgtacttggatattgatatctttctctaagtttgggaagttctctgttatccctttgaataaactttctatccctatgtctttctcttcctcatctttaaggccaataactattagctttgctcttttgtggctattttctagatcctgcaggtgtgcttcattgttttttattcttttttcttttgtctcctctgactatgtattttcaaacagcctgtcttcaagctcactaaatctttcttttgcttgatcaattttgctattaaaggactctgatgctttcttcagtatgctagttgcatttttagttcagaatttctgtttgattaatttaaagtatttcaatctctttgctaaatttagctgatagaattctaaattccttctctgtgttatattgaatttctttgagtttcctcaacacagctattttgaattatctctctgaaaggtcacatgtctcttgtttctccaggttggtccctagtgccttatttagttcatttggtgaggtcatgttttcctggatggtgttgatgctagtagatgttctttggtgtctgggcattgaagagttaggtctttattgcaatctttactgtctgggcttatttgtacctgtccttctttggaaggctttccagatatatgaaaagactttggtgttgtgatctaagctgtatctgctttagggggcaccccaagtacagtaatgctttgtttcttgcagactcgtagagataccaccttggtggccttccataagatccagaagcattctctagattacccagcagaggcttttctcttactttctcccagagtctccctctctgttctggaagcctggatctgggggaggggtgacagaagcatccccatggccaccactgccaagactgtactgggtcaaacctgaagccagcacagtactgggtctcccccaaggcctgctgtaaccacctttgtaaccaaggcccgctgctaccacctttgttcactcaaggccctagagctctacaaccagcaggtggtgaagccagccagccttttgtctttctcttaagggtatggagttctcccaggccctgggtgggtccagagatgctgtctgggagccgggacctggagatggaaaccttagacatctacctggtgcactaatctactgtggttgagctggtgttgaaacccccagacaaagtccttcccactcttccctcctttttccccaggcaaaggagtctatccctatgcccaccactacaggcccatggggagtaatgccaggctactgccgatgtttacttaaggcccaagggctcttcagtcagcttctggtgaatcttccaggcctgggactcatcattcaggatagtgggctcttctctgacccaggttaggtccagagacggtgtccaagagccaaggactggaatcctggaccccaagagcctgcttggtgtttttccctactgtggccaaggtggcacctaagctcaagacttactcctccatctgcttttcttaagcagaaggggtctctccctgtagccaccacagctgtgaatgcactgccttgaagggaaggatacagacctggtaggattcatcacctgctaactaaagagcccttgggccctgaataaccatcaatgataaccagggagtacatacccactgtgggccttgctgctgtgggccttgggcgagactctgagatgtgttggcttcaggtgtgaaccagcgcattcacagctatcctttagtctctaaagtttagtgttttgaatgtgactagataggtttcctcaccagaatcaagttggaaattcctttgtgattagcatgatattgtcagctcttgcctccctccacccccagccaattgccttccaaaacttaacattgctttatcttccgatgagcccagtttgtaggtttaggtttgctctattctctgagcctgttctattcaaaggaagaaagaatagtaccattgtagagtagggaagctgttggtttggattaagttatactggccatcagatttgagctttaacatactaggggcatattctatgcacctgtttagctttggagttgtatcatttctttttttattgtggtaagaacgtttaatatgagatttgctgtcagcaaaactttaagtatacattattgactgtaagtatagtattgtatagcagatctgtattgcttattcatcttgcttgactgaaacattatgcccgttgcttagtaactccctattacccctttcccccagcccttggaaaccaccattctactctttggttctatgaatttgactattttaggtatttcatgtaagtggaaccatgcagtatttgtcttgtgactagcttatttcacttagtataatgtcctcaaggttcatccatattgtcacatattatggaatttccttctttttgaagactaaatggcattttattgtatgtatataccacattttctttatccattcatttgctggtggacatttgcatcatttccacatcttggctattgtgaatagtgctacagtgaacatgggagtgctaatatctcttcaagaccctgatttcaattcatgtggataaatacccagaagtgtaattgctgtatcatatgcgagttgtatttttaattttttgaagaaccttcatactgtgttccatagcagctgcaccattttaccatcctaccaacagtgtacaagagttccaatttctctacatcctcaccaatacttcttattttttctttctttctttctttctttctttttcttttttttttttttttgtggcagtgtctcactcttacccaggatggagtgtagtggctcgatcttggctcactgcaacctctgtcttacaggtttgagcaattctcctgcttcagcctcccaagtacctggcactacaggtggtgccaccgtgcccagctaatttttgtatttttggtagagacggggtttcaccatgttgctcaggctggtctcgaactcctgacctcaagtgatccacctgcctcggcctcccaatgtgctgggattacaggcataagccactgcgcctggccttattttctattttttgatagtggttatcttaatggatgtgaggtgatatatcattgtaattttaaattttagtttgcatttccctgatgattagtgatgttgagattttttccatatacctgttggccatttgtatatcttcttggagaaatttttggtactttaaaatattttctatctctgttgaaattctcactttgttcatgcattgctctcttgacctcagtgagcatcttcatgagagttgttttaattctctgtcaggtaaattatataactctatttattagggttggtttatggagattatcttgttcctttgtttggaacatctttgcctggtttttcattttccttgacccactgttggtgcctgtgttaaggcacctctctcattcttcatgggcttgtcttgtacaggagaagggcccccccaattaggcttggcagagattctgggggcctctaccacctctttctctccccagagagaagctggaagctatagtttttgtctgcttgttctgggctgagccagagtggagagctatggcatgtaccagctcaagccactgtctcccattctcccctgagcagctagagtttgccggacccatctgagcctcaaaactagagagatatatgcaagttcttttggcagccctggagaagttggggcactagaggcacagatcaactcttttccctccccaccaggaagcagagagctggagcttttcatctgtggaggtgtatcatttctgcttgtcatgattttcatgaggttagcctgccctgcatccatccctagttaactctccaggatcaggacactgctcagaactacaatacactgctgtgaatagatctgttggaactatggtacatacagttccatctgacttctgctttatgacttgctgcttggattctcttgtaccatatccaatttgtcatttgggacttcctggaacattatataggaaaaattattatctttgtgaccgtggatagaaattacgatttacaatgtaattttagtctatgactaaacctgtttgcctgattttgccagacccttttgacactgttttggatattttggctgtcctcattcaaaccaacctctgcagtttgaatagttttctttagcccacaatcagagctatagtgtagtgctctgaatgcttttggctcatttctttcctttctgctgtttttcagttgtctgagtgtcctagcttatcacttgttccagatccttcctgatagaaccagtatagtggaaagtacaggatttcaaatcagaaagcctgaattcaagtcctagcttactactttctattttatcaccatcaagaagtcactttatccagcaaaaaggcctgatttttaaaaagtcacttcattttgttaaaacttagtttccacatcttatgaaataaaaatatcttccttacagaatagattgaagattaaatgagaatgcatatgaaaaagcttcgagactggaaagcaatatgcaaatgttaattttattgtcatttctggttcttttctcactaaagaagttgcatataattattgtgacttggagtaaaatcttgaattgattttggcaggtctttgagctgctttggcttttgaatgactggttgagctgatggaggtcacagggaaagacttggcaggacagttgatagatttttgcatgttgtaacagaagctcccttcctcaaggacagggaaaatgtttattttctattatacggtacctagaatgttatctacttaatcagaattaattgatacagattaacgtggctgcctcaatcgagtgaacccccagttttaactagaatgcatctcatttaaattaaatggactaaaatctgttgtaaatcatagtttctttttgtagccaggaagataatttaataatttttttcaaaacgtacaatcttgcttgacaaaaccttaatacagtttgctgtcttctcatctcaggagtagactgcattttgtatttgagacagtctctgccgcttaggctggagtgcaatggcgtgatcacaactcactgtagtttcaacctcctaggctcaagcgatcctcccacctcaaccacccgagtagctgggaccacaggtgtgggctaccatgcctggctaattttatttatttatttgtaaagatggggtctgtctatattgcccagggtagtctcgaactcctgggctcaagcaatccccttgccttggcctcccaaattgctggaattacaagcgcgagacactttgcccagctgtagactgcatttatagaagttcttttcatcggatgcagtggcacacacctgtaatgccagctacttggatgggaggatcacttaagcccaagagtttcaggccaggctgggcaacatagcaagaccctgtctcaaaacaaaaacaaaaacaaaaacaaaaaatagaatttattttctgagcttctcccagatgcaaatctcttctttatagtgtaactctcaacctttcagctatgtgatctctatcacttacccagctttgctgactgcattttatccttaaaggactgcaatgctgtcattgcctcagctggtgtcggtgaaattgctcagctgaataacactgaaaatatgttttgaaaggaccagaattatttagacaaaaatgagttaataaaacattaaccacttaagagaacattcacaaatcaaaatatatgtcttcatagtctcataaactatgtaaccagaaactattattggtattctacaataacatcttaggatttttttttttttgagagacaaggtcttgctctgtcacccagctggagtgccgtggcatgatcatagcttaactgcagcttccacctcctgggctggagtgatcctctcacctcagccaccgagtagctggaactacaggtgtgagccaccacacccagataatttttaagttttttatggagatgaagtctcactgtgttccccaggctggtctcaaactcctgagctcaagcaatctacctgcctcagcctcccaaactgttaggattacaggcatgagccaccacggctggccaggatgttttttttaaaacgtatattggtggcatgtgcttgtagtcccagctactcagcaggctgaggcaggagaattgcttgaacctgggaggcggagattgcagtgagccaagatcccccactgtacttcagcctaggtgacagagtaagactctgtcttaaaaacaaaacaaaacaaacaaacgaaagtttatattggggttttgttttcttctcaaaaatatttttaaaaatctgttctttaaacaatatttgtatttttaaaaacatcaattttaaaatctccctgattctgttaccaatattttgagtaagggctatataaatatatgcccctcagcccaatacttacctaatcttagaggagtcaagatatttaacatcagtctttccattaaacaacttatgggaaaaagaaagatagagggtttcttttttcttttttctttttctttttttttttttttttgagatggagtcttgttctgttgcccaggctggagtgcagtggccgatctcagctcactgcaacctctgcctcctgggttcaagagattctcctgtctcaccttctggagtagctgggactgcaggtatgtgccaccgtgcctggctaatttttgtatttttcttttcatatatagtttttcacctaaagtatttaaaatgtgtgaattttaaatactttttaatttgctttgtgacgtctttattggaatctatagtcttatgtttagctagaattttaatttttaatttttatttttatacgtacatagtaggtgtatatatttataggatacatgagatattttgatacagacatagaatgtgtaataatcacatcagggtaaataggatatccatcacctcaagcatttgtttaactgaaatttttgtagctgatttattttttactgtagcaaggtaaaagttctgtttattttagcagcttaaaaatcttttagaaggtgcttttatagtactgttatgaatattaacatttttgctaatttgaggctcaagaatgttgcaagaaattagaaatatgtagcttatggacatttctgtcacgagtttgaaaaaaacctcaattttgataatatgaagggcatcaattgtgattctacatcatgcttattgtttagttttagttttttttttttttttgagacacagtcttgctctgttgcccaggctggaattcagtggcatgatctgagctaagtacaacctcaacctcccaggctcaagcaattcttatgcctcagccaccccagtagctgggattacaggcgggcacaccacgcctagctaatttttgtatttttaatagggatggggttttgccatgctgagcaagctggtcttgaattcctggcctgaagtgatctgcctgcctccgcctcccaatgtgctgggattacaagcatgagccactgggcccggtctagttttagttttagtttttttttttttttttttttttttggatgatgtcttgctatgttgcccagcctgtttcaaactcctgggctcaagggatcctcctgccacagcctcctgagtagttggtactacaggcgtggagcatcctgcccagctaatgcttgggtttgaaggaattccatggcctggtaagattcagctatttggagtctggagctcagaccatttagaaaatggtgacatcatttgtgcagattcaatatctggttaatgttgctaattgagcatgtcatttttttcttgcaaagtaagttcaagacttcagagccagcagttagctatgtctgtctaatgcttgaaaatattagtaagtttttcagttttacagggcacatattcagaacttctttcagaatttctacattttctggttttgaagacactgttaagttcagttttgcagggtttttgtttgtttgttttagagaaagggtctcactctgtagcccatgctgcatggagtacagtggcaggatcgtagctcactgtagccttgaactcctggactcaagtgatcctcctacctcagcctttggactagctagggctaaagacgtgtgccaccatgcttggcctgttttgtacttttaatattacctaataacattactatttgtgaagtcaatgcattttactttctgagaatgagtaatgattaagttataaacaagtgactcccaaagaatgcaaattttatttgaaaattatactctagcttaaagaaactttaaatctccagtttggttttactctaaggatcaagttccttcatgctgtattcatttggccaatgatttagacatagatttaaaaatgatttgctacatttagccaatggtaatagttcacagcacatttatcatccattgtcatttcagaagttgttgaaaacctggttacaaatgataattcacctaacataccagaggcaattgatagactcttcagcgacatagcaaatatcaacagggagtctatggctgaaataacagacattcaggttagtataaaaataattctgtttatgataagtttcgatgattcttcattttaaccaatgtattatataggtaaaaaagtagtcttcatgcttaaccattgctaaacatataaaaatctatttttggatgttcacacctaatttagggggaaaaattttagaaaccaatgggaacatatgtgctcgtttaatatttattatttatttatttattagcaatgttatttattattaatatttattaacctccccaggcttcagttttctcacctgttaaatgataatagtaatacccacctccaagtgttgttatgaatagtaaacaaaataacatatataaggtcctgggcacatactagttctcttttccttccctttgcaacaaagtagtggagccacccagtagtggagaactcagttgactataagccttcagaagtgctttttttgggggtaattttctaatgtttaaatgaaggtctgttacttacttaatatggaagctgtcttgaggcttgaaacacttttgagaatatttaccttgggcaaatacttccattttggtgactacttgtatggaaaggtgagaggaaagtttactgtaaatctctcttcctctttatatatataagtatctatatatgtatatatgtgtttatgtatatataaatacctttatttagatataatttacataccatgcaattcacccatttcaagtatacaattcaatagtttttagtatttcacagagttgttgtgcacctatcaccacagttagttaattttagaatattttcatcacctcaaaaagaaaccgcacacccgttcacaaacactctccatttcctcccatcctcttccctccctcaccctcagccctaggcaaccactaatctacttttggtctctatggttttgcctaatgaggacattttatataaatagaatcatacaatgtgtggtttactgactgttttcacttagcaagatgttttcaaagttcatccatattgttgcatgtatttgtacttcatacatttttatgactgaataatatcccattgtatggatataccatattttgtttgtccattcatctattcatgaacgttttcattgcttccaccttttggctattatgaataatgctgctataaatactcatgtacagatttttatgttttcatttttcttaggtttgtacctaagaatgaaattgcttccaccttttggctattatgaataatgctgctataaatactcatgtacagatttttatgttttcatttttcttaggtttgtacctaagaatgaaattgctgggccatgtgttaactctaaacttttttttttttttactttttttaaattttaagttctagggtacatgtgcacaacgggcaggtttgttacatatgtatacatgtgccatgttggtttgctgctgccagattgttttccaaagtggccgcaccattttacattcccactagcaatataagagggatccagttggctgggcacggtgactcacgcctgtaatcccagcactttgggacgccgaggcgggcagatcacaaggtcaggagatcgagaccatcctggctaacacagtgaaaccctgtctctactaaaaatacaaaaattagccgggcgtggtggcaggcgcctgtagtcccagctacttgggaggctgaggcaggagaatggcgtgaacccagaaggcggagcttgcagtgagccgagattgcaccactgcactccagcctgggtgacagagcgagactccgtctcaaaaaaaaaaaaaaaaaaaaaagagggatagagggatccagtttttccacctccttgctgacatttgtcattatttgtctttttgattatagtcattctagtgggtatgaagtgttatctcattgtgttttttattgcggtaaaatacacataacacaaaatttaccatcttaactatctttaggtgtatagttcccttgtgttaagtatgttcacattgtgcagctattatctagaacccttttcgtcttgcaaaactgaaactctatatccattaaacaactcccccttgccctctaaaattcttacgaattttgggatcagcttgtcaaccaccattctactttctctctctataaatttgactactctcagtacctcatgtaagtggaatcatgtaataattgtctttttgtggctggtttatttctcttagtataatgtcttcaaggttcattcatgttgcagcatgtgtcagaatttccttcctttttaagactgaataatccattgtatgtgtgtaccacattttgtttatccattcatttgttgatggacacttgggttgcatctaccttttgcctattgtgaataatgttgctatgagcattggtatggaaatttctgttcaagtccctgcatttaattcttttggatatatacccagaattggaattgctgtatcatatggcaattctgtttttaattttttgaggaaccaccatactgttttccatagcaactataccattttacatttctattagtagtgaacaagggtaccagtttcttcacattatcaccaatacttgttgttctgtttttttattgatagtagtcatcctagtgactgtgaggtggtatctcagtttttgtttttgtttttgttttttttttttaagacaatcacactctgttgcccaggctggagtgcagtgtcaggatctcagttcactgcaacctctgcctcctggtttgaagcagttctcgtgcctcagccacccaagtagctgggattacaggcaggcgccaccacacctggctaatttttgtgtttttagtagagatgtgtttttgccatgttggccaggctggtttcgaactcctggcctcaagagatccacccacctcggcctcccaaagtgctgggattacaggtgtgagccactgtgcccggtggtaaatctctttttagatcataacctcttactgtacttagctgttagtgaaaacaaattataagattccaagagtttgggtttgtttgtttgtttgtttgttttttgagacagtgtcttggtttggagtgcagttgcatgatctcagctcactgcatcctcgacctcctaggctcaagtgatccccctcagccctccgagtagctgggactgcaggcatgtgccaccatacccagctaattttttgtatttttcatagagatggggtttctccatgttgcacaggctagtcttgaaatcctgagctcaagcaatctgccctctttggcctcccagtgttagaattacaggcatgagccataagagtttggtcttatttttgaagaagatctgcttggttttggaaatgccttgaatttattttctttctggaaagtctaatcttcatattatttacttctgtttgcagcatgtatttaccatgcttatcattatacatttatgtaaacctaagacaaaacctgccacatcttaggtgcttaatatatatgtgttgaataaatatgttttctgattatgaagtatttacagtcatagtttatcttatcctttctaacacaatatgagaaaatacaagaatttatttaaaatcataaagtaacataacttcacagaaagtttaaaaaaatggatacaaaatcacatgcaaacacaccacttcaatataactactattattttaatgtattttctttaatagttttacagtttaaatgttatttagctataattatactgtacatgtaatatttctggcatcataaaaggcaatttgctctgttttcccaacattttaaaataaacattttcaaacagaaaagttgaaagaatattacactggacacctatgtaacagccacttacattctacagttgtaaacattttaccatattcgcttcatcacatatacatttgtccattagcgcatcttattttttgggtgcattttaaaatgagttgctgacaacagtacacttcccccctaaatgttttagtgtgcatatcattaactagaatccaatattttattgaagttcttctttggggtaagatttgcatatgtacaactttctgtacatacagttttgtatctttccttctttcctttttcactagacatgtaataaatattttcccgtgttaaaaacatagttttcatgaccactattttattttatttttgtttttatttttatttttttgaggcagagtctcgctctgtcgcccaggctggagtgcagtggcacgatctcggctcactgcaacctccacctctcaggtttaagtgattcttctgcctcagcctcccgagtagctgagactacaggtgtgcaccaccacacctggctatttttttttttttttttgtatttttagtagagacggggtttcaccaagttggccaggctggtctcgaactcttgacctcaagtgatccacctgcctcggcctcccagagtgctgggattacaggcgtgagccaccatgtctggccatgaccactattttaaatggatgaatactattccatcaaggaaggttatcataattcacctatttctttattattggatatttatattgtttctcatattgttcctcatttttcactattataaataatgatatgaagaacactattaagtgcaaagattatccccccacacattttcatctatttcttaggataaagtctcaaaagtgcaactattgggacaaaagatatgaactttatttgtttatttatttatttactcatttatttatttttattgagacagagtctcgctctgtctcgcccaggctggagtacagtggcatgatcttggctcactgcaacctccgcctcctggggtcaagtgattctcatgcctcagcctcccgagtagctgggattacaggcacctgccaccacgcacgactaatttttgtatattttagtagagacagggtttgaccatgttggccaggctggtctcgaacacctgacctcaggcaatccgaccgcctcggcctcccaaagtgctgggattacaggtgtgagccaccgcacccaggcgaacatttttatatgttgccaaattgctttccaaaatgccaaacaagtagcttctttaagctatttagtctggatgctcatttcccatcataatatgtcaaatcatttgttcttctgggtaatttggagtgcagttattaactccatgtgtttttagtgatacaaatgaaataatacttagtatgaaagtcagccgggtgtggtggctcatgcctgtaatcccagcactttgggaggttgaggcgggcggatcacctgaggtcaggagttcgagaccagtctggcctacatggtgaaaccccatctcaagtaaaaatacaaaaattagccaggcattatggtgggtgcctgtaatcccagctacttgggaggctgaggtgggagaatcacttgaacccgggaggtggtggttgcagtgagccgagatcacgccattgcactccagcttgggcaacaaaatgagactctgtctccaaaaaaaaaaaaaaaaaaaaaaaggaagtcatcatttgatcaactgtggcattgaggatactatgtgatggagatggacatgataattagccccagaataataagtgaaatgacaaccatgctgcattaggctgtttgcattgctataaaggaaatacctgaggctgggtaattgataaggaaaagaagtttatttggctcatggttctgcagatcatataagaagcatggcactggcatctgcttccagtgagggcctctggaagtttccaatcatgttggaaggggaaagggagcaggcatcacatgatgagagaggaggaaagagaaaggaggaggtaccaggctcttttttaagaatcagatcttgcagtaactaatagactgagaactcactcattactgtgaggacagcaccaagacaatgagggatccatccccgtgacccaagtacctcccatcagccccacatccaacattggggatcaaattttgatatgagattctcaggggaaaaatatccaaactatatcacatgttaaataaatcatctgtttaaactgaagctcatcagaaaaatgtgaaatggtaagtgagaaaagtggcatggaagaaaagacttaaaactaacatacattttgtaccactgctgtgcataaattgggttaaagaaaagaaataaaacaaagaataaatgatacaaagtaatataattaattgccaaattgtatacaacttaatgaatatatgaattcaaagaagaaagaacaacgtagactgtaatggttgctgaaagcttcatttatgttgttggtgagactgaaatggatttgagttacataaaaacaaagggaggaggtatatcaggtgaaggtatatcaatagtatgaataaagacacattgataggaatgaacaagttgtgttcaggaaatagataattactctaacagtgggtaagtttttgcggggagaggtagaatgcgactagattatggagggcctggaaatgacccacaatagttacataagcatacaacattcaagaatgaaaataccgttggaggtggccagtattttaactaactaaggaaatgtttctctttgaccagattgaagaaatggcagtaaacctatggaactgggcacttaccataggaggaggttggcttgtaaatgaagagcagaaaattagatgtatgtatacatattgtgacatgtattatgaggcgtgttcttactatatattgggtagtattcctgcagtttaaataatgttttgacccattcttagatagagatttgttaaaagacaaacaaaacaacccaggaacaatggtttctcaagcaaatggcctccctcagttttatgatttttttttcagaggttagctccttattaacaaacgtttaaagatatcactgcaagaaatagtcaggaggtgaacaacaaagatgattaaaaggtgggacagtgagaacttaaagaaatgttaaaggacatggattatttctcatggagatgatcaaaatcttcagggttctgaaggaccatcaaatagtagtttcccctctattaataatagaataagtgttgccatatgacatattcagattttaaaaagtgtaaagaatagtttcctcaggagatggattgataaacattggaatgagttactgagaaactatagaaatgatttctacctgtgagagcaaacaacaagaacaaaaaaaccaaaaatctcaaactaaactcatcttcttggatgctttgaatgtggtccactgtctggcaatgttctagtgctttagctaaatgggcaaagtctagtgtgctgacagttagtgattttcaacaggcatagtgacagcaaatgcatttatgggaagtatattgccaattataaaggatacattgaagtaacataccaaagggtgaacctctggactgcttgacattgtaaagacaaatgacttttgtctgtatgcaacaaatataatttactactaactatttatctttgtgaatatgaacaaaactgtatacaacttccgtgtagatatagggtaattgtgcttaatataatcaagaatatacttgctcatgagtccactctattagcatgtttagagaacagttctagctctttaactcttagataaattgatatcattgctcccaggagcctcagatcctgtagttatggggaggtaagagctaggaatttatcagtggaagaaacttagtacacaggtgaaccgtgtgatattaaagtgcgttaattcttaactcctaccattctgcatatgaggaagtattgctttagctgtttactgcttatcagatagggatatggtagatgaagtgggtgtcacagcctcttcccatgtactgtctcatttctttttttctttttcttttttttttttaagggacggcaaggggtgagggcagaaccacacagtgttgatggggttagggccagggagatgagagagctagggaagagaaaagagactgttaaaaaaaagggggggtgctgtaagaggaaaaatactaaatgggtggggaaagtggagaaaaaagggggaagcaagaagaggagaaaggcaagaggggagagaagaagagggaaaagcaagagataagagaagaaaagggaaggataagagaggggacaagagacagtaaagaagagagtcccatgtactgtctcatttcacgtagcagttcttaatcagatatttgggtgcttgttatgtgtatcatactttttttgatacagtggagaatagattatcagcgcaggaggcctccaaattaaaataattttgtttcaaaaatatgtttattggaatatattttgtttccttaaaaacaaatttagtgtgcctggatgtgatgaaataagtcatgaagatttataagctataattctttattatttggaggaattatggaacaatgaacaggaaagtcagaagtagatgaatgacttgtaagttttagttttagacctgttgcatttgagatgacaataaggttggagatgtgagactagagcttatgagaaaggtcaggactgagcctacagatttggcaatgatttacacagaggtggtagttgaagacagaagagtagttgagttctttgaggaaaaaaataaagagcagtggttcttaaatattggtataaatcagaatcaggctggtagcggtggctcacgcctataatcccagcactttgggaggcctaggtgagtggatcacctgagatcaggagttcaagaccagcctggccaacgtagtgaaaccccgtctctattaaaaatacaaaaattagtcgggcatggtggtgtgtgcttgtaatcccagctacttgggaggctgaagcaggagaatcgcttgaaccctggaggtggaggttgcagtgagctgagatcgcaccattgcactccatcctgggcgacaagagtgaaactccgtccctccccctccccccaaaaaatcagaatcacctgtgaagcctgtgaaaaatacagatgcccaggcccttccattggtggttttgattcatttaggttcaggatgaaacctgggcatgtctataatttgaaaaaatgtctcaggaattctcatgcacaccaaaatttaagaatcagtggtattgagagaagaacaaagtagtgagattttaactctgaatctaccagcttcaaagttaaaataaaaagaatagggatagatgaccaaaaggaacagtcaaaaaattctacaggagattggccaggcacagtggctcacgcctgtaatcccagcactttgggaggctgaagcaggtggatcacgaggtcaggagattgagaccatcctgactaacacagtgaaactccgtctctactaaaaatatgaaaaattagccatgcgtggtggtgggctcctgtggtcccagctgctcaggaggccgaggcaggagaatggcgtgaacccaggaggcagagcttgcagcgagccgagattgcgccactgcactccagcctgggcaacagagcaagactccctctcataaaaacaaaaaaaaattctacaggatatttattagtcatttattgagtgcattctccgtatagggttctcgtaccatgttatggtacatagtaaatgaaagggaaaaggtaagataccagaacaaagataccaatcttaaattatgcttgaggatttcggaaggaatagtttaaagctagataaacaataatttaaaaatttataaatgtcagagggtataaccccgtgtttatctaaagtcaattcaatttcaggctgtgggtagagcagagtaaagcggatgttcaaaggtatcagtcaccaattatgtaaccaagatgtttataatatagagaggtcaagaacaggctggtgagaagacaagatggagcaacagcaacaaagaaaacatctttatatggaagtagcattctgtttcagcctcagctgcctttggcttgaagacttattggtgataactataaacagctggattatgaatgtcaggattggagcagacaaagttcttagactaagatatttcccacacaaggaccaggatatttcaggccaagagggtaatttttttttttttgagacaggatctggctctgtcacccaggttggagtgcagtggtgcaatattgactcactgcaacccctgcctcctgggctcaggtcaacctcctacctcagcttcccgagtagctgggactacaaggcatgtggcatcacaccttactaatttttgtattttttgtagatacaggttttgccatgttgcttaggctggtctgaaactccaagggagtaatatttttcaaaaaggttatggccattttgaaatgttgctatgaagttaaggaaggtgatctttgggagtgcagttttagtaaagtggtaaggatgcaaaacagattgtggacatttaaggagatgagtgggtagcaagacagtagagctagtagacagacttttcaattcaagaagcttgtcaatcaaaggaagaggagaaatgggatgcaagcttgaagcatagtggggttagttgattttttttttcaaggtaaggagatgggtacgtttgaaggtagagaagaaggaataagttgagagggaggtactcaagatacttttagaaaggggcaataattgagagatcagagtctttgaaaatactgaaggattagcaaactttggaactttggaataaagaaaggaaacattttctttttcttttctttattttattttgttttattttattttattttattttattttattttattttattttattttattttattttattttattttattttattttactttaagttctgggatatgtgtgcagaacacgcaggcttgttacataggtatacatgtgccatggtgatttgctgcacctatcaacctgtcatctaggttttaagccccgcatgcattaggtatgcgtcctaatgctctccctccctttgcccccacccgctgacaggcccgggtatgtgatgttcccctcccttgtccatgtgttctcattgttcaactcccacttatgagtgagaacatttagtgtttggttttctgttcctgtgttagtttgctgacagtgatggtttccagtttcatccatgtccccgcaaaggacatgcactcattcttttgtatgtctgcatagtattccatggtgtatatgtgccacattttctttatccagtctatcattgatgagcatttgggttggttccaagtctttgctattgtaaatagtgctgcaataaacatgcgtgtgcctgtgtctttatagaagaatgatttataatcctttgggtgtatactcagtaatgggattgctgggtcaaaatggtatttctggttctagaaaccagaggaatcgccacattgtcttctacaatggttgaactaatttacactcccaccaacagtgtaaaagcgttcctatttctccgcatcctcaccagcatctcttgtttctgactttttaatgatcagcattctaactggagtgagatggtacctcattgtggttttcatttgcatttctctaatgaccagtgatgatgagcttttttaatatgtttttttggcctcaaaaatgtcttcttttgagaagtggctgttcatatccttcgcctactttttgatggggttgtttgtttttttcttgtaaatttgtttaagttccttgtagattctggatattagacctttgtcagacggatagatggcaaaaattttctcccattctgtaggttgcctgttcaccctgacgatagtttcttttcctgtgcagaagctctttagtttaattagatcccatttttcaattttggcttttgctgcaattgcttttggtgttttagtcatgaagtctttgcccatgcccatgtcttgaatggtattgcctacattttcttctagggtttttatggttttaggtcttatgtttaagtctttaatccatgttgagttaatttttttataaggtgtaaggaaagaatccagtttctgttttctgcatatggctagccagttttcccaacacatttattaaatagggaatccttcccccattgctttttttttgtcaagtttgttgaagatcgaatggttgtagatgggtggtgttatttctgaagcctctgttctgttccattggtgtatatatatttgttttggtaccagtatcatgctgttttggttactgtagccttgtagtatagtttgaagtcaggtagtgtgatgcctccagttttgttctttttgcttaggattgtcttggctacacgggctcttttttggttccatatgaaatttaaagtagttttttctagttctgtgaagaaagtcagtggtagcttgatgggaatagcattgaatctataaattactttgggcagtatggccattttcatgatattaatctttcctatccatgagcatggaatttttttccatttgtttgtgtcctctcttatttccttgagcagtggtttgtagttctccttgaagagatccttcacattccttgtaagttgcattcctaggtattttattctctgtgtagcagttgtgaatgggagttcactcatgatttggctgtctgcttgtctattattggtgtatgggaatgcttgtgatttttacatattgattttgtatcctgagactttgctgaagttgcttatcagcttaaggagtttttgggctgggatgatggtattgtctaaatatacaattatgtcatctgcaaacacagacaatttgacttccactcttcctaattgaatacgctttatttctttctcttgcctgattgccctggccagaactttcaatactgtgttgaatgggagtagtgagagagggcatccttgtcttgtgccagttttccacaggaaagcttccagcttttgcccattcagtatgatattggctatgggtttgtcataaatagctcttattattttgagatatgagagtttttagcatgaaatggttttgaattttattgaaggccttttctgcatctattgagataatcatgtggtttttgtcattggttctgtttatgcgacggattacgtttactgatttgcctatgttgaaccagccttgcatcccagggatgaagctgacttgatcgtggtagataagctttttgatgtgctgctggattcgatttgccagtattttattgaggattttcgcattgatgttcatcagggatattggcctgaaattttcttttctgttgtgtctctgccaggttttggtatcaggatgatgctggcctcataaaatcagttagggaggagtccctttttttctattgattggaatagtttcagaaggaatggtaccagcccctctttgtacctctggtaggattcagctgtgaatctgtctggtcctgggatttttttttttttttggttggtaggctattaattactgtctcaatttcagaacttgttagtggtctattcagggattcgacatcttctggttttgtcttgggagagtgtatgcatccaggaatttatccatttcttctagattttctagtttatttgtgtataggtgtttatagtattctctgatggtagtctgtatttctgtgggatcagtggtgatagcccctttatcatttttactgtctaattgattcttctctcttttctactttattaatctggttagcggtgtatctatttgcttaatcttttcagaaaatcagctcctggattcattgatttttttgaagggttttttgtgtctctatctccttcagttctgctctgatcttagttatttcttgtcttctggtggcttttgaatttgtttgctcttgcttctctagttcttttaattgtgatgttcgggtgttgatttcagatctttccagctttccgatgtgggcatttagtgctgtaaatttcccacttaacactgctttagctgtgtcccagagattctggtatgttgtctctttgttctcattggtttcaaagaacttcactatttctgccttaatttcgttatttacccagtagtcattcaggaacaggttgttcaatttccatgtagttgtgcggttttgagtgagtttcttaatcctgagttctaatttgattgcactgtgttctgagagactgttttgatttccgttcttttgcatttgctgaggagtgttttacttccaattatgtggtcgattttagaataagtgctatatggtgctgagaagaatgtatattctgttgatttgaggtggagagttctgtagatgtctattaggtctgctttctccagagctgagttcaagtcctgaatatccttgttaattttctgtctcgttgatctgtctaatattgacagtggggtgttaaaatctcccgctattattgtgtgggagtttaagtctctttgtaggtctctaagaacttgctttatgaatctgggtgcccctgtattgggtgcatatatatttaggatagttagctcttcttgttgaattgatccctttaccattatgtaatgcccttctttgtctcttttgatctttgttggtttaaagtgtgttttatcagactaggattgcaacccctgctttttttgttttccatttgcttggtagatcttcctccatccgtttattttgagcctatgtgtgtctctgtgtgtgagatggttctcctgaatacagcacactgatgggtcttgactcgttatccaatttgccggtctgtgtcttttaattggagcatttagcccatttacatttaaggttaatattgttatgtgtgaatttcatcctgtcatcatgatgctagctggttattttgctcgttaattgatgcagtttcttcatagtgccattggtctttatattttggtatgtttttgccgcggctgttaccggttttttctttccatatttagtgcttccttcaggagctcttgtaaggcaggcctggtggtcacaaaatccaacagcatttgcttgtttggaaatctcttttgctcgtgaagcttattttggctggatatgaaattctgggttgaaaattcttttcttttcttttttttttttttttttgagatggcatctcgctctgtcacccaggctggagtgcagtggcatgatctcggctcactgcaacccctgcctcccgggtttgagtgattcttctgcctcagcctcccgagtagctgagactacaggtgtgtgccaccatgcccagctaatttttttttttgtatttttagtatagaaagggtttcactgtattcgccaggctggtctcgaactcctgaccttgtgatccgcccacctcggcctcccaaagtgctgggattacaggtgtgagccactgcaccccgctgaaaattcttttctttaaaaatgttgaatattggcccccactgtcttctggcttgtaggatttctgcagagagatccactgttattctgatgggcttccctttgtgggtaacctgacctttctctctggctgcccttaatatgttttctttcatttcaaccttggagaatctgatgattatgtgtcttggggttgctcttcttgaggagtatcttagtggtgttctccatatttcctgaagttgaatgttggcttgccttgccaggttggggaagttctcctggataatatcctgaattgtgtttttcagctgggttccattctccctgtcactttcaggtacaccaatcaatcatacgtttggtcttttcacatagtcccatatttcttggaggctttgtttgttccttttcactcttttttctctcatcttgtcttcacgccttatttcagtaagttggtcttcaacggtcttcaatctctgacatcctttcttcgcttgattgatttggctgttgatacgtgtgtatgcttcacgaagttctcctgctgtttttcagctcatcagttaatttatgctcctctctaaactggttattctagttagcagttcctgtaaccttttatcaaggttcttagcttccttgcattgggtagaacatgctcctttagctcagaggaatttgttatacccaccttctggagcctacttctgtcaatttgtcaaactcattctctgtgcagttttgtgcccttgctggagaggagttgcgatcattttgaggggaagaggcattctggtttttggaattttcagcatttttgcactggtttttcctcatcttcgtggatttatctacctttttgatctttgaggctgatgatctttggatggggtttttgtgtgggggtcctttttgttgatgttgatgttgttgctttccatttgttagtttttcttctaagagtcaggcccctcttctgcaggtctgctgcagtttgctggaggtccactccagaccctgttcacctggttatcactagtggaggctgcagaacagcaaagattgctgcctgctccttcctctggaaactttgtcccagcggggcaccagcctaatgccagctggagcttttctgtatgaggtttttctcgacccctgttgggaggtctctcccagtcaggaggcacgggggtcagggacccacttgaggaggcagagtctgtcccttgtcagagcttgagtgctgtgctgggaggatcctccttgttaggatcagctgctctcttcagagccggcaggcaggaaagtttaagttcactgaagctgtgcccacagacgccccttcccccaggtgctctctcccagggtgatgggagttgtatctataagcccatgactggggctgctacctttctttcagagatgccctgcccagtgaggaggaatctagagaggcagtctggccacagccgctttgtcgcactgtgttgagttctgcccagtccgaacttcccctcttctttttttttttttttgagttggagttgtgttcttattgcccaggctggaatgcaatggcatgatctcaactcactgcaacttccgcctcccaggttgaagagactttcctgcctcagtctctctagtagctgggattacaggtatgcaccaccactcccagctaattttttttttttttttgtatttttactagagatgtggttacaccatgttggtcaggctggtcttgaactcctgagctcaggtgatttacccacctcagcctcttaaagtgttggggttacaggtgtgagccaccatgcccagccaaaaagaaacattttcaaaaattttcagaactggaaattcaagtcagtataaatatatgattagtaattattttaccaaaagtgttttttagaatgaattaattttgttaagtgatgaataaattttacactttatgatgggcaataaaaatctgaccatttcaattaccctgtaatttccgctagacaaatctctttttcaaaggactattaattagaagtggtgttagcataggtagaatggctgctgacatctaacataaaggtgactagttcatttatttgtgaagctgttttttaaaacttgaatatgttttatgctgaaataaactagagaaataaagaggttataattattcaaacttccctattttcagggaaaatgagttatataatgaagtagtctgtatcttctaaattatactttaagaactgttatgacatctacagaaaagaatatgtttaggccaggtgtggtggctcacacctataatcccagcactttgggaggctgaggttgggaggattgcttgagcccaggaatttgaggctgcagtgagctatgatcatgccactgtattctagcttgggtgagtgacagagcgagaccccctctctacagaaaaaaatatatatatatttagaaagtttcacattttaggagagaaatcgaaaactattctgatgtccagagattttgtcagatgttgaacagctttagatcaattgaatttacaattatttttctgttaacatggtatacacaagagcatcatgtggaatcaggtatttttagtgagtctttgggacttaagaccttaagaaattaaaatttaagtattaaatatctctctgggccggttgtggtggctcacacctgtaatcccagcactttgggaagccgaggctggtggatcacctgaggtcaggagttcaagaccagcctggtcaacgtggtgagtccccgtctctactaaaaatacaaaaattagctgggcgtggtggcgcatgcctgtaatcccagctactcgggaggctgaggcaggggaatcactggaacctgggaggtggaggctgtagtgagccaagatcatgcgtcactgcactccatcctgggcgacagagtgagactccatctcaaaaataaataaataaataaataaataaataaatctcttactgaaacattcagtaaatgattcatttaataagttttaggtcatttacttttgaaaattgattttttaaaaagtcctttacaggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaggcctttacaatttttatttttaataacaacaaaactggcttccttcaattgtcttttctctttggtgtatataaaaggagaatgaatgttttgtgtttatcattgtctaattactgttttgcagtacattatgttgcttgcaagttgctgagtatgtgtgaagcctcatttgcctcagaacaaagtattcaacgactgattatggtaagtcttaatttaggagaaagtggagatgaaatgagatggttgttacttctatgaaaatggtaaagttagtgtgaaactggaagggggttgaatcttttagtgctatccttttttgatggtgttccttttcagtgttccttttataatggtatatttactacgctaaagttctcagaatactgtagtaattacggtggttcagtgaaccaaatactgaacttataattctgggttgatgatttattttttacttttctcatctctaacttgatagagtaactgtttcttcatctaagggaatggtaatacttagttctaaatgagtttttcaaatgaaaaatttgaagcactaagtaaataaggaaaagggtacaggatttgaagtctcaagacctaggttaggtctgccgcttactagctatgtgacattggaagattacttagttttctcttttgtaagatgaaaatagtaatatctaccttagagtgttatagagttaaaattagagtttttgtgaaaaatgctttgtaaactataaaatatatgtgtaaatacatagtggtagaatttgtccatgtaaaatgctatgacaacagtctgataaatcctgtatcatatataatatgataaaactgagttgaatgcagggttcaccttgtgtgttttccttctttcaaagattgtagccactccaatgccttcacacagttatattttgtccagcttttagggttgtttagagtgggacagtcagtttgaattgagctattccatcatggctgaaagtggaagtcttcctcttgcatttctgttatttaaaagattttttccttataatttttattttgagagggagtcaccctggctggaatgcagtggtgtgatctgggctcgctgcaacctccatctcctgggttcaagcaattctcctgcctcagcctcctgagtagctgggattacaggcatgcgccaccacacctagctaatttttgtatttttagtagagacagggtttcaccatgttggtcaggctggtcttgaactcctgatctcaggtgatctgctcaccttggcctcccaaagtgctgggattacaggcatgagccactgcgcctggcctaaaagattaattttttaaacatttatttccaccccccaaaatacaaatgtatgtttatgtaaaattaaattgttcagaaaagtaattaaagtaataaaaagtgattttctgctccatctatctgttctctctttttttttttttttttttttggacaggatctcactctgttgcccaggctggagtgcagtggtgtgttctcggctcactgcagcctccacctctcaggttcaagcagttctcctgcctcagcttcccgagtaactgggattacaggtgtttgccaccatgcccagctaattttttttttttttttaagtagagacagggtttcaccatgttggccaggctggtcttgaactcctgacctcaagtgatccacccgccccggcctcccaaagtgctgggattacaggagtgagccaccacacccagccctatctgttctcttgctccttagaggcaaatacatttttttagtggaaaaatatttttcccagtgttttaaaatattttattatgtaaaaaagctcaaacatatataaaaaaggtaagacagtacaatgattccctccatttacccatcactcagttagagtaatcatcaactcatggccactcttgtttcttctatatctcctcaaatagcaaactcctggccccactggattatttttattattttttatttttttgagatagagtctcgctctgtcactcaggctggagtgcagtggcacgatctcagctcactgtaacccctgcgtcctgggttcaagtgattctcctgcctcagcctcccgagtagctggaattacaggcgcccaccaccacacccagctaatttttgtatttttagtagagatggggtttcaccatgttggccaggctggtcacgaactcctgagctcaggtgatccgcccaccttggcttcccaaagttctgggattacaggcatgagccaccgcgcctggccaacccactggattattttcaagcaaattcaacatgtataattttgcccataaatatttcagtgtgtgtttctaaaagacaatgtattttttttcagcttgtaaatgcttaatttttttaaacatagaggatgcttggtggtgtatatgtggccatttgatgtttttatgactaagagagttcaatctcttatagaatgtaaatgtacccctacacatttatttatttatttattttctattttttccataaattattggggtacaggtagtatttggttatgtaagttcttcttcttctttttttttttttcttgagatggagtctcactctgtcgcccaggctggagtgcagtggcatgatcttggctcactgcaacctctgccacctgggttcaagcaattctcctgcctcagcctcctgagaagctgggattacaggccactgcacccggctaatttttgtatttttagtagagacggagttttaccatcttggccaggctggtcttgaactcctgacctcgtgatctacctaccttggcctcccaaagtgctgggattacaggtgtgagccactgcatccggccatgagtaagttctttagtggtgatttgtgagattttggtgcacccatcacccaagcagtatacaaggcatcgtatttgtagtcttttatcccttgcccccctcccactcttccctccaaatccccaaagtccattgtatcatttttatgtctttgcatcctcgtagcttagctcccacatgtcagtgagaacatacgatgtttgattttccattcctgagttacttcacttagaataatagtctccaatctcatccaggtcactgcaaattctgttaattctttcctttttatggctgcatagtattcagttatatatatataccacagtttttttatccacttgttgattgatgggcatttgggttggttccacaattttgcaatacacatgcacatgtaattcttatcaaaattaagcttagtcactaaaagaagattcgctatctgaactttgttctgcaggattttcacttttgccatcaggcactggagcacctgacctctcaagaagatctgggtctagtccttctgatatcatttttcttattgccatcactggtacactcacttgaaccattttgagatatatgacatatcttgaatctttagctacagttaagatatttcctgctgatacttaactttcctgtggtccagagtcttaatgtactgtcctgctgtgattactctgaggtgacttcagaatgtgatccatttgtgacactagtggcacttgaaggagatacttcaaatgtgacatcatctaggcctggtatagatgacaactttgcatctacagtattgagaattgtttcaatttgctggataccaagataaaggtttgccagtttctcctcactaaatgtagaagagcgattgaggcactatacagtgtgtaccacattttggtttagaaaagccaccattcttttctgctgaatagctggcaccttgatcaagtctacgcctgactcccatgagaggaagcccatctttatccatctcctcaggaggcaggagacccaggactcacccatgaactcctcccagatggggcctgcccaaccctgtaatcgtgtcccagtgcttccccacgtcccccaagacaatgtatttttatattcaacaaacccagttcactttaccacacctgataaaacctaacaaagatttccccaaatcaaatatctagtcctcccaccccctctccaattggtttcttaaaatcaggaccaaagataatccatactttgtattttgttaatatgtctgttttaatgaaactacatgttttcttctcttttttttaaaaaaaaaatctgttgaacggatttatttgttgaagaaatgaggttgtcctatagagttttctaaattctgggttctggtgcttcttcatggtgtcacttaatagtccatcgtttcctttaacccttattttctgtaaactgataattagatctagaagcttgttctgatacaggtttgatttttgtcagaataatttataggcagtatgtttctgaatccttggattcaaccaatcatggattgaaaatattaccaaaaaagtcttaaaaagataacaatacaataaaaaataatacaaataaaaatacagtataacaactattcacatagcatttatattgtattaaatcatctagagatgatttatagtacatgggaagatgtgtataggttatatgcaaatattacaccatttcatgtaagagattatataatgtatttttatatttcaaaatataaaatattttaaaatatatgtacaaaatttatataaaatatgtgtttataagcagacaaatatatactcatatctcccctcattccgccattttcttagataaatggtaacagtccatatatactcttcttcacctgattttttccccctcgtttaacattatatcctagggattactccatagaaatatatagagatattccttatttttaatagctgtatttcaattgctgtatgtaccttattatgttcaaccagcctcccttgatggacatttggatgctgcaatgaattgccttgtgcctatgtctttgccacttttaaggctattactataaccatttctgttttcactctcatggttccctctatgtatcttagtcatatgcttgtatcactgtattggtttgctagggctgccataacacaatatcacaggttggttggcttaaacaacagatatttattttcccacagttttggaggctagaagttcaagattaaggtgtcagcaagtttgatttcttctgagtactctttccttggcttgcagatgttcgccttcttgctgtgtcctctcacatggcctttcctctgtgtgtgctcatttttcgtgcccatttgtgtgtccaaatttcctctggttataaagataccagtcagatgagattagggcccgccctaatggcctcattttaatgcaatcacttcttaaagcccctatctgcaaatacagttacattctgaggtgttggaggttagggctacagtgtaggactttgaagggacataattctgcttgtaacaataactaattcttttttttttttttgagacagagtctcactctatcgcccaagctggagtgcagtggcatgatctcagctcactacaacctccaccttctgggctcaagtgattcttgtgcctcagtctcctgaggagctggggctacaggcatgcaccaccacgcccagctaattttttgtatttttagtagagatggggttttgccatattgcccaggctggtctcaaactactgagctcaggctttccacccgcctcggcctcccaaagtgctagggttacaggcgtgagccaccatgtctggccaataactaattattgatttatcagctttatttatgatctatttatttgctattatgatggatgaggatttatctcatattatatcatgttacctccccatcccctctcaatttttgttagttatattatactattttaaatttatctgttggctgtcttttaaaacttaattatatatatttttatatacacacatataattttttgtatatatttcaaaagtatactttttattgagacagggtcttgctctgtcacccaggctagagtgcaatggcgcgatcttggctcactgcaaccttggcaccccgggctcaagcaatcctctcatctcagcctcccaagtagctgggaccacaggtgtgcaccaccatgcccagctaattttttgtatttttagcagagatgggggtctcaccgtattgcccaggctggtctcgaactcctgagcttaagaaattcgtccacctcggcctcccaaaatgctgggattacaggcatgagccacggcgcctggcctaaaataacatatgcttttttttttttttgaaacagggtcttgcctgttgcccaggctggagtgcagtggcatgatcatggctcactgcagccttcacctcccaggctcaagcaatcttcctgcctcagcctccctaatagctgagaccacaggtgtgcaccaccatgcccaatgaatttttaaattttttgtagagacagggtcttgctatgttatgttgctcaggccggtcttgaattcctggcctgaagtcatcctttcacctcagcctcacaaactgctaggattacaggcgtgagccacaccatgctcagccctaagtcatatatttaaacttttctttcttttttttttaaaatcaaatttggagtttatctctttacttgctactttgtgaggatatttccattctttctatctctctttccctttaaccttccaccttctgtcacctctaacatttgcattttgggctttgttgatccctaataatgaaaactgaaaaggcatgttattgattgtgactattatttaactctgtggattataatttggtatctctgtatgtttccatctgctagctctctcaattctattttctcagttattctgtttgttgagtgtgatgtcctttcatggcattggtttccctcaattgtttggtaattcttgctcatatttgatttgaaattctgtgatgatcttctatgaatattgtgtcacactgtgtactataacctgaatccagtgactgatgaagaggtaggactggatgtttttcattaacctgtgttgtcagccacctagaactctgtttctgtccagccaaagtaattgtactctctgttcctttctggagaggagggaggaagatacctttcttggggaggcctattgcctgatgttcctactgttcgcatccagggctgtttccacattttgcatttttgtgcatgttgggatatctaccagttacaatactgtgagctccttcagtgagactggaatataaaggtacttaataaacatttgttggattaatccaaattttattgcagatggaattaaaaactagaaccccagtagtctaatgcttatcatatgcctttcttcaagtatgtgaagcattaagttttcagaactttctcttcctatctaagttacttcaacgttttcttttaatatttcctcagaagatgtgtttttaagtctattaatttttgctattatttttgtctttatgaccatttcttttaaattgtggagttcaaagtagaacacagaactctaacaaatgctaactgttgctttttgttttctgtgagttataagactgaatatggacagaggattcaatattttctccaatattcccccaccaatttgggggaggtatgaatttttaaaaattattttctaatttctctcttctagatgaatatgagaataggaaaagaatggttggatgctggaaattttctaatcgctgatgaatgttttcaagctgctgtggccgtaagttaccattgacttttagctgaggcaattattagtagtaacatctgtggttattctcattgttacattgtactgtgggtttattttccagagtctggagcaattatacgtcaaattaattcaaaggagctcccctgaggctgacttgaccatggagaagattactgttgagagtgaccacttcagagtgctttcttaccaagcagagtcagtaggtatcgtgggcaccagggtcttccagtggggcattttccatatgtaaaagtaaaagtgatgatatatagcctattggaagaaagtcagatgtcactggccttttataggatattaatttgacctttttatctctgttatatctgaaggtgatgttactaatgctgattggaatctatggggtggctaagggtgagaagactgatatacagctaaacatcattttcaccccctgcatgtaacatctgtcatttatttatggcagcaatccctacttgaaacacctgtctctgtgactctctcttacattcacagtctgcctaaaatatttgcctgaaaagagccttctcatttgcagttgttctgagttgtctattgatgctttctaaaagtctgctgagatcatacactgtttaaagttatactttacctctgtttatcttgtgggtttcctccttttgccatcatacacttaggtgtgcatttgagctatgatgagtttgctttctgttattacgcaattctggaaatgaaaaatccccagctgggcatggtggctcgtgcctgtaatcccagcactttgggagcctgaagcggaaagattgcttgagcccaggaattggtgaccaacctgggcagcatagtaagacccccatctctaccaaaaaataaaagtgaaaaattagccaggcttggtggtgtgcacctgtagttccagctactagggagtctgaggcagaaggattccttgaacccaggtgacagtgagctatgattgtgccactgcactccagcctgggtgacagagctagactgtgtctcaaaaaacaaacaaacaaaacaacaatgaaaaagaaaagtccccttttttattttttgacatatttactgagatataattcatataccataaaattcacccatttacactgtgtaattcagtaatttagtatattcacagaattgtgcaatattcaccacaagctaagtttaaaacatgtttgtcaccccaaaaagacatccccatcagcattagcagtcattcctcattgcttctgaccctagctctagcaaccgtgaatttattttctgtttctatagatatgcctattttggacatttcatattaatataatcatgcaataagtggtcttttgtgattagcttctttcatttagcataattgttttcagggttcatcagtgttgttgcatgtttcactgtatgaatatgccatgttttgtttatccattcatctattgatgaacatttgagtggtttccaatttttgtctattgtgaataattctaatgtgaacattcatttactctgtgtgtgtgtgtgtgtgtgtgtgtgtgtgtgtgtatgtttttaattttctttggtatataactaagggtggaattgttgggtagcatggtaactctaagtctgtgtttaaccttttgagaaactgccagaatgttttccatagtggctgaactattttattacacttcccccagtagtatatgagggctccaccttctctacatctaaaggttttatagttttagcacttacacttagatctgtggtccattttacgtaaattttcaggtataatgtgaagtagtggtctaacttcattcttttgcatgtggctattcaattgtcccagtaccatttgttgagaagactattctttccccatattgaatgaccttagcacctttgtcaaaaatcaatttatcataagtgggagggtttacttctggactcttgattctattccatttatctgtatatctagccttatgctggtaccacacttgtcttgattactgtagctatgtagtaagtttcaaaattgggaattgcaagtcctccagttttgttctttttaaagagtgtttggacttttctgggtcccttacatttccatatgaatgttaggatcagcttttcaattggtgtacagaagccagctggaattttgatagggatagcattgaatttatacaacaatttgggggatattgttatcataagaatattgtgttctgatccatgaacatgggatgtcttttcatttatttaggttttgtttaattttctctcatttatttatttttatcttttttttgtagagacaaggttttgctatgttgcccaggctggtatcaaactcctggcctcaagcagtcctctcaccttggcctctcaaagtgctgggattacaggcgtgagccaccatgcctggccagacctatgtgtggtatttttgttgttgttttagagacaggatcttgctttgttgcccaggctggagtaatgtggcccaatcatagctcactgcagcctcaacctcctgggctcaagggatcctcctccctcaacctcccgagtaggtaagactatgggtgtatgccactgtgcctggctaattaaataaacattttttttttttttttgtagagggagggttttactatgttgtctaggctgttcttgaactcctgggctcaagtgattctcccaccttgccctcccaaagtgctggaattacaggcatgaaccactgcgactggccagacctatgtgttttaattgtccacaagctcaaacttaaatcagtgatgtgacgtaactgcaaaaaaagctagcacagtcctaggctatgttaatagatacatagtgtcctcatctaggtagttaattcacattttgaatattgtgataacttctaggcatcacattttaaaatcactgggttggtgtacaaaatatatgaaaaatatttggagaatatagtgatgtttgtctcagaaaaagaagacagtaggaatgatagctctctttgaatattttaaggactattgtattaaaaaggaattaaactccacaggatggaatgaagaacaatgggtagaaattataggaagacagattttggcttaatataaggagtagccttttatcagtgatagtaatcctataatggaatagctttcctgcaagattttaaatctgttttcactggaaatttgtaagcaaaggtgtgaatatcctaagaattatacattgcagaaggaattccttcatttggtaggaaatttgactactatgacccttaagtcccttttaacaccaagatcctatgatttcagaaagtcttgtagcatttgttcagtgtggtggatgttgatatctaaatggcatctttatatagctggttaaaagtgttagttgttataatcagtaatgagaactatataattcttgactttgataagtgatgacatcttcagaagttgtggtgaaggctaattccttttgctctaagttaatttttcatttctaagacattcgcaccattagagtttatgagttttgttgatatttgcttgggagaagacatctttaaaatggcggttaatagcggtgtttgataatgagttttctctgtcctaataaagctcctgagaggccttatctttctctaggcacctaccatttaaccagttagataattgctttattatttattaagttattcaacagacaaggaatatcttctatgaacagactactatgctaggttttgtggaataatgcaaataatcacatatcctatcctcaaggattatagtttaattggtgagataaaggatgcatatgcaagatagaaaaaattgggtactataatagttgtacagataagtgatctacatgcagtgttcagtgctatgtgtgagtggagatgtaatatatggtcattttccttaagaaaattataagctagtttgagagataggtcatgaatacattttctaaaactggaaaaagaaaaatattaagtgccaaatgaatgacttaggttaggtgggacacagactttgtctaaagtggtcacatgaccttcctaacaattgttaacattttatttttcctcaatccctatatccacttgcaaggtgaaggatacttttctgtgtatgcaagtgccagattacccttctgtaatcttttagaattgtaaaaataactatagatcttggtgtttctcctaattccccatttcccttggttactggcaatgcctctttctgcagtgtgcatcatctgcagatgcaagggtcgtatgttttgcttctgctccctcccctatttaaagtaggaccacttgtagaagctgacagggtcacactgaggaaggggctatgagcttacctataaagactatgatggaggctatcctggagatacaagccaagtgaaagccagctttctctattatatcaaggactttggttcaccatctttcctagtagttaaaaaagtagtaatgtaaaaaaattaatctgcattgtcagcttctagcatagtacgtagcatataatatatattatgtaaatgtgtgtggtacaaatgaatctgctctccccctattattcctttctgatctttttgcaccccccatcctatcaaaagagtgatcagtagtatgtaaaatgtgaaagactgaaaaacaccagtacaggcaagtgctacaagagtgtagaaaagtggggagattattgtggactgggttgtagaagacacacaggatttagagcatgatttgaactttgaaggaagaaacagacttaggaaagtggggaagagggcacagaatattccaggcagagcaaagtcatataggcagaaatgtgcatgccacgtttaaggaacagtgtgatcagtttatctgaaggaaagtattttgcaagggcacaatgagtgctaagtctggagaaataagtagggccaggttgagaaagcccaaatatacctctttgaaaaaatacttttgatattttcctaaaggtactggggtgattgaaagtgtttaggaagaggtttggtggcacctagtgaagagtaacctgtaatcgtgtttagaattgattgaaaagtgaacagaatcaaggcatagtgtaagcatgaactggtgaaagcctgtactatagtagtaccaatgagaatgggaaagaagggacagatacaggagacatataaaggaagcaatcatttatgctcagtgagaaggacttgaaccattgaatctttggaggcaggaaagggaggataataaagcctgttcattccacaaacatttacatgttgttgggaggtgggagagtgcagtcgaaagtagagcaaacactgctaggcatggtggctcacacctgtaatcccagcactttgggaggccaaggtgggaggatcatttgaggtcaggagttcaagaccagcatgggcaacatagctagaccctatctctgtgagaaaagaaaaaaaattagccaggcatggtggcacatgcctgtggtctcagcttcatgggaggctgaaacaggaggatcacagattgaggctgcagtgagccatgattacaccacggcactccagcctgggtgatagagtgaatccctgtctttaaaaaattaaatttaattacattaaaatttcaaaaagcagagcaaacgaaaaagaaggaataccagagatgaaagaggactagaacagtgtgggtcattcacgagaagagagtttggagaaaaggatgatcaacagtggccagtgcttcagagaaataaaagaaaatgaggtcggaataaacgccattggacctgacgtttaggaagatgatagtgaccatagaaagcagtttcagtagtaaggtgtcttagttcgttttgtattgctataatggcatacttgaggctgggtaatttataaagaaaagatttattcttgctcacggttctgcacactgtacaagaagcatatgccagcatctgcttctggccagggacttcagtaagcttccaatcatgccaaaagtcgaaggggagcaggcatgtcacatgacaagagagggaaaaagagatacaggggagggtgataccagactctttcgaacaatgccatcttagaggaactactagagcaagaactcactgttactgtggggagagagccaagtcattcatgagagatctgactccatgtcctaaacacctcccactgggccttacctccaaaattggggcatcacatctctttctttcttcctttttttttgagacagagtcttgctctgttgcctaggttgtagtgcagtggcgtgatctcagctcactgaaatctctgcctcctgggttcaagctattctcatgcctcagcctccagagtagctgggattacagtcacatgccaccacgcccggctaatttttgtatttttagtagagacagggtttcgccatgttggccaggctggccttgaactcctcgcctcaagcaatccacccaccttggcctcccaaactgctgggattacaggcgtgagcgaccatgcctgacctggggcatcacatttcaacatgagatttggaagggacaaatattccaactatatcataagataatagtagaaaatagactgtaagggtttaaggactgaatgggtggcgaggcaatggaagaagttatggtgggaggttctgggaggtcaaaactattttataataattctaaaacattatttgcctattttttgctgttttagcatttgctctggtgatgcaaagcaatgatgggtaagattgctggcacttcaacatgaatcaggatagtggcactagcatacagactagtcatctttttattcatcactgctatactcttactttaagaagaatgccagtcttaagactatactttcagggatcatttctatagtttgttactagagaagtttctctgaacgtgtatagcactgaaaaccacaaagaagaggtgcagcattatctcctaagtgtaaagccggctcttgatgttgctttgctgcaactgccatttgccattgatgatcgttcttttcttcctttgggagactgggaaggaaaggatgcaatctgagtggttttcatttaaaaaataaataaataaaaaggatgccagttttacacaaaaccatccttgataagcgagtaaagatgattaattttattaaatcttgggcccttgaacacatatcattttaatatgtgtgatgaaaagggaaacactcatatagcacttttgttgcatatcgaagtgtgatggttatctggaggagaggctcttaagtgattgtttaatttgtgagccgaattaactattttgtgtgtgcgtgtgtgatggagtcttgctctgtcacccaggctggaatgcaatggcacaatcttggctcactgcaaactccacctcctgggttcaagcgattctcctgcctcagcctcccgagtagctgggactacaggtgcgcatcaccatgcctggctaatttttgtatttttagtagagatggaattttgccatgttggccaggcgggtctcgaactcctgacctcaggtgatctgcccacttcagcctcccaaagtgctgggattacgggcgtgacccagtgtgccctgcctggattaactatttttaatttcaagaatgactgacacataaacttggctatttagcagatgttttcataaaaatgaatgaagtgggccaggcgcagtggcccctgcctgtaatcccatcactttgggaggccgaggcgggcggatcgcctgaggtcaggagttcaagaccagcctggccaaaatggtaaaaccccgtctctactaaaaatataaacgtgggctgggcatggtgtcaggtgcctgtaatttcagctccttgggagactgaggcaggagaatcgcttgaattcgggagacagaggttgcagtgagcagagatgatgccactgcacttcagcctgggtgacagtgagattccctctcaaaagtaaaagataaaataaaatgaaccaagtgaataggactctattgtgtatatgtaccattttgcattcttcatccattcatctgttgatggacacttaggttagcatgtgacttctgggaaaacaattgacagtattttttgccagtgaaaaagtttgagcttttaggtaaaaactgaaattttagaaaatgtgtacttctaccatgagcttggtagcttctaaatacttagtcttttttttttttgaggcagtctcattctgccacacaggttggagtgcagtggcacagtctcagctcactgcagcctctgcctcccgggttcaagcggttctcatgcctcagcctgggaggtagctgggattacaggcgcacaccaccactgctggcttttttgttttgttttgttttggtatttctagtagagatgggggtttccccatgttggccaggccggtctcgagctcctggcctcaagttatccacctgccttggcctcccaaagtgctgggactacaggtatgagccactgcctaaatacaaagtctttttttttattttattattattgtactttaagttttagggtacatgtgcacaacgtgcaggtttgttacatatgtgtacatgtgccatgttggtgtgctgcacccattaactcgtcatttagcattaggtatatcccctaatgctatccctcccccctccccccaccccacaacagtctccggtgtgtgatgttccccttcctgtgtccatgggttctcattgttcaattcccaactatgagtgagaacatgcggtgtttggttttttgtccttgcgatagtttgctgagaatgatggcttccagtttcatccatgtccctacaaaggacatgaactcatccttttttatggctgcatagtattccatggtgtatatgtgccacattttcttaatccagtctatcgttattggacatttaggttgcttccaagtctttgctattgtgaatagtgccgctataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttaatgatgccattctaactggtgtgagatggtatctcattgtggttttgatttgcatttctctgatggccagtgatgatgagcattttttcatgtgttttttggctgcataaatgtcttcttttgagaagtgtctcctcttcatatccttcgcccacttgttgatggtattgttagtttttttcttgtaaatttgtttgagttcattgtagattctggatattagccctttgtcagatgagtagattgcaaaaattttctcccattttgtaggttgcctgttcactctgatggtagttccttttgctgtgcagaagctctttagtttaattggatcccatttgtcaattttggcttttgttgccattgcttttggtgttttagacatgaagtccttgcccatgcctatgtcctgaatggtattgcctaggttttcttctaggggttttatggttttaggtctaatgtttaagtctttaatccatcttgaattaatttttgtataaggtgtaaggaagggatccagcttcagctttctacatatggctagccagttttcccagcaccatttattaaatagggaatcctttccccattgcttgtttttgtcaggtttgtcaaagatcagatagttgtagatatgcggcattatttctgagggctctgttctgttttggtaccagtaccatgctgttttggttactgtagccttgtagtatagtttgaagtcaggtagcatgatgcctccagctttgttcttctggcttaggattgtcttggcaatgtgggctctttttggttccgtatgaactttaaagtagttttttccaattctgtgaagaaagttgttggtagcttgatggggatggcattgaaactataaattaccttgggcagtatggccattttcacgatattgattctttctacccatgagcatggaatgttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctgttgtctgttattggtgtataagaatgcttgtgatttttgtacattgattttgtgtccggagactttgctgaagttgtttatcagcttgaggagattttgggctgagatgatggggttttctagatgtacaatcatgtcatctacaaacagggacaatttgacttcctcttttcctaattgaataccctttatttccttctcctgcctaattgccttggccagcacttccaacactatgttgaataggagtggtgagagagggcatccctgtcttgtgtcagttttcaaagggaatgcttccagtgtttgcccattcagtatgatattggctgtgggtttgtcatagatagctcttattatttggagatatgtcccatgaatacctaatttattgagagtttttagcatgaagtgttgttgaattttgtcaaaggccttttctgcatctattgagataatcatgtggtttttgtctttggttctgtttatatgctggattacatttattgatttgcgtatgttgaatcagccttgcatcccagggatgaagcccacttaatcatggtggataagctttttgatgtgctgctgaattcggtttgtgagtattttactgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctgttgattattgccacaatttcagagcctgttattggtctattcagagattcaacttcttcctggtttagtcttgggagggtgtatgtgtcgaggagtttatccatttcttctagattttctagtttatttgcgtagaggtgtttgtagtattctctgatggtagtttgtatttctgtgggatcggtggtgatatcccctttatcattttttattgcgtctaattgattcttctctcttttcttctttattagtcttgctagcggtctatcaatttcgttgatcttttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatcttttctgcttcctcttgtgggcatttagtgctataagtttccctctacacactgctttgaatgtgtcccagagattctggtatgttgtgtctttgttctcgttggtttcaaagaacatctttatttctgccttcatttcattatgtaccgagtagtcattcaggagcaggttgttcagtttccatgtagttgagcggttttgagtcagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcaaagctgagttcaattcctgggtatccttgttaactttctgtcttattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagttcttcttgttgaattgatccctttaccattatgtaatggccttctttgtctcttttgatctttgttggtttaaagtctgttttagcagagactaggattgcaacccctgcctttgtttgttttccatttgcttggtagatcttcctccatccctttattttgagcctatgtgtgtctctgcacatgagatggctttcctgaatacagcacactgatgggtcttgactctttatccaatttgccagtctgtgtcttttaattggagcatttagcccatttacatttaaggttaatattgttatgtgtgaatttgatcctgtcattatgatgttagctggtcattttgctcgatagttgatgcagttttttcctagccttgatggcgtttacaatttggtatgtttttgcagtggctggtaccagttgttcctttccatgtttagcgcttccttcaggagctcttttagggcaggcctggtggtgacaaaatctctcagcatttgcttgtctgtaaagtattttatttctccttcacttatgaaggttagtttggctggatatgagattgtgggttgaaaattcttccctttaagaatgttgaatattggtccccactctcttctggcttgtagagtttctgcagagagatcagctgttagtctgatgggcttccctttgtgggtaacccgacctttctctctggctgcccttaacgttttttccttcatttcaactttggtgaatctgacaattatgtgtcttggacttgctcttctcgaggagtatctttgtggtgttctctgtatttcctgaatttgaatgttggcctgccttggtagattggggaatttctcctggataatatcctgcagagtgttttccaacttggttccattctccccatcactttcagctacaccaatcagacgtagatttggtcttttcaatagtcccatatttcttggaggctttgttcatttctttttattcttttttctctaaacttctcttctcgcttcatttcatcttccatcactgataccctttcttccagttgatcgcatcggctactgaggcttctgcgttcatcacgtagctctcgtgccttggttttcagctccatcaggtccttgaaggacttctctgcattggttattctagtatccgttcgcctaattttttttcaaagcttttaacttctttgctattggttcgaatttcctcctgtagctcagagtagtttgattgcctgaagccttcttctctcagctcgtcaaagtcattcttcgtccagctttgttccattgctggtgaggagctgcattcctttggaggaggagaggcgctctgacttttagagtttccagtttttctgctctgtttttttcccatctttgtggttttatctacctttgttctttgatgatggtgacctacagatgagtttttgatgtggatgtcctttctgtttgttagttttccttctaacagacagggccctcagctgcaggtctgttggagtttgctagaggtccactccagaccctgtttgcctgggtatcagcagtggtggctgcagaacagcagatattggtgaactgcagatgctgctgcctgatcgctcctctggaagttttgtctcagaggggtacccggccgtgtgaggtgtcagtccgcccctcctgggggtgcctcccagttaggctacttgggggtcagggacccacttgaggaggcagtctgcccgttcccagatctcaagctgcgtgctgggagaaccactactctcttcaaagctgtcagagagggacatttaagtctgcataggttactgctgtctttttgtttgtctgtgccctgctcccagaggtggagcctacagaggcaggcaggcctccttgagctgtggtgggctccacccagttcgagcttcccggctgctttgtttacctaatcaaacaactaactcagcaatggtgggtgcccctccccgagcctcgctgccaccttgcagtttgatctcggactgctgtgctagcaatgagcgagactccatgggtgtaggaccctctgagccatgtgcgggatataatctcctggtgtgccattttttaagcccgttggaaaagcgcagtattagggtgggagtgacccgattttccaggtgccatctgtcactgctttctttgactaggaaagggaattccctgaccccttgtgcttccctggtgaggcgatgcctcgccctgctttggcttgcgcacagtttgctgcacccactgtcctgcacctactgtctggcactccccagtgagatgaacccggtacctcagttggaaatgcagaaatcacccatcttctgcgtcgctcacactgggagctgtagactggagctgttcctattcggccatcttggctcctccccctctaatacttagtcttttctgatgaaattggtggtggtattaaacaaatgtgattttattttattttatttgttctgagaccaagtcttgctccgttgcccaggctggagggcagtagtgccatcttggctcactgcaacctccacctcctgggttcaagcgattatcctgcctcagcctcccgagtagctagctgggactacagacagccgccaccatgctaggctaaattttgtatttttagtacagatggtgtttcaccgtgttgaccaggctggtcttgaactcctgacctcaggtgatccacccacctcggcctcccaaagcactgggattgcaggtgtgagctaccgtgcctggccaacaaatgtgtttctaaaaattttttaaaattttgaaataagcatagatttgcaggaaactacaaaaatagtaaagagagatctgtgtacccttcacccagctttttgccagtagcaaaatcttgcatacatatagtgcaatataaaaccaggaaatagacattgatacaatccacagaccttatttagatttcaccagttttacatgaactcacttgtgtgtgtttgcatgtgtttatagagctctatacaatttcagcacatgtgtaggtgaagattcatgttcactaccaccaccacaatcaagatacagaacagtttcattaccacacagattctttacataacccctttatagggatacccctttcccatcatccaaaacctcaggcaaccaaaacctagtctccatctctataattttgtcattttaagaacattatataaatgtaatattacactatgtaaccatttcatattggttgttttcactcagcatttttttttttgcgatccgtccttgtctttttatgtgttaatagtttgttctttttgtttgtttgtttgtttttgagacagagagtctcactctgttgcctaggctggagtgcaatggcgtgatctcggctcactgcaactactgcctcctgagttcaagtgattctcctgcctcagcctcccaagtagcgtgagattacaggcatgtgccaccttgcctggctaatttttttgtattttttagtatagatggcgtttcaccaagttggccaggctggtttcaaactcctggcctcaagtgatccacccacctctgcctatcaaagtgctgggattacaggcatgagtcaacgtgccaagccctgttctctttttattgctatgtagaattctatgctatggatgtaccaatttgtttagccattcaccattgaaagaatttgggttgtttccaatttttggctattgtaaataagttggcatgaacatttccatacaggtttttgtgtggacataaagggtatatttagttttattttttttttagaaactgccaactgttttctagagtggccatgccattttacattctgtgttttgttttgttttcttgttttcttttgagacagagtctcactctgtcacccagggtggagtgctgtggcatgatctcagctcactgcaacctccgcctcccaggctcaagtgattctcctgcctcagcctcccgagtggctgagactacaggtgcgtgccaccatgcctggctaatttttgtatttttagtagaaatggggctttgccatcttggccaggcttgtctcaaactgctgacctcaggtgatccacccacctaggcctcccaaagtactgggattacaggtgtgagccactgcacccggccaccatttagattcttaccagtaatgtatgagagatcccatttctttgcatccttgacagcatttggtattgtgaccaatttttttattgtagctatcctaataggtatatagtgatatctcattgtggttttaatttgcatttctctaatggctaatgatgttgaacatcctttcatttacttatttgccatctgtatctccctttaggcaaaatatctgtcatttttcttgtctattttctatttggattgtttgatagtttactgttgaatttacaggattatttatatattctagatgtgattcccttgtcagataaatattcgcgaatattgtcttgttgtagcttgtctttttgtcctttttaatagggtcacagaatacagttttgatgaagtccagttgattgatttctttttcttttatggatcatgcttttggtgtcatgtctcagaatgtttcacctagccctgggtttcttaaatttccatttgaattttaagatcagcatgttaatttctgcaaaaaaggccaactggaattttaatggaattggattaaatttatagatcaactcggggagtattgccattttaatatattgtcttttttttttttttttttgagacagagtctcactctattgcccaggcaatattgcgccatctcggctcactgcagcctctgcttcccgggttcaagcgattctcctgcctcagcctcccaagtagctgagattacaggcacgcaccaccatgcctagctagctactttttgtatttttagtagagacagggttttgccatgttggacaggctggtctcgaactcctggcctcaggtgatcagtctaccttggcctcccaaagtgctgggattacaggggtgagccactgggcccagccctgatggtagttttgattgccccaaatgtacacatttttgaatactgacttacagtttatgaaatgctttcacatctgtgatcccatttgatcctcataaaaatcaatcctatattgtagacattactgtccctattttatagttaacaaaatagagcctcaaagagattgtgacttacctaagttcactgagccaagaagtggaaaaactgggaatgcaaagctcatattcttttcactacatcagtatacgcaggacatcactccagatctaatgaatcacagtctccccaagttgtgagagctgggcatgtgattttcagaaagctccactggtgagtctgatgctcacaaaaggttactacagcactgtattgtgctgcctcttctttaagacttcttttactttaaatctttatcttttgggcttgaaatatttgtttctagtcataagaagatgaataaattttcaaaagtagcctgaattattagagctttgatttctctaagataaaatctgagtaatgatagacactttatgggttgtttgaacattaaagtctcatattgttttatatgttataagaacagacagcaacatctatcctctgatatggtgttgtcactcagcatttctcttttatagtaagattttctccaccttgaataatgatttaatcagcaagtattcatagaatatagtgtagacaggaatattattttctaatctctatatagagatttggcttattgaggcacttgtgttagcaatttattttcccctttaataatatctagtattaaagccttataagagagtatctactcagcaagatgtcaggcttactattcagcagttagaagagaaaactagagagaagctggtgtcttacgttgtttatattttcttctgtctactcaattcttttattattcaaagcacaataatatttgacaccacgtaaagaagagaagaaagaaaatagcaagtgtagtactttattatttccttgtatgtatccatgtttttcttaaaaaatgctgtgtcagccttttttttttttttgtgacagagtctcgctctgtctcccaggctggagtgcaatggctcgatctcagctcgctgcaacctccgcctcccgagtagctggattgcaggtgcccaccaccacacccagctaatttgtgtttgggttgttttgttttgttttgttttgttttgtttgtttgttttttggtagagacgggatttcaccatgttggtcaagctggtctcagactgctgacctcaggtgatccacccaccttggcctccctaggtgctgggattataggcgtgagccactgctcctggccaactaagttcttcaatggctgaaacaagcctcttctacaagtgctaaagtatgtgtgattgatgtttacattcatttgggggtgttcagacatagaatggtagaactgaaaggaaccctgcagatagtctagtacagtctcctcactttatggatgaggaaacaatctgtgagagcttaaggctcaaagttacacatgataaatggcagagcggctcttttggcttcatgatgagattgtacgaagctgcttttcttttttcttaaaattttttttttttttaagagatggggttttgctctgtcatctgtggcaggagtagagaggtatcttcttagcttactgcagcttcgaactactggacttgagcaattttcccgcctcagcctctaaagtagctgggaccataggtgtgtgccaccatgtctggctaattgataagctgctttttgtagtggatatacatagcagttcagactatgaggttattgtgatcttgctttaagacaaagactgctgtttagcttaattcctctaatgtagaagtgaatagaagagctattcaagttgcagaagcatctagtagacctggcattatgtcatagtataataacataaggcagtacaaccagtttttgcatttccagaaaaaagtaaatgactcctgctcattcagtatcaactctgtgtcaccaaagattaccacttattcttctgtattttgagcaagctatctgtttagcttgaacaactagtattgctaaaaatattagaaaacaaaataagacttttaaacactagttaaaatatgctaaaattgacttagagacaaataaccttgtcattttaaccaattattgacattctttatctttttcaggcagttgctcaaggggattttcaaagagcatctatgtgtgtactgcaatgtaaagatatgttgatgaggctcccccagatggtgagtgaagtctgcattctccaagagtttgaaaatatgctatatcaagttccaggaagaatcattactacttcatgcaaccttttggagattctatttgagatcagttccacataagtagctgatctttgaaatattttgcttcctttgttctttaccagaaagggcatttgaaaaagctatatggaatatttcttttttttcttttcttttcttttcttttcttttcttttttttttttctgagatggagtctcactctgtcacccaggctggagtgcagtgatgtgatctcagctcactgcaacctccacctcccgggttcaagtgattcttgtgcctcagcctcctgagtagctgggattacaggcctgcgccaccacacctggctactttttgtatttttagtacagacagggttttgctatgttgggcaggctgctctggagctcctggcctcaagtgatccacccacctcagcctcccaaagtactgggattacaggcgtgagccaccacacctggctgatatggaatatttcttaaaattttctttgctttgtcttttattgtcaaatcattttgataacatttgctccatattcatgctatacaacaaaagaaagaaaaaaatgagtttgtctgctgacaaggttgatagcagttaatcatcttactgccatagtatttttctatactgggatttggagatgtgagagatttgataggataaagcctgcatcctggactggatctcatgaaaattcctaaatacatagttttttgctttttcattttatcttccctttccattctttctctcctatttcagcgcctatgcctacttcagtctttactatcacagagggattaataatggagatataattggatattagggagaatgttcccagtattgcatacatcgtacctatttgtgagattggtcttattttttccccaaattgggtgtcataatgtagagcttaattcagtaaacatttatatgttgcctgttatatgtcacatcagacattcttctaggctttaaaaacttttaaaacaatttcatatttatagaaaagttataagaatagtacaaagaactcctgtatatcctttgcttggaaacgtcattcaaattttccaataatgttctatatagaaaatggtttcaatctagaattatacatagtcttcagtctccttcaatctggaaatctggaacacctcctcattcttgccttgttattcatgatcttggcagttttgaagattacagatcagtcattttgtagcatgtgatttaatgtgggtttagccaaagtttcctcatgattagaacaggttgtgaatttgaggccagaaaaccacagaagaaattctatgttctactcatggcttcctattgggtggtatacaggattgatttatactattattggtggtgctagctttgatctcttgattaagatcgtgtctttcaggttttttcactgtaaacctgtatcatttcgtgagtgatacactgaaactatggcaaatcaaatttctcattctactttcaccatctttattcttttttcctccatttttctagctttattgggggtataattgacaaaatttgtatatatttatggtatataacataatattttgatatacattgtgaaaagatcaccacaatcaagccaatttatatattcatcaactcacacaggttttttttgtggagaaatatttaagatctactttcttagcaattttcaagtatacaatacattattataatattaactgtagtcactgtgctgtacagtacagccccagaacttattcatacggcctaaatgaaactttgtaacccctccccttttatttgaagagatagagtattgctctgtcgccaggctggagtgcagtggcatgatcctggctcactgcagcctcaacctcctcggctaaagtgatcctcccacctcagcctctcgagtagctgggactacaggtgcgtgccaccaaggctggctagttgttttatttttttgtagagatgggggtttcactatgttatgcaggctgatcttgaactcctgggctcaggcagtcctcttgccccagccacccaaagtactgggattatagacgggagccactgtgcttggacactttgtaccctttgaccaatatctcctcatccattccccaaccccctggcaaccacctttctactctctacttctatgaactcagctttttcagaatccacatataagtgagatcatgcagtatttgtctttctgcggctggcttatttcacttagcttaatgtcctccaggttcatctgtgttatcacaaatgacaggatttccttcttttttatggctgaatagtattctattgtatataaataccacattttctttacccattcatctcttgttggacccttaggttgattccatagcttggctattgtaaataatgctgcagtgaacaagggattgcagatatctcttaaagatacttattttatttcccttgggtatatatccagaagtgagattgctggatcatatggtagttacatttttaattttttgagcaacctctatactgttttctgtaatgggtatactaatttacattcccaccagcagtgtacaaagtttccttttctccatgcccttgccaacacttatcttttgtctttttgataatagacattctaacagatgtgaggtgatatctcattgtgattttaatttgcatttccctgatggttagtgatgttgagcattttttcacatacctgttgctgatttgtatgtcttccttagataaatatctattcaggtcttttgcccattttttcattgggttatttgtttatttgctattgcagtgtttgagttccttgtatattttggagattaactctttatcagacgtgtgatttgtggatattttctcctattctgtaggttgtctcttcactctgttgattgtttcctttgctgtgcagagcattttggtttggtgcaatctcatttgcctatttttgcttttgtcacctgtgggggtcatatccaaaaaaatcattgaccaggggtctatctctctctttccctctaataattgctttatatatctgagtgctccagtgttgggtgcatgtgtatgtaaaattgttatagcctcttgctgaattttcccctttatccttatatagtgacctttttttctctctccttaaagtttttgtcttgaaatccattttgtctgatataagtataggtactcctgctctttcgtggtttccgttgtcatggaatatctttttccatccgtttattttcaatctgtgtgtatcttcataggggaaatgtgtttcttataggcaagagatcattgggtcttgtttttttttaatccattcagccactctatgtcctttgattggagagtttagtctatttacattcagtgttattactgataagtaaagacttactcctgccactttgttatttgttttctgattgtttttggttttctattttttattctattatatttctttctttcctgtcttccttttagtgaaggcgattttcactggtggtatgatttaatttcttcctttttatttttttattttcgttgtttttcagtttcaggttaccgtgagccttgcaaatgctatcttataatccattattttaaattgatgacagtgtaacactgattgtattaacaaagagccaaacacacacatacacacacacacacacacaaactaataaaaactctacactttaactttgttcccctgattaactttttttgtttttctttatgtcttatggtactgtccatgttttgaaaagttgttgtggttattatttctgtttggttcatcatttattctttctacttaagtcaagagaagtttacaccccacaatttcagtgtgataccattctgtctttttctgtgtgcttactgtttttttttttttttttttttgagacggaatgttgctctgtcacccaggctggagtgcagtggcatgatcttggctcactgcaacatccgcctcctgggttcaagtaattctcctgcctcagcctcccaagtagctggaactacaggtgcatgccaccacacccggataatttttgtatttttagtagagacggggtttcaccatattggtcaggctggtctcgaactcctgacctcaggcgatccacctgcctcggcctcccaaagtgctgggattacaggcatgagccactgtttccagctgtccagccttgtgcttactattacccatgagttttgtaccttcaggtgatttcttcttgctcattaacatccttttctttcagattgaacaactccctttagcatttcttgtaggacaggtctggtgttcatgaaatccctcagcttttgtttgtctgggaaagtctttatttctccctcatgtttgaaggatactttctgctggatatactatcctagggtaaacatttttttttctccttcagcactttaaatatgtcatgcctctctttcctggcctgtaaagtttctgctgataagttggctgccagatgtattgaagttcgattgtatgtgattttttttcttctcttttactgtttttgggattctttctttatccttgacctttgggagtttgattattaaatgccttgaggtgttcttctttgggttaaatctgcttagtgttctataaccttcttatacttgaatgttgatatctttctccaggtttgggatattctctgatattatctcttcgaataaacttcttacccatagctctttccctacctcctctttaaggccaatggatcttagatttacccttttgaggctattttctagatcatgtaggtatgcttcatgcttttttattttttttcttttgtctcctctgattgtgtattttcaaatagcctgtcttgaagctcactagttttcttctgcttgatcaattctgctgctaagagactgatgcattcttaagcatgtcaattgcattttcaactccagcatttctgcttgattcttttaaattatttcagtctctttgttaaatttatctgatagaattctgaattccttctttgtgttatttcaaatttcttgcagtttcttcaaaatagctattttgaattttctgtccgaaaagtcacatatctctgtttctgcagaactggtccctggtgccatatttaattcatttggtgaagtcatgttttcctggatggtgttgatgcttgtagatattcatcggtgtctgggcattgaagagttaggtatttattgtagtcttctcaatctaggcttgctcatgccagtccttcttgggaaggccttccagttattcaaagagacttggaccccaagcctaataatgctgtgtttcttgtagacccataaagggtactccttgatgaccttggataacatctgaaagaattctctggattaccaggcagaaactcttgttctttacccttactttctctgaaacatatggagtcactgtctctgtgttgagctgggggtgtggtgatgcaagcactgggcctgtgctgtgtcagacttgaagccagcacagcactggaccttgcccaaggaaggcccttccctttaggatggtgagttcccccacaacccaggtgtgtccaaagatgctctctgggagccagggattggagtcagaaacttgagcaatttacctgttttattctactgcagttaagctggcactcaaatcacaatacaaagcccttcccactcttccctccctttccacaggcagaggagtctctccctgtggccgccaccatcagtggtccatggggtgttctgctaggccaccactgatgttcacataaaacccaaggtctcttccatcagcttgtggtgaatgctgccaggcctgggactcacccttcagggcagtgggctctcctgtggcccaggacgagaaatactgtccaagaggctacacctggatttggggaccccaagagccaagctggtacctagagtgcagtacaaagtcctctttacttttcctgggcttttctcaaacaaaaggagtctttcactggagccaccacagctgggaatgtgctgggtgtcccctgaagccagcacttctcagagcccaaggcccatggtgtactccctgggtcgttaatggttattccagggttataccaagggttctttagtcagcaggtgattaatcctgccaggactggatcctttccttcaaggcagtgggttcccttttggcccaggatgtgtctagaaatgtggtttgagagctaggtcctggaatgggggcctcactactctgcccagtgccctgtcctactgtggctgagctggtatccaagatgctagacaaagtcctctttactcttcccttccctctacttaggcagaaggaaggagtcactttcattgctacgagctttattgcctggggttggggaagggatggtgcaagccctccctttgctgtgccagctgttgtctccctaggtcacgtggcaagttcactggctctaagcccagccttacactaggagttgcctaggaattgcagtccttgtgccctagactgccactcaagtttatgtaggaccccagagcacttcagcccacagtgacgaggcttgccaagaaactcaagttcccaccactgggatgagggtaattctcctgtggctaaggctggtccaaacactccctctgtgcacaagcgctggctgaacccagcatgacttttttctctactgtgactgtgcagcactgagttcaatgtaaagttccccagctgctgtgctcttcctctgcaatgtgcacagattctctctctgcactgcatagctgctgccagggaagcggggaggggtggccttggagattgaagactgtttatcctgccctcttcaatgcctctttccacaatatgtagttaaaaccgggtactgtgagtgttcacctggttttggttcttgtgattgtgcttttctgtgtgcagacagttgttaaaatttggtgttccagtggagggtacaaacaatgcaggcttttattccatgatcttgccccacccttattttagctttttttttttttttgacaaggagtttcgctcttgttgcccaggctggagtgcaatggcacagtcttggctcactgcaaccttcgcctcccgggttcaaacgatcctcctgccttagcctcccaagtagctgggattacaggcatgagccaccatgcccagctacttttttgtatttttagtagagacgttgggggggtttcattatgttggtcaggctgatctcgaactcctgacctcaggtgagccacccaccgtggcctcccaaagtgctggaattacaggcgtgagccactgcgccaggccaacatctcttataaggtgattatttatttatttattttatctgagactgagtctcactcttttgcacccaggctggagtgcagtggcgcgatctcagctcactgcaacctctgtctcccgggttcaagccattctctcacctcagtctcccaaagtagctgggattacaggctcctgccactacgtccagctaattttttgtatttttagtagagatgtggtttcaccatgttggccaggctggtcttgaactcctgacctcaggtgatccacccaccttggcctcccaaagtgctgggattataggcgtgagccaccacacccggccaaagtgattttactggaaaaacatttcgtcaattcttgtatgctgctctaaacttaaaaaagatcctttaagaatgtaaaaacttttaaaatctcaccatccatattggcccacaggttgtaatttgctgactcatttctttactgagactatatttttctatttatttcatgagtgtttataattatttgttcaaacagttttaaaacatctgatttaaagcccttatcagatagttttaacattcatatcatctttctatgattgtcttttcttatgtatgttgagattttcaagcattgtcatataccgagtagttttttattgaacaatatatatatatacatatatataaatatatgtgtatatatatttgttttttgagactgagtctccctctgtggcccaggctggagtgcggtggcatgatctcagctcactgcaacctccatttcccgggttcaagcgcttttcctgcctcagcctccctagtagctgggattacaagcgtacaccaccatgcccagctaatttttgtatttttagtagagacagggtttcgccatgttggccaggctggtctcagaattgacctcaagtgatctgcccgcctccgcctcctaaagtgctgggattacaagcatgagccaacacacccaacccctatacattttctatattacatttttggcttctgggtcttgtctaaattctgggagagtgtcgatatttttattatagcaggtaatcaatctggtagattcaggcaaattttaaactcattttttgtgggttatggtttcaatgttgtttcaattttgcagtgtgcttcaggtttgtcttgcgtatgcaacactcattgatcagtcctggtacttggcagaggtttatctgttagctcagttatcaaagtttttgttatgtaaattaggttgagattcctggttattaaggttgtaggataagccttgaacttaatcaactttattttgttgcttttctgagctcctctctctctctctctatgatcttcttggtagtttctggttctctgagctgtccttttcagtcctctaaccaatagctatccataatctgcagttgcactgtgactggggccaagcagtaggaagacacaggcagaggaaaaaaagcagtgggagtttgccccatcctgtgggaactactgctgcagtgaatggacagtaaggttttcctctctcaaagttttgagtattttggtttcccctggctaccactgctgttgccaccatgggattgcctagggcctgagcacaagagaatggaagaaagatgaaataaaaaccaaaattgaatatttgcactttctctgagcaattcaagccagaagtagagaagcaccctcagtctgtaccacagcattcgcttctgagtttctggctgcattaagtttaggccaggggatattagaggaaaagaatggtaaacttaccaccagtttggtgttaacttgaattctggtgttcttcctttatttgccttctgctattattttctcagagtcctcaaatagctaagtgcattctgtcgaggtttatagttacattcagtgggagataaagggtggtgcatacttactttatcttacccaaaactaaaacactatttatttatttattatttttattttttgagatggaatctcactatgtcgcccaggctggagtgcagtggcatgatctcggctcactgtaacctccatctttcagatttaagtgattctcctgcctcagcctcccaagtagccgggactacaggcatgcgggcatgcaccactatgcctggctaatctttgtattttttttttagtagagacagggttttatcatgttggccaggctggtctcgaactcctgatttcaagtgatctgccttccttgccctcccaaagtgctgggattacaggagtgagccactgcacccggtctaaaacactattttgatggttaactctttctacatttggccattaagaggccctttaagctgatttgtatgtcttttttggaatggcagggtggtttactagcctggtgatctatttgtgtcctttcagtttccggcctgaacttgtcttttttttgaaatatttattttggtagaattgacaaataaaaattattatgtatttaaggtgaacaacttgatgttttgatatacatacatattttggaatgatcactgtgataaaggtaatgaacatattcatcacctcacatagttacctttttttttgtggtgagaacacttaagatatagtctcttagaaaaaaatcacctatacaatacacaacacaatgttattaactatagtcaccatgctgtgcattagatctccagaacttattcatcttatataactgaaactttgtatgctttatctaacatcgccctatttccccttcccctgagcccctggcagccaccattttattctctgcttttgtaagtttgactcttttcattttacatataagtgagatcatgtagtatttgcttttctgtgcctggcttatttcatttagcataatgtcatccagatttatccatatagtttcaaatgagacaatttccttttcttttaaggctgtggtatgggttcaatgtttgacgccacccgccccccaccccccaaccaaatctcatgttgaaatttcatccctaatgttggaggtggggcttagtgggaggtgtttgcatcatgaaggtgatgaaggcagatctctcatgaatggcttggtgcagtcctcatggtaatgagtgagttctctctattagttcctgctagagctggttatttaaaagagcctgtcatctccctctgctctctgtcttgcttccactctctagccatgtgatttctgcgcaggctagcttctctttgccttctaccatgagtggaagcagcctgaagccctcatcagaagcagatactggcaccaccttgtacagcctgcaaaaccgttaatcaaataaacctcgttttaaaataaattaccctaggagtgacagaaaatgtgaaaaaaagttactcttcctcaggtattcctttatagtgacacaaactgactaaggccgatatgggtgtgtgtgtgtgtatatagatacatacatatatatacgtatatacaatatcctgtgtgtgtgtgtatatatacataccacattttgtatatacatgcatatgtatatcctgtgtgtgtgtatatacataccatattttctttatccatttatccatcaacaggtattaggttgtttccatatcttgggtattgtgaataatgctgcaatgaatatgtgagtgcagatatctcaaaatcctgattttagttcctttgcatacatacagttagccctctgtgaccctgggttccacatccatgtatttaaccaactggggattgaaaatacttgggaaaaaaggatggttgcatctgtaccaaacatgtagatacttttttcctactactttcctattcctacctaatacagttgttatactgtattatttatattattccctaaataatacagtataacaactatttacatagcatattcattgtattagatattataagtaatctagagatgatgtaaagtatataggaggatgtttgtaggttatatgcaaatactatgccattttatataagggacttgagtatctgtggattttggtatccacagagggtcctggaacaaatccccagcagatactgaaagatgactgtacctagaagtgaaatggctatatcatatagtagttttattattttttattaaccttcctactattttgcataatgattgtacagatttacattgccaacagtgtacaagggctcccttttctccattcctcaatgacacattatcttttgactttttgataatagtcatacaaacaggtgtgaggtgatgtcccatcgtggtgttgatttgaatttttctgatgattagtgtattagttcgttctcacattgctataaagaactaccagagactgggtaatttataaagaaaagaggtttaattggctcacggttctacaggctgtacaggaagcaaggcttggggtggcaggggctctggaaacttacaatcatggcagatggtgaaggggaagctggcgcatcctacatggctggagcagaaggaagagagagtgaagggggaagtgctacacactttcaaacaactaaatctcatgagaactcattatcatgacaacagcaaaagggaaatccacccctatgatccaatcacctcccaccaggcctctcccccaacactgggggttacaattcaacaagagatttgggtggggacacagagccaaaccatatcaattagtaatgttcaacactttttcatacacctgttggccatttgtatattttctttgaagaaatggtctattcagatcatttgcccatttttaaattgagctatctggtttttgttttgttttgttttgttttttgttttgctattgagttgtatgagttccttacatatcttgcacattaattcctcatcagatatatggtttgcaaatattttgtctcattttgtaggatgctttttcactctgttgatggggtttctttgctgtgcagaagcattttagtttgatgcaatcccacttgtctatttttgtttttggtgcctgtgctattagagtcatatacaaaaactcattgccaggatgaatgtcaagaagcttttcccttgttttcttctaaaagttttacggtttcaggtattaagtctgatatggcttggatatttgtccctcagaatctcatgttgaagcgtaatctccaatgttggaggtggggcctggtgggaggtgattggatcatgggggaggatcccttatgaatagcttggtgctattcctcacaatagtaagtgagttctcactcagagttcacacgagatcttgttgtttagaaaagtgtgtggcacctccctcctcactgtcttgctcccgttcttgccatgggacatgtttactcccctttgccttcctgaggctctcaccagaagctggccatgattataagcttcctgaggccctcatcagaagctgagaagctgttggtgccattcttgtacagcctgcagaaccatgagccaattaataaacctcttttctttataaattacttagtctcaagtatttctttatagcaatgcgagaacagcctaatacaaagtctttaacttattctgagttgatttttgtatacagtgtgatataagggtccaatttcattattttgcatgttgatatccatcaacactgactgaagagactgtcttttcttcattgtgtgttcttggcactcatgttgaagatcagttgcctgtgaatgtgtggatttatttctggctcttctattctattccattagtgtatatgtttgttcttattctagtaccatactgttttgattactatagctttgtaataaattttgaaatgaggaagcatgatgctcctgggtttgtacttcttgcgcaagatttctttggctatttggattcttttatgattttatatgaattttaggattgtttttcctatctgtaaagaatgccattcagattttgatagtattacattgaatctgtagatcattttaggtagtatggacattttaacaatattaattattccaatctgtgaatgtgggatgtatttccatttatctatgtgccctttaatttccttcattgatgctttacaattttcaatgtagaagtctttcacctctttaagtttattgctaagtattttgttttttgttgttattgtaagtggattgttttcttaattttcttcttggatagtttgtttttagtgtatagaaacgtcactgatacttgtatgttgattttgtatcatgttactttaatttgtttattagttctaacttttttttggttgagtttttaggattctcgaaatatatgatcatgtcattggcaagcacagatgattttacccttccttctcatttgggtgcttttttctttttctttcctaattgctgttgctgggacttctagtactatgttgaatagaagtgttgagggatgggcttccttgccttgtactagatcgtggaggaaaagctttcagtttttcccatcaattatgatgttagctgtgggcttttcatttatggccctttgtattgagttatgttcctcgtatacctattttgttgagagtgttcagtttaatggatgttgaattttgtcaaatgctttttctgcatctattgagataatcatgtggttttaatctttcattttgttaatatagtatatatcacattgattttcacgtgttgaaccatgcttgcattccagggataaatctcactggattgtggtgtatgatccttttaatatccttgttggattcagtttcttagtattttatcgaggatttttgcatctgtgttcatcagggaaattggcctgcagttttcttctggtgtccttgtcttgctttggtatcagagtaatgctgatttcataaaatgaatttggaaatattccctcttcttttattttttggaagagtttgagaaggattgatattaattcttctttgaatgtttggtagaatacaccagagaagccatttagtactgggatttttttttctggggcattttaaaattattgattcaatctctttatttgttattggtctattgtttctatttcttcttggttcagtgttgttaggctgcatgtttctaagactttagaagtaatcacctcttgcagacattgtggactggttttggtagggaaaaaccttcacctgtgggtgtgtgcaggtgtgctagattggtgaggtgtgtggtggtgctggttctggatgcatgcaagaatgctaatcccagggatatgtggtggttctagggctagggagtgcgtggtgccaccagctcaaagggggatgcttgagatcaccttgggggagcagtatcacaggctccaggtgcattggttgtgggctttgggtggctccagcagctgaggtccactttggcaaagactgtgggggtcctccactctgaaggctgaaatagtcctcagtggaaggcttctggaattttcctgttctccttttccttcactttggaactcatagctgaaggaatacctctaagtattgagctaccctggcctagggcatggggtgatgcaggcaaaataaaactgttctgttcttcctactgttttctatgtggttatcctcagattttgtgttccagtgggttgcttcagcttcttcttcttctttttctttttttcaagacagggtctcaccttgtcacccagactggagtgcagtggtgcaaaagcggctcactgcagcctggacctcctgggctcaagtgatcctcccacctcagccagccccacctccctcctgtgtagctgggattccaggcgcgcgtcaccacgcctggataatttttgtattttttatagagatggggtttcgccatgttgccctggctggacttgatctcctgggtttaagtgatccgcccacctcggccttccaaagtgctgggattacaggctctggagctctctgagagctgtttttgcctgtatatagttgttaaatcattgcttttgtggagacactagggctgggagctcttagtctgccatcttgctggtgttacttgacttctatgtgttttttacgtgttgccattacttttgagcacgtcattcctttcgggcacaataaaatattacaggcttattttgtattcctttcctttccttttttttcctttctttttcattcctttccttccttttcctttcctttcttttcctttttcctctttccttttttgagacagggtctcactctgtcacccaggctggagtgcagtgatgtgatctcactctctctgtcacctaggctgagtcacccaggctggagtgcagcggcatgatcttggctcactgcaactactgccacctgggttcaaggggttctcctgcctcagcctcctgagtagctgccattacaggcgtgtcccaccacgcccggctaatttttgtatttttagctcactgcagcctcgatttcccgggctcaagcaatcttcccacctcagccttctgggactacaggcacgtgtgtgctttcttgatcaagccatgaaattaactatgtatctcaggagaccttatttattttagtagaaaatcttatttagaagccaagatctgggcattacgcatccttattgcttttgggatgtcactgctctctcagaccctcacagtggaaagagcatatgtgtgtgtgtgtgtgtgtgtgtgtgtgtgtgtatatatatatgtgtgtgtgtgtgtatgtgtatgtgtatataaatatgtgtgtgtgtatgtatatatatctatattatatacactcatacatttccattacatttatctatattatttattatctatctatcttctatcatctctaatatactgaaaaccatgatatcgtctgtttcaatccaacaacaaaatattcatcctaattttctcccttttcatgtttctaattctcttctccaacaacaaaaaacttggcttcaattatccttaatgtatttatgtatttaatcagtacccctgtatgttaccagtcttccatattctctgccactctattcactgtgaggatgccctcttctccatgctcattctctgattcttcattttgggtttctttccctgggtgcttaccctcttccttctactctgactccctttaccttaccattatttcatgtctatgttctctcaccctatttgggctctgaatctacatgctcatctcctggatggaagaataatactttttttttttttttgagacagagtctcactcactctgtcacccaggctggagtgcagtggcacgatcttggctcactgcaactgccgcctcccaggttcaagcgattgtcctgcctcagcctcctgagtagctgggattacagacatgacccattgtgcctggctaatttttgtatttttagtagggctgggggttttaccatgttggccaggctggtctcaaactcctgacctcaagtgatctgcctgcctcagcctcccaaaatgctgggattacaggcaagataatactttcttatactagactgattgcatagaatcttatcggggagaccactcagtcctcagaatctctgtccccctggaaaattatagaactataaaaataaattttaaaaatacctgttattcaagtggccactgctataggaagagaaagtacataaaaaatggatgccagtcatggagtaatgggtgatgacatcagtatgcctctaatcctattggagactattattctaagcgaagtaactcaggaatggaaaaccaaacatcgtatgttctcactcataagtgggagctaagatgtgaggatgcaaaggcataagaatgacacagtggactttggggactcagggggaaagggtgggaaggggatgagggataaaagactacaaactgggtgcagtttatactactcggttgatgggtacaccaaaatctcacaaatcaccaccaaagaacttactcatgtaaacaaacaccacctgttctccaataacctatggaaataaaaagttaaaaaaattaaataaaattttaaaaagatgtccttaatacttttaagatgattttgtgaagtcctaaaaaatcaaaaccaaaaaacatactcttaagcaagtcaaatctaattaacttctattttaaagtaaatatatgccacacagcacttgtagaagtttgacagaagcgtgaaatcaagcgatgaaatggatagcaatgcagtagtccccccttatccgtgggggacatgttccaagatgtccagtggatacctgaaactgcggatagtaccaaatcctatatatactatgttttttcgtatatatacatacctctgataaattttaatttataaattgacactgtaagaaatgaatactactaataaaatagaataattataacaatatcctataataaaatttatgtgaatgtgatctctctctcttttaaaataccttattttattatactcacccttctttccttgggtaaccgaagccatggcaggagggaaaaccatggatggggggaactactgtaatggtttagtgtccagcttctataagtttatagtaataaatgtattaactggaataactaggacacagtaatgttttatttaatggaacttcctgatttagtgagagttagaaaattcttatattttgaacatttattttaaaaaatgtttgcatatacttacttttataagtggaacatagggattctttctttgatatttgagactcttgtaattaattactcaagacaatgctcatgatctgtgtacagccttgtaggaggagctactcattagtatcgctagttgtgagacatttcactgctttgaaaatcagtattctcatctgtaaagtgagagtgtatgacaacatggtctcaaagatcacttcagtgtaaaaattcctagtcctcaatttagggaagccctgagccatagtgcagagggtatgtgttcctatgtatgtattttttataataaaattctctgggagcagcttgtttacttaattctttacctctttctcctgttaatcagaattttattttgagtagtttgtatgctttggcttgctttgttatcttttatttctatctttagtttcttctagaagttatcttatgtatagagttttacttcattgtgaagcttttatttatgcaaaggaaatggccaattgatgtctgaaactctttgaagtaattcgttcaagattcagctagatttcattgctgctctgtgggacacaaagcttctaaatgaggtctaggttgcttactctattacaattcttttattctcttttgcctaaatttaccattttgtagccaaatatttgaaagataacgtgtaaatattctgtacatttctctctgtagtaacattgaatctcttggcacataaatgaattactccttttgatgtaaaactcagttttctgcctattatgggctagtaggcatatatttgctttctgtagacctttctgcccactgctttacgtatctgggagagcctaatcacttaaggttatctagtttcattccaaactcaaaatcatttgagccttaaaaatgactcactggtttttgtcaggtttgtcaaagatcggatggttgtagatgtgtggtattatttctgagggctctgttctgttccattggtctgtatctctgttttggtaccagtaccatgctgttttggttactgtagccttgtagtatagtttgaagtcaggtggtgtgatgctttcaactttgttcttttggctgaggactgacttggcaatgcgggctcttttttggttccatatgaactttaaagtagttttttccaattctgtgaagaaagtcattggtagcttgatggggatggcattgaatctataaattaccttgggcagtatgaccattttcatgatattgattattcctatccatgagcatggaatgtgttcttccatttgtttgtgtcctcttatgtttcactgagcagtgatttgtagttctccttgtagaggtccttcacatcccttgtaagttggattcttaggtattttattctctttgaaggaattgtgaatgggagttcactcatgatttggctctctgtttgtctgttattggtgtataagaatgcttgtgatttttgcacattgattttgtatcctgagactttactgaagttgcttatcagcttaaggagattttgggctgagacgatggggttttctagatatacaatcatgtcatctgcaaacagggacaatttgacttcctcttttcctaattggataccctttatttctttctcctgcctgattgccctggccagaacttccaacactatgttgaataggagtggtgagagagggcatccctctcttgtgccagttttcaaagggaatgcttccagtgtttgcccattcagtatgatattggctgtgggtttgtcataaatagctcttattatttcaagatacatcccatcaatacctaatttattgagagtttttagcatgaagggctgttgaattttgtcaaaggccttttctgcatctattgagataatcatgtggtttttgtctttggttctgtttatatgctggattacattcattgatttgcgtatgttgaaccagccttgcatcccagggatgaagcccacttgatcatgatagataagcttttggatgtgctgctggatttggtttgccagtattttattgaggatttttgcattgatgttcctcagggttattggtctaaaattctcttttttttgttgtgtctctgccaggctttggtatcaggatgatgctggcctcatgaaatgagttagggaggattccttctttttctattgattgaaatggtttcagaaggaatggtaccagctcctccttgtacctctggtagaattcagctgtgactccgtctggtcctggactttttttggttggtaggctattaattattgcctcaattttagagcctgttattggtctattcagagattcaacttcttcctggtgtagttttgggagagtgtatatgttgaggaatttatccatttcttctagattttctagtttatttgcgtagaggtatttatagtattctctgatggtagtttgtatttctgtgggatcggtggtgatatcccctttatcattttttattgcatctatttgattcttctctcttttcttctttattagccttgctagcgatctatcaattttgttgatcttttcaaaaaaccagctcctggattcattaattttttgaagggttttttgtgtctctatctccttcggttccctatttaataaatggtgctgggaaaactggccagccatatgtagaaagctgaaactggatcccttccttacaccgtatgcaaaaattaattcaagggccaggcgcggtggctcatgcctgtaatcccagcactttgggaggccgagacgggcagatcacgaggtcaggagatcgagaccatcctggctaacacggtgaaaccccgtgtctactgaaaatacaaaaaattagccggcctggtggtgggtgcgcctgtagtcccagctactcagaaggctgaggcaggagaatgatgtgaacccaagaggcggagcttgcagtgagcggagatcgtgcgccactgtaatctagcctgggtgacagagtgagactccgtctcaaaaaaaaaaaaattaattcaagatggattaaagacttaaatattagtcctaaaaccatgaaaacctagaatggtattgcctagaagaaaacctaggcaataccattcaggacataggcatgggcaaggacttcatgtctaaaacgccaaaaacaatggcaacaaaagccaaaactgacaaatgggatctaattaaactaaagagcttctgcacagcaaaataaactaccatcagagtgaacaggcagcgtacagaatgggagaaaatttttgcaatctacttatctgacaaagggcaaatacccagaatctacaaagaactcaaacaaatttacaagaaataaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcagggatcttgaactagaaataccatttgacccagccatcccattactgggtatatacccaaaagattataaatcatgctgctataaagacacatgctgacatatgtttattgcggcactattcacaatagcaaagacttggaaccaacccaaatgtccatcagtgatagtctggattaagaaaatatggcacatatacaccatgaaatactatgcagccatagaaaaggatgagttcatgtcctttgcagggacatgggtgaagctggaaaccatcattctcagcaaactgtcacaaagacaaaaaaccaaacactgcatgttctcactcataggtgagaattgaacaatgagaacacttggacacaggaaggggaacatcagacgctggggcctgttgtggggtgggggcaggggggagggatcgcattaggagatatacctaatgtaaatgatgagttaatgggtgcagcacaccaacatggcacatgtatgcatatgtagcaaacatgcacgttgtgcacatgtaccctagaacttaaagtataataaaaaaattttaaaaaatgactcattggaatatttgtaacgacatgttctgtaaattttaagtgagtcatatacttttaaactaaatatctacggtatatggaaagcttggttagatttgtccatgttttgaggctctttatgtagccattagaacatttattattcattctaacaaataccaatgttgatttttagctcaggttgtcactgttattttttaaagtatggggtttactttttttttttaatactttaagttctgggataaatgtgcagaatgtgcaggtttgttacatagatgtacacgtgccatggtggtttgctgcatccattaacccgtcatctacattaggtatttctcctaatgctatccctcccatacctcctcacccctcaacaggccccagtgtatgatgttcccctccctgtgtccatgtgttctcattgttcagctcccacttatgagtgagaacatgcggtgtttggttttctgttcctgtgtcaggttgctgagaatgatggttttcagcttcatccatgtccctgcaaagaacatgaactcattcttttttatggctgcatagtattccatggtgtatatgtgccacattttctttatccagtctatcattgatgggcatttgggttggttccaagtctttgctattgtgaacagtgttgaaataaacatacgtgtgtatgtgtctttatgatagaatgatttataatcttttggctatatacccagtaatgggattgctgggtcaaatagtatttctggttctagatctttgaggaatcaccacactgtcttccacaatggttgaactaatttacacccccaccaacagtggaaaagcgttcctatttctccacatcctctccagcatctgttgtttcctgactttttaatgatcaccattttaactgtcgtgagatggtatctcattgtggttttgatttgcatttctctgatggccagtgatgatgagcattttttcatgtgtttgttggtcgcataaatgtcttcttttgagaagtgtctgttcatattactttttaatgcctacttgttgcatgtaattcttttttatcagtgtgtatctatacatagtttaaagagtaaaataagtttacaggtctttttacaaaatcaccagtacctatgaaaaattagccaggcttggtggcgggtgcctgtaattttggctattcgggtggctgaggcacgagaatgggttgaacctcggaggcagaggttgcagtgagccgagaacgcaccactgcactccagcctgggcgacggagtgactctatctcaaaaaacaaaacaaaactaaccccgaaaaaccaagatcaccagtacccatcctgacttttggacttatttttatctcacgtaacagctactttcagttattttagttggctctttttgtatttacctccatgtatctacatagtgttcttatactgctgtgctgcttgatttttttacttttagatattatatattgacttcccactttagaaggtgaatttagtttcttttctttttccctctacccccaacacatatgctcacttcctgtcactccatcatctctatatagtttaccataactttggttagattaatatttagtgtttacactccagtgtttatatgaatactatcatagttgaatcatataaagtaccatgattacttttcttttcttttcttgcacaaaagtttgtttttccctggagttaattatattggttttcctgactacttagtatttcatgtacttggtattgtttcttccctaattatgtaaacttctttttagtatgttagaatgtattagttattttatcactttcacttgcttaaagaaataactgtcatagtttctgatcttctcttatctgtacagattgttgtgtaagcatcctgttcagttatcgttttgagattttcctcctccattgacttgggaattcctttcaactccctcatagattgtaaccctgtttcttgaatcctgtgtctttctttttctgattttactccctaaattttgtggggcatatcctccagtagcttcttgagaaaggttgcatgaaatgaaaattgtttgaagagtttgcatgtctaaacatatttttattgtaccatcataatttatgctttcactggatataaaatttggacttggaaataatttttcctgagtattttgaaaacatcagttagattctcatctagcttctgatttgactactgagaaatgtgttgcaattttattttcttttactttttttaaatataaaatttttacttttgtgggtatatgatagatgtatctatttatggggtacattaaggttttgatgtaagcatgcaattgataataatcacgtcatggaaaatggagtattcatcccttcaggcatttatcctttgtgttacaaacaatccaactgaactatgttagttatttttaaatgtatattatttatataataataataattattattattttgagatggaatctctctctgttgcccaggctggagtgcggtggcatgatctcagctcactgcaacctctgccttccgggttcaagcgattctcctgcctcagccacccaagtagctgggattacaggtgcccaccaccacgcccaactaatttttctatttttagtagagacagagtttcaccatgttggccaggctggtctcaaactcctgacctcaagtgacccacccaccttggcctcccaaagtgctgggatttcaggcttgagccacggtgcccagcttaaaatttataattaaattattattgaccatagtcactctgtagtgctatcaaatacttggtcttattcattcattcttttttttttttttttttttttttttttttttttttgagacagagtctcactctgtcatccaggctggagtgagtgcagtggcacgatctcggcttactgcaacctccgcctcctgggttcaagagattgtcctgcctcagcctcctgagtagcccggattacaggcacctgccaccacgcctggctaatttttgtatttttagtggagacggggtttcgccatgttggccaggctgatcttgaactcctggcctcaagtgatccacctgtcttggtctctcaaagcgctcggattacaggtgtgagccaccgtgcctggcctattctttattttagattcaaatatatagtaggtctaatgtgctcagacatgcatattgaacttctgctatgtgaatgtactgtaattcaaagggaaacttttttgaagcaagacaggtctttatacattacttatgaataacttgcttcagatcttggattcttagttgaggatctgcttctgtagtcttactcgggtaaaacttataaaagactttttatatgggtataatcaaattctctagataggtggtttctataaatgctgaggggatatttggataaattattagcatcaaaatttctcctatgccatttcccagtattttgagagatgaaaattatgtaaaacatggcattaatgcagggactgagatgctgattcctaaggcaacattcatatacttgttcctactttcatctcaatgctaatttatgtaaagaaaatgattgttgatgctaaagagtgtccatgaaactatttctaaatacgtcttttgactagatagtgctttggacacattttagaacttcagaatttttagaattgtctcaattttgaaaaaaaaaaatcattcatttcccaacctcactcctcgtcaatagtgattttttgtctttgaatatactccctgctctagtgcctttaactggatctggcaaccaaaagcagggttttagcctgccctttggctgggcaatgattgggtttctcatttcctgttacaaagcatcttttaacttctattagtaatttattgtaatactttttcatacataactaattctccaacctgaatgttttgcagttcttctttatacaaattgagaagttttgataaggaagcttattttgatgtataggacacattaagtatgtttttgtttgtttgttttttgagacggagttttgctctgtctcctaggctggagtgatgtggcaccgtcatggctcactgccacctcggcctcccaaagtgtgttgggatttaaggaaatcatgaatctaatgcattttttttatattgcagacttcaagtcttcatcatctctgttacaactttggagtagaaacccagaagaataataaatatgaagaaagttctttctggcttaggtaacataaacaaaaaactgaatgtaaactcgggaatattatcatagatgtcagttaatatttactgtagagtactttggcagtttaaaccttctctgacttcagaagccaacatgctatatttatttactcttttaacatgtattgtttattattcttacacattgtcagttcatagaaaaatgtgttcttccttccttccttcattctttctttcttttttcctttctttctttttttcttcttttttttttcgtatctctctctgtcacctaggctggagtgcaatggcatgatctctgctcactgcaacctctgccttctgggctcaagcgatcctctgacctcagccttccaagtagctgggaccacaggcatgtgccagcatgcgtggctaatttttaatatctttggtagagaaggggtttcgccatgttgcccaggctgttctcaaactcttgagctcaggcaatccacctgcctcggtctctcaacgtgctgggattacaggcgtgagccaccacgcctgaccagtgttctcttcttaatataagagcttactcctctctcttcattcctcctttatatctctatcaagagtatagaaaattttgttgttgttgctttgatacttattgttgtctggcaacaccagagtataaggtggaggtgtgattgggagtagtattggctaaaattattagtcttagatgaattttggcattttaatatcagtcaagtaagtatatatttaacgctgtatgctgagtactatactaagatttggagtgttgtgctttatctggaaatatcaagaaaattatacaaaaatataggaaatgtgcaagaaccctttctttcactgaaaacctaggcccagcacagattctgacacacagtagatactcaataattgttagttaaatgaatatatgtgaaaaatgtatttttgtggagatgtcacataaggtgcagtgctttgaatatcaggagattatggaggaggctgggcatggtggctcacacctgtaatcccagcactttgggaggccaaggtgggcagatcacctgaggtcaggagttcaagaccagcctggccaacatggcaaaaccccatctctactaaaaatacaaaaattaggcgggtgtggtggcacaggcctgtaatcccagctactcgggaggctgaggcaggagaatcgcttgaaccagggagatgcagcttgcagtgagccgatatcgcaccgctgcactccagcctgagcgacagagagactccgtctcaaaaaaaaaaaaaagaaaaaaaaatggatcatggagtaaaatatatcaaatcaattcactaaatgtttaccctttctgagtgcaggattagttctagttatttggggatactcctatgattaactatagtctaacttttgtgaatatgatgtttgtcatttaacaaaataaatacaaatctgggcactgagattataatactcagacatatctatcactagcaaaatgttgatgcaaatgacttatataagagactttttaaagcccaaagattgatcaaactctatataaagaactattcctaatagaacaggctggagttctattccagtatttgacagtatttgggagtagaacactcacaaagtttatggcatcaatgtatcaaaagaccagtatgccaagaaggcaggaatagggagatccaaaaaaaaaaaaaaaaaaaaaaaggatgctggtgccatggatggcttctggaagcttaagactagatgtgagcttggagtttatgccaagaatgagggtgagttaggagtcataaaaataaatgttctctaggaactggtcataacagtaggttgaggcctgacatggcatgacttgtaggttatttgcacatacgccattggtttttgacttcttatctgttatcattttctaaagaatctcatggaaagaaaatatgttgatgagacatccatattataaactagaatatcttagcggctatatttgtaggaatataatctgacccacaatgatattttcataaaaatctaaataaataacaaatttatatagcaccagtatgagtcttttgtgttcacatcactagaataatattgaagaaaagaagaaaaactttaattttagccctagtaattacatatgattttaatctttctgcttcattttttcttgcacatcttttgggaatataaaaataacctggtgaaatattcacaaatgttttaaaaggaattatcatattttaatgtctaaaaagaggcaaaaataattatcagtattattaactgtaggaattgtagcacagtgaatagtttttctaacagtagactgactgtcagaatttgttgtcatctaagaccttagtgttaaattgttaaatattgtgatactttatttagaattgttgtggggtttacatatgataatgcatgtattatagagtattcagtaacatgcctggaaaacagaaactgcttaacaaacggaaaatgctgctactatctctacgtgatgtttgctatttattagagatggactctcttgtggccattccactagtttattctaaaatgtatcacagtcggatcaagcatggattacttactaagttcccaaataaaatgtcataaaaacaaacatctacatctttaaatctttggaacaattaaaaaaaaaaaacattgtttttttgtagaggcggagcctcgctatataaaccacggtggtctcaaactctggcctaaagttatcctcccacgtcagcttcccaaactgctggaattacaggtgtgagccactgcgcctgaccctttggaataatttcttcatgctttatatccacatgttaaaaaaactgttggcagcagttggtgatgcaagcagagatgaatagctgctaattaagcaccgttttctgtaaattttataccagaaggaggtcatggaaaatgagtacacattctacaggcttaactcttttgagaacagtgaatatcttagactagaggttatatataatttggaagtacccattcagtctaaaagtaaaaacctcatttttcacaaatgataatatataaaaatgctgtagtatattcgaatttttttgaaattgaagcctagagcaatactaaacgtaaagagtggtagtgggtattgtttaaaaagctcatttatttcccttgatttttgttaacatctcagtgcaggacctttctgagtttttatcaccctcctgccttttcttttgctaagaaaagttcataaatagctgctgctctccttgctttctgccacactcttttgatcgtgttcccttagagataccacaggttaagagaaagctgctgtaattatgaatgaaattaaaattccttcagctcgctttactgtggattgtcaacgtatttgcctcaatgtattaaatgacaaattctcttagacctttataaaatacaaaatttcagatttttgaaatccgaatgcaaggtttggaaataatatatttaagagtttttttgtttgtttgtttaataaaataccattttttcctccttctcctcctctttcgtaagtcttgcagtactgagctcctatgtctgctcctggcagaaggcagggctaagtagatgagaagagattgttgatagagaaatttccctcacaatctagacaacttgttagtggcctccattgttctggtggaatttaaattgtgtttagctcttaaagtcctatctaatgattaggacatatattatgctgaacttggcttttcagaaaaggtatacagaaatttcattgtaacaaatttgtattctacaaagaagaattgcatattaacacaaataagttcaactcaaaaggctttagggttacatttattaaccagaaagacttcgcagatttttttccctgggagaaaaatgctctactttccaaaccttagtcatattcttaattctgggtgatttttcatttatctctagtagttttatttctaagtcatttaactgtattccttggcactgctgacctacagcaatatcagacatctctgtggctgataaacacttgagaagctcactattttccttttgaagtaagaagacctcctactactttcttttcccctcaagcttcgttgaggtataattgacaaattaaaattgtatgtatttaatagtgtacaatgtgatgttttgatatatatatatacactgtgaaatgattactacgatcaagttgattatcatatccatcacctcacatagttaccatttttttctcacatgtcattataacagaattttattagtaatcatcaaacacacattgttcaaatttcactgattgtctcataaaatcttatacaattgatttgtcaaggcctatatactgtgattgattaaggtgtctcttatgtctactttaatcctaggtttcttcctttttttccttgcaatgtatttgttaaagaagtcaggtagcttcctgcattttgaattttgctgtttgtgcccctgttccttaacatgtttattttttctgtgttctctgtatttcctacaaattagtaattaagattctaaaggctcttaccagattttttggcagaagtatttcacaggtggtgtggtgtatgtccatcaggggtcttgtatgttagttgttttgttttttgcgatattagcagccatcagtgatcattgcctggattctttatttcatcagtgtttgtaaaataatagtattctaattgtgtcattttacttttcctttatgagctggaatacttctctagagtacaacttcccttagcaactgttagattactctgaggtccaattgtctgagttgccttttttttgtgtgtgtggtgagaatatttaatatctactctcagcaaatttcaagtgtacaatgcagtattatgaactatagttaccaagctgtacactagatctccttttaagaaagagagaagaaagaaagaaagaaagaaagaaagaaagaaagaaagaaagaaagaaagaaagaaagaaaataaaagaaaagaaggaaaagaaagaaaagaaaggaaagaaaggaaaaagagagcattcatggagacaatgccccaaagaaatcagaaattttcaaatggataactcctttgaagaaggaatgagattcctgtaatggctgcttcctggaaggcagtgtcatgtggaaccccttagcctcagcatccagagctccaggaagggaacatttccagtcaggtagaattatatatatactatttctttggaaacttcagccatcaagattcagccatcaaaattccaccatcatgacttctgtttcaacacaatggctcttagtcctcattttactgcttttgttgctgcctgttgttgaagcagtagaagccagaaatgcaattgctgtcatgttgggtgtggttctcagcattacaggcatttgtgcttgcttgggggtatgtgcacaaaagagaaatggacagatatgactttgaagggcatcccaaatcaaactttgccctgaaaacctttggactagtgaggctaaacttgagctttggtgtttgaaaatttccaagaaacagtaaataggggagttccacattcttagttgttttccataaaatgagagcaaattgctatgtataagaaaaaatgttttccttacaataaataatgcactgaaaaattaagcctataatttgtatttgctgcttagaaagggggttcaagaagtaagatggttgacatttacataagtaatatttcatagttttctaattatctaagctgggcatggtggcatgcgcctgtagtcccagctacttgaaaggctgaggtgggaggatcacttgaacccaggaggtcgaggctgcagtgagtcatcatcacaccactgcagtacagccttggtgacagagtgagatcttgtctcaaaaaaaaaaaaaaaaaaaaaaagcacatgaaataggaagaaggaagttcttgcccagaatcctaagaaatcaccactgttcagttataatcactgcctcctgaatcattgaggagtcttttctccatattttcattagacttttgttattgcccaagttaatattgtatttaaatatcaaatagccaaacatagatgcttttatctctggagaaaaaacatttagaaaaatgcattcagtgtatctaacattgaagtggagaaaagagttaatgtaaaaaaatcctttatttttatatttatcattttaaacttttattttaggtttggggtacatgtgaaagtttgttacataggtaaactcatgtcatgggagtttgttgtacagattatttcatcacccaggtattaagcccagtacccaatagttatattttttactcctctccctcctcccaccctccaccctcaagtagacctcagtatctattgttctcttctttgtgttcatgagttcgcatcatttagctcccacttacaagtgagaacatgtggtacttggtttgctttaaaaaaacactttatatttacattgaaatggagaagatatttaatgttaaaaaactttatattaattaattgagtaacatccccatggggagaagtactatattaaatataaactcattatgttgttaaaaaaaaaagaagggacgaaatgatgttgaagatgaaacctgcagcagcaggctgtacacaacaatttgtgaggaaaaaattaatcgtttgtgctctaattgaagaggagtgatgattaatagtacaaataatagccaacaccatagacatctcaatttgttctgcttatacaaatctgactgaaaaaattgaagtggagcaaactcaatgggtgccaaaaccattgtgcccagatcagcggcagataagagcagagctttcattggaaattttaaacaagtgggatcaaaatcctgaagcatttcttcaaagaattgtaacaagagatgaacatggctttaccagtatgatcccaaagagaaattacaataaaagcagtggctaccaagaagtggaagtggtctagtcaaagcaaaagcagctctgtcaagagtaaagatcatagcaacagttttttgggatgctcaaggcattttgcctggtgatttttctggagggccaaagaatgataatgtctgcttattatgagagttttttcagaaagccaaaattttagcaggaaaatgcctgaaaagcttcaccagtgtccttcaccacaacaatgttcctgctcattcctgtcatcaaacaaaagtaatcttgtgaatttcaatggaaaaacattaggcatccaccttacagacatgatttggctccttctgacttctttttgtttcctaatcttaaaaaatctgtaaaaggcacccatttttcctcagttaatgtgaaatgtgaaaaagattgcattgacatagctaaattcctcagttctttatggatggactaaatggctagtatcacaaaggtatcttaaacttgatggagcttatgttgataaataaaatttatattttaatcttttaattccatttttccaaaagttttttgaggtctcataatattctgcaattccacaggctgtctcttcactctgttaattgtttcctttgcagttgtacatggtatttagttagatgtaattccatttgtctatttttgtttttgttgtctgtactttgggggtcatatctaaaaaataatttcccatacaatatcaataagctttcccccagttttcttctagtaattttacagtttctggtcttacatttaagtctgtaatccatttttaattgattttttgcataaggtgggagataaggttccaattttattcttctgtatgtggatatccaggtttttccaacaccatttattggagaaactctcttttccccattgtatgttcttggcaactttgttgatcatcagttgcccataaatatgtggattttgttctagatattctattctattccattggtctgtatgtctttttaaaatgtccataccatgctgttttaatgactattagatgtctagtgtattttgaaatcaggaaatgtgatggctccagctttgttctttttgctcaagattgctttggctatttaggtcttttgtgattccatataaatttgaggattattttttctgcttctgtgaaaatgccattgtcatgttgacagggataagactgaatctgtagaatgctttaggtagtatggacatttaaaaatattaagtcttccaatctatgaacacaggatatctgtccctttatttgtgttttcttcaatttctttcttcagtgttttatagttttcagtgtgcaagtctttcacctccttggttaaatttactcataagtattttattttttgacactattataaatgggattgttttcttaatttttgggtatagttcattgtttgcatataaaagctactgatttttatgttgattttgtgatttgcaactttattgaatttattagttctgacagttttttggtagcattttaaggttttctaatataagattatgtcatctgcaaacaattttacttcttcctttcaaatttgaatgcctttccccccccctcatcttgcctaattgctctggctaagacttctagtacaatgttgaatagaagtggtgagagtgggcatctttgctttgcttttttcctatgttagaggaaatgttttaacctttttaccatctagtatgatgttaactgtggacttgttgcatgatttttattatgatgaggtacattccttctattcctaattttttgaaatttttttttaatcttgaaaggatgaattttgtaacagaagatttttctgcatctatcaagatgactatatgatttttatcctttattctgttcaaatggtgtatcacatttattgatttttatatgctgaaccacccccaccctcatatctgaggaataaatcctagttgatcgtgctgtatttggtttgctagtattttgttaaggattttttcatctgtgttcatcagggatagtttttttgtcatgtccttgtctggctttgatattagggtaatgctggcctcatagaatgagtgtggataggttctttcctcttcatttttagggaagagtttgagaaggattggcgttaagtttttcttaaatatttagtagaattcaccagtgaaggcatttggccctgtgttttccttggttgtgagatttttgattactgattcagtcaccttaacattattttatgtttctgtgtttgttaacttaaggcctccagctgcatccgtgttgctgcataggacatgatttcattctttttaaatggctacatagtatttcatggtgtatatgtaccacatttaccttatgcattctgccattgatgggcagcaaggttggttccatgtctttactattgtgaatagtgctgcaatgaacatacaggtgcatgtgtctttttggtacaacaatttgttttcttttggctgtatccccagtaatgaaattgtggaatcaaatagtagttctgttttaagttctttgagaaatctccaaactgctttccacagtggctgaactaatttacatccccaccaacagtgtaaaagaattcccttttctctgcagcccagctaacacctgttattctttgactttttaataaaaaccacttcgactggtgtgagatggtatctcattgtggttttgatttgcatttctctgatgactagtgatgctgagcattttttcatatgtttgttgaccacttgtatgtcttcttttgagaattgtctgttcatgtctttttaacccccactttttaatggggttatattttgcttgttgaattatttaaattccttaaagattctgggtattagacctttgttggatgcatagcttgcaagtatttactcccattctgtaggttgtctgtttactctgttgatagtttcttttgctgtgcagcagttctttagtttaattaggtcccacttgtcaagttttggttttgttgcaattgcttttggtgaggacttagtcataaattattttccaagactgatgccacaaggtagtcttctttggcttaaatccacctggtgttctataatctgttacttgaatattgatatctctctaggtttgggaagttctctgttattatccctttgaataaactatctaccactatatctttctctacctcctctttaaggtcagtgattcttatatttgccctttatgaggctatattctagatcttgtaggaatacttcattcttttttcttttgtctcccctgacttgtatttttaatagcctgtcttcaaggtcactacttatttcatctacttgttcagttgcactattaagatactctgatatcagtatatcaattgcatttttctattccagaatttctgcttgattctttgtaattatttcaatcactttgttagatatatctgataggattctgaattccttctctgtgttatcctgaatttttttgtttcctcaaaagggctaatttgaattctctgcctgaaaggtcacatatctctgtcactctgggattggtccctggtgccttatttagttcatttggtaagggcatgttttcctggatggtcttgaggcttgtggatatttgttggtgtctggacagtgaagagttaggtatttactgtagtctttgcagtctgggcttatttgtatccatcatttttgggaagactttctaatatttgaagggatttgcatgttgtgtgctatgtttttggtcacagcagccgtatctgccttagaaggcaccccaagcccagtaacactgtgagtcttgcagacttttagaggtctcaccttggtggtgttggatggggtccagaaaaattctctggattaccaagcagagactctttgttctcttcccttgctttctctctaacaaatggagtctgtttttctgtattgaactgtctggagctaggggaggagtgatacaagcacccctgtggccactacccctgggactgctgtgtctgacctgaagccagcgtagtactgggtctcacccaaggcctgctgtaatctgctacctggctaccacctatgtttgcttaatgaacgagggctctaatagcaggtgaggcgatgaagcttgccaggcttgtgtccttcaattcagggcagcaagttccccctggctcctggtgggtgcaaagatgctggccaggaacaagggcctggagtcagaatccttagggagctacctggtgctcctttttactgtggctgatctggcacccaagccacaagaaaaagtttttttctactcttccctcctctttccacaagcagaggagtatcttcctatggccaccactgtcacaggcccgtggggagtactgccaggctccactgatgttcactgaaggcccaagggctcttcagtcagcttgtgatgaatggtgccgggtctgggactcatcttgcaaggcagtgcacttctctctggcccagggtaggtccagaaatgccatccaagagtcaaggtctggaattggggacccaagagactgcttggtgctctaccccactgtggctgacctggtacctaagctgcaagataaagtcccctttcatcttccccttttttttgtcaagcagaaggagactctccccatagccaccatagctgggaatgtgttggctcacacctgaagccagcacatctcagattctcacccaaggcccatctatggtatgcactacttggctatcgctgctgattgttcaaaatgtgttggctttctagccagtgggtgatgaatcctttcaggacctggtctttcctttcaaggcagcagatccccttctggccctggttgtgtctagaaatgttatccagtagctagggcttggaatgggtgtctcatgactcttcctggtgtcctatcctaccatagcagagttgttatccaaattgcaagaccaagccctgtttactcttccctttcctctcctcaagcagaaggaagggggtctcttggagctgcaacctgtgctgcctgggcttgggggaggggcagggtaggcactcccttggccacccaggctggtgtctcacatgccccctaagtttactgactccatacccacaaggacttgccttgtggcctagactgcctttcaggtttatttaggaccccaatgcactttagccgacagcaatgaggcttgctacaactcaagttccaattactggaatggatgattgccctctgactagggctggtctaaatgtgctctccattgacgtcaactgatttgtgcctagtgttttctgctgtgaaagggcggcactgagttgcgatgcagagtctcacaatcattgcactctctatcccccaaacgcacagattcttcccattatgtggctgtgaatggggaagggatggtgtgggcaattcaagactgtctttcctaccctcttcagtgcctctttcagttatatgaagttaagaccaggcactgtgaccactcacctgatttttggttcctacaaaattgctttttttgtgcagatagttgtcaagtttggtgctcctgcagggagaatgatcagtggagacttccatttggccatcttgctctatctccctctacatttattttgtatcctgaaattttactgaagtcatttattagttctaagagccttttttttttttggaggctttagtgctttctagttatagaatcataatgtcagtgaagggagatagtttgacttcttcttttcctatttggatgcttttaatttctttctcttgcctgatcggtctggctaggatatatagtacgtattaggccattcttgtttgctataaatacttgagactgttttaatttataagaaaaaaggtttaattggttcatggttctgtaggctgtacaggaaacatagtgctgtcatctgcttctggtaaggcctcagaaagctttttctcatggcagaaggtgaagcgggagcagacatttcacccggcaaaagcagaagaaagagagtgagggtgggagggaaagtgccacccacttctacaaaaccagatttcgtgagaactcattcactcatcaccaaggggatgggctaagccattcatgagagatatgcccccatgatccaaacatcttccagcaggccctatctccaacactggagattacaagtcaacatgagatttgggcagggacattcaaactacaccacagtactatgttgaatagaagtggtgagtgtgggcgtccttgtttgttccagttctcaagggaaatgttcctagttttggcctgttcattatgatgttggccgtgggtttgtcatagatggctcttattattttgagatatgttcctttgatgcctagtgtattgggggttttttatcatgaatgggtgttggattttattgaatgcattttctgtgactattagagatgatcatgtggtttttgtttttaattctgtttatgtggtcagtcacattcattgatttgaatatattgaaccaatcttgtatcccaggaataaagcctacttgatcgtggtgaattaactttttaatgtgttgctggattcagtttgctagtattttgttgaggatttttgcattgatgttcatcagtgatattggctggaagttttgttttttgttgttcctgccagatttaggtatcaggatgatgccaccatcaggatgatgcatcgtagaatgaattacggaggagtctctcctctttgatattttggaatattttcagtaggattggtaccagctcttctttgcatgcctggtagaatttggatgtaaattctaggtccagggctttgttgtcattgttgtttttgtcgttgttgatcttctttctctattttctttgttaatttagctaccagtctgtgaatcttgtttattctttcaaataaaaccaagttttggtttcgttgatcttttgtatacagttttacatctcaattttattcagttttgctatggttttagtcatttttttttcttttgttagctttgaggttagtttgtttttgtttttctaattcctctagttgtgatgttacattgttaattttagatctttctaacttcttgatacaggcatttcatgctataaactttcctcttaacactgcttttgctgcatcccagatatatatttgtgtgtgtatatatatatatatatatatatatatatatatatatatatatttttttttttttttttttttttttttttgagacagagccttgccctgtagctcaggctggagtgcagtgggaccatcttggctcactgcaacctctgcctcctgggttaaagcgattctcctgcctcagcctcctgcatagctggaactacaggcgtgtaccatgcctggctaattttttttttttttttgagacggagttttgctcttgttgcccgtgctggagtgcaatggcgcaatctcggctcaccacaacctctgcctcctgggttcaagtgattctcctgcctcagcctctcgagtagctggaattacaggcatgtgccaccatgcccggctaattttgcatttttggtagagacggagtttcttcatgttggtcaggctggtcttcaactcctgacctcaagtgatccacccgcctcggcctcccaaagtgctgggattacaggcgtgagccactgcatggcccatcccagagattttggcatgtcgtgtatcttaattaatttcaaagtattttttatttctgccttaattttattgtttacctgaaatcactcagtaacaagttgtgcttaatttccaggtaattgtgtggttttaagggatcttctttggtattcatttctatttttattgcactgtggtctgagtgtatgcttggtatgatttcagtttgtttgaattcattgagatgtgctttatgcccgaacatgtggtcaatcttagagtatgttctgcatgcagatgagaagaatgtgtgttccatggttgctgagtgacatattttgtagaaatctattaggtccaattgttcaagtgttgaatttaagtgcagaatttcctcataagttttctgccttgatgatctgtctaacgctgtcagtgggttcttgaagttccccttattattgtgtgactgaggctattcataggtctagaagtacttgttttatgaatcagcgttctctaatgttgggtgtatatatatttaggataattaagtcttcttgttgaattgaatcctttattgttatgtaatgtcctttgtcctttttgactattgttggtttaaagtctgttttatctgatataagaatagtgacccctgcttttttttctgtttttatgatagatctttctccatcactttactttgagcctgtaggtgtcattacatgtgagatgcatctcttaaagatagcagatgatggtttccagcttcatccatgtccctacaaaggacatgaactcatcatttttatggctgcatagtattccatggtgtatatgtgccacggtatacatatgtaacaaacctgcatgttgtgcacatgtaccctaaaacttaaagtataataataaaaaaaagacagcaaatgattgggtcttgttttttatccaacttgccattcttgaaacttctgacctgtgtgctcaaacgatgcaggattgggactgggcctgcagctttgtactctggcccctcatagttgaacactagctgtcctagcggggctgaagtgcacccaagccactggcaaagcactcaggcagggcagtggaggctatgctgtgtgcttgctcttgtaggagaatccaggcaggagccttgggaggtgttgccgacagaggggcatgcagatcagatgcactccagtactgcaggaaagccatctctgctctatcctctctcttggcccagcagtcatcagggtcgtgttttactgcagctgccttgcatgcagaaccttctgggctctgcgcaggcttgagctctgcctctgtctactctcctggcattttaccctgccaatttaaatgtctatggagtttgtggaatctcttgtagctaggatcccagaggtccgtggtgggagtgtgttgactcataattccttcatttaccccttccttaggacctgttgaaggctgagagctggtcctggtgcttggtgactccatgcggagttcccagtttcctgtgcctcttccaagtcagtgtctgtgttgcctctctgttgactttcagtgttttctctcaaaagatgtgtttgaagtgtgatggtttacttgatatttggtttctcttggtgagagaggtgcttcccagctgtgtcttgaaccatcttgttccttatccaagtttgtactttttaatcatcatctctacattctctccacagctctgtctctgtaaccaccattctactctgtgcttgtacgagttcagttgttttagattccaggtacaatttaaaacatgtggtatttgactctccgtgctggacttatttcacttagcataatatcttcctggttcatccatgttgtcacaaatcacagtttttccattcttttaaaggctgaatagtattccattgtgtatataatgctacattttttaatccatttatttgttgagggacacttaggtggattgtgtaacttggctattgtgagtagcgttgcagtgaacccagaagtgtagacgtctctttgacaaactgacttcaaatatttggggtaaatacccaaaagctgcatcatatagtaattttatttttagtttgttgaggaacttctatacagttttccataatgtttgtactaatttacattctcattgacaatgtacaagggtttccttttttcacatccttgccaactcttgttatctttcgtctccccataatcattctgacaggtatgaggtgatatctcattgtgggttttttgtttgtttgtttgtttgagacagagtcttgctctcggctcacttcaacctccgcctccagggttcaagtgattatcgtgcttcagcttcccgagtagctgggatcacaggcgcctgccaccatgcctagctaatttttgtatttttagtagagacagggttttgccatgttggccaggctggtctcaaactcctaagctcaggtgatttgcttgccttggcctcccaaagtttgggattacaggcgtgagccaccacacctgccctcactgtggttttaatttgagcttccctaatgtgtagcgattttgagcattttttcatatatctgttggccatttgtatgtgttcttttgagaaatgtgtattcacttttcttgccaacttttttttttttgagacagggtcgtgttgtatttcccaaagtggtcttgtgctggtctcgtactcctgtgctcaagcaatcctcctgcatcagcctctggagtagctaggattatagatgtgtgccaccatgcctggctttttgcccattatttatttggattatttgttttcttgctctctctctctctctctctctctctctctctctctctctctatatatatatatatatatatatatatatatatatataatcaaaacccttactggatatatggattagaaatactttctcccaatctgtaggttgactctttgcactgttaattgctttcattgctgtgcaaaagctttttagcttgatataaccccacttgtctctttttgcctttgtttcctgtgcttttgtggtcaaatccaagaaaacattgcccagaccaggccatgtagtttttcccctgtgtgtgtgtgtgtgtgtgtgtgtgtgtgtgtgtgtgtgtgtgtttcccaagagatttacattttctgatcatcagggttattgtagttttattttcttggaatgtctttgtctggctttagtatcagggtaatgctgaccctgttaaaagagtttggaagtattggttttttttgtattttggaagaattacatttaggtctttaatccattttaagttgatttttgtacgtggtgggagagaaggtttaaatttcattcttctgtgtgtggatatccagctttcccaacatcatttgttgaagagactatccttttttcattgcatattcttggcacctttgttgaaaaccaattgaccacacatgtgtgggttcatttctgggctctctattctgttccattggttgacacgtctatttttatgccactaccatgttgttttaattactatagctttgtaatatagtttgaaattaggttgtgtgaaccatccagctgtattctttttgctcattgtagcatttgctaattggtgttttttgtggatccatacacattttagtgtcgttttcccatttctatgaaaattgatattggaatttttatagggattgcattgaatctgcatatcacttttggtagtatggatattgtaacaatatgaattctttcaatccatgaacatggggtatctttccatttgtgttttcagttttttttttcagtttatagttttcagtatacatgcctttcacttccttggttaaatttatttctaggtattggatttttttgtagctattataagttagattgttctctttatttcatttttggatagttcattgatcgtgcctagaaacactattgatttttgcatgtacaatttgcattttgcaactttactgtatttttttattcattcttaacagttttttggtggagtattcaggattttctaatataaaatcatgttgtcagcatctgatacaatttcacttcttcctttcttgtttggatgtcttttactttctttcttttgcttaattgctctggtgaggacttccaatattatgttggatcgaaatggcaagagggggccgggtgcagtggctcatatctgtaatcccagcactttggaaggccgaggtgggcggatcacgaggtcaggagattgagaccatcctggccaacatggtgaaaccccgtctctagtaaaagtacaaaaattagctgggtgtggcagcatgtgcctataatcccagatacttgggagtctgaggcagaagaatcatttgaacctgggaggtggaggttgcaatgagttgagattgtgccactgcactccaacctggtgacaaagctagactccatctaaaaaaaagaaaaaaagtggcaagagggggattccttgtcttgttctagatcttagagtaaaggtttcagttttttactgttgagtataatgttagctgtgggtttcttatatatggactttattgtgttaagatacgttctttttatatctaatttggtgagagttttataatgaaaaaatgttgaattttgtcagatgctttatttatttatttgggatggagttttgcttttgttgcccaggctggagtgcaatggcacaatcttggctcactgcaacctccttctcccaggttcaagtgattctcctgcctcagcctcccgagtggctggaattacaggcatgagccaccatgcctggctaattttgtatttttagtagagatggggtttctccaagttggtcaggctggtttcgaactcctgacctcaggcaatccgcccgctttggcctcccacggtgctgggattataggtgtgagtcaccacaccgggacagtcagatgctttttccacatcaaatcagaggatcatatgttttttgtcctttactctgttaatgtgacataccacatttacgttttgcatattttgaactattccatctcaggaataaatcccacctgatcatagtgaatgatccttttaatgtgttgttgaattcagttgctagtattttgttgaggatatttgcatctatgttcatcaaggttattggtctgtaattttcttttcttggaatgtccttgtctggatttggtatcagggtaacgctaatcttgttaataaagtttggaagcattcccccttctgattttttggaagagtttgggaaggattgccattcattctattatttatttatctatttattttattatacttcaagttctacggtacatgtgcatgcacaatgtgcaagtttgctacataggtatacatgtgccatgttggtttgctgcacccatcaactcatcatttacattaggtatttctcctaatgctatccctcccccaagcccaccacctcctgacaggccctggtgtgtgatgttccccaccctgtgtccaagtgttctcatggttcaattcccacctatgagtgagaacatgtggtgtttggttttctgtccttgtgatagtttgctcagaatgatggtttccagcttcatccatgtccctacaaaggacatgaactcatccttttttatggctgcatagtattccatgctgtatatgtgccatattttcttaatccagtctatcattgatggacatttgggttggttccaagtctttactattgtgaatagtgccacaataaacatatgtgtgcacgtatctttatagtagcatgatttataatcctttgggtatatacccagtaatgggatcgctgggtcaaatgctatttctagttctagatccttgaggaatcgccacactgtcttccacaatggttgaagtaatttacactcccaccaacagtgtaaaagcgttcctatttttccacaaccttaccagcacctgttgtttcctgactttttaatgatctctattctaacgggtgtgagatggtatctcattgtggttttgatttgcatttctctgatggccagtgatgatgagcattttttcatgtgtctgttggctgcataaatgttttcttttgagaagtgtctgttcatatccttcacccactttttgatggggctgtttgattttttcttgtaaatttgtttgagtacattgtagattctgcgtattagccctttgtcagatgagtaggttgtgaaaattttctcccattttgtaggttgcctcttcactctgatggtggtttcttttgctgtgcagaagctctttagtttaattagatcccatttgtcaattttggcttttgttgccatagcttttggtgttttagtcatgaagtctttgccagtgcctatgccctgaatggtattgcctagattttcttctaggttttttatggtttcaggtctaacatttaatccatcttgaattaatttttgtataagctgtatggaagggatccagtttcagctttccacatatggctagccagttttcccagcactatttattaaatagggaatcctttcccatttcttgtttttgtcaggtttgtcaaagatcagatggttgtacatgtgtggtattatttctgaggcctctgttctgttccattggtctatatatctgctttagtaccagtgtcatgctgttttggttactgtagacttgtagtatagtttgaagtcaggtagtgtgatgcctccagctttgttctttttgcttaggattgtcttggcaatgtgggctcttttctgtttccatataaactttaaagtagttttttccaattctgtgaagaaagtcattggtagcttaatggggatggcattgaatctataaattaccttgggcagtatggccattttcacggtattgattcttcctacccatgagcatggaatgttcttccatttctttgtatcctcttttatttcgtggagcagtggtttgtagttctccttgaagaggtccttcacatcccttgtaagttggattcctaggtattttattctctttgcagcaattgtgaatgggagttcactcatgatttggctctctgtttgtacttggtgtataagaatgcttgtgatttttgtacattgattttgtatcctgagactttgctgaagttgcttatcagcttaaagagattttgggcagagatgatggggttttctaaatatacaatcatgtcacctgcaaacagagacaatttgacttcctcttttcctaattgaataccctttatttctttctcctgcctaattgccctagccagaacttccaacattatgttgaataggagtggtgagagagggcatctttgtcttgtgccggttttcaaaggaaatgctttcagttgttgcccattcagtatgatattggctgtgggttttgtcagaaatagctcttatttttttgagatacgttccatcaatacctagtttattgagagtttttagcatgaagagctgttgaattttgttgaaggccttttctgcatctattgcgataatcatgtggtttttgtcattggttctctttatgtgatggattacatttattgatttgcatacgttcaaccagccttgcatcccagagatgaagctgacttgatcgtagtggataagctttttgatgtgctgctggattcggtttgccaatattttattgaggatttttgcatcaatgttcgtcagggatattggtctaaaattctctttttttttgttgtgtctctgccaggcttttgtatcaggatgatgctgacctcataaaatgagatagggaggtttccctctttttctattgattggaatagtttcagaaggaatggaccagctcctctttgtacctctggtagaattcggctgtgagtccatctggtcctggacttttttttggttggtaggctatcaattattgcctcaatttcagaacctgttattcacctattcggagattcaacttcttcctggtttagtcttgggaggatgtaagtgtccaggaatttatccattccctcgagattttcttgtttatttgcatagatgtgtttatagtattctctgatggcagtttgtatttctgtgggatcagtggtgatatcccctttgtcattttttatagcgtctatttgattcttctttcttttcttctttgttagtcttgctagcggtctatcaattttgttgatcttttcaaaaatccagctcttggattcattgatgttttgaagggatttttgtgtctctccttcagttctgctctgatcttagttatttcttgccttctgctaactttgaatttgtttgctcttgcttctctagttcttttaattgtgatgttaggatgtcgattttagatctttcctgctttctcttgtgggcgtttagtggtataaatttccctctacacactgctttaaatgtgccccagagattctggtatgttgtgtctttgttctcattggcttcaaaaaacatctttaattctgccttcattttgttatttacccagtagtcattgaggagcaggttgttcagttcccatgtagttgtgtgttttgagtgagtttcttaatcctgagttctaatttgattgcactgtggtctgagagacagtttcttgtgatttctgttcttttacatttgctgaggagtgctttacttccaattatgtggtcaattttagaataagtgcgatgtggtgctgagaagaatgtatattctgttgatttggggtggagagttctgtaggtgtctattaggtccaattggtccagagctgagttcaaagtcctggatatccttgttaaccatctgtcttgttgatctgtctaatattgacagtggggtgttaaagtctcccattattattgtgtgggagtctaagtctctttgtaggtctctaaggattgttttgtgaatatggatgctcctgtattgggtgcatatatatttaagatagttagctcttcttgttttattgatccttttaccattatgtaatggccttctttgtcttttttgatctttactggtttaaagtgtgttttatcagagactaggattgcaacccctgtttttttttttttttttttttgctttccatttgcttggtagatcttcctctatttttaaattttgagcttatgtgtgtctctgcacgtaagatgggtctcctgaacacagcacactgatgggtcttgactctttatccaatttgccagtctgtgtcttttaattggggcatttagcccatttacatttaaggttaatattgttatgtgtgaatttaatcccgtcactatgatgttagctggttagtttgcccgttaattgatgcagtttcttcctaacatcgatggtctttacaatttggcatgtttttgcagtggctggtaccagttgttcctttccatgtttagtgcttccttcaggagctcttgtaaggcaagcttggtggtgacaaaatgtcttagcatttgcttgtctgtaaaggattttatttctccttcacttatgaagcttagtttggctggatatgaaattctgggttgaaaattcttttctttaagaatgttgaatattggccgccattctcttcgggcttatagggtttgtgccaagagatcagctgttagtctgatgggcttccctttgtgggtaacccaacctttctttctggctgcccttaaaattttttccttcatttcaaccttggtgaatctgacaattatgtgtcttgtggttgctcttcttgaggggtatctttgtggtgttctctgtatttccctgaatttgaatgttcacctaccttgctaggttggggaagttctcctggataatatcctgaagagtgttatccagcttggttccattctccacctcagtttcagggacaccaatcaaacgtagatttggtcttttcacatggtcccatatttcttggagattttgttcatttctttttactcttttttctctaaacttgtcttctcactttatttcattaatttgatcttcaatcagtggtaccctctcttccacttgatcgaatcagctactgaagcctgtacatgtgtcacgaagttttcgtgctatggttttcagctccattaggtcatttaaggtcttctctacactgtttgttctagttagccatccgactaaccttttttcaagatttttagcttccttgagatggattggaacatgcttcttagcttggagaagtttgttattactgaccttctgaagcctaattctgtgaactcatgaaagtcattctccatccagctttgttccattgccggtgaggagctgtgatcctttggaggagaagaggctctctggtttttagaattttcagtttttctgctctggtttctccccatctttgtggttttcatctacctttggtatttgatgttggtgacctacagatggagttttggtgtagatgtcctttttgttgatgttgatgctatttctttctgtttgttagttttccttctaccagtgaggtccctcagctgcaggtctgttggagtttgctggaggtccactccagaccctgtttgcctgggtatcaccagcggaggctgcagaatagcaaatattgctgcctgatcctttctctggaagcttcatcccagaggggcatctgcctatatgaggtgtctgttggcccttactgggaggtgtctcacatttaggctacacgggggtcagggacccacttgaggaggcagtctgtccattctccgagctcaaacactgtgctgggagaaccactgctctcttcagagctgtcagacagggacttttaagtgtgcagaagtttctgctgccttttgttcagctctgccctgtccacagaggtggagtctatagaggcagtgggccttgctgagctgcggtgggctccgaccagcttgagcttcccagccgctttgtttacctactcaagcctcagcaatggcagatgcccctcccccagccaggctgcagccttgcagttagaactcaaactgatgcgctagcagtgagcaaggctccatgggcggggaccctccaagccaggcacgagagggaatttcctggtctgccggttgtgaagactgtgggaaaggcacagtatttgggcaggagtgtactgttcctccaggtacagactgtcacagcttcccttggctaggaaagggaagtcctcagaccccctgtgcttcccccatgagtcaacgctccaccctgctttggttcaccctccatgggctacacccactgtccaaccagtcccaatgagatgaaccatgtacctcagctggaaatgcagaaatcacccatcttctgcgtcgatcacgctgggcgctgcagagcagagctcttcctatttggccatctttgaatggaaaacctggcattccttattttataaatgtttttcttgtcttgtcttttttttgtgtgtgcgtgatggagtcttgctctgtcacccaggctggagtgcagtggaaggatcttggcttactgcaacctttgcctcccaggttcaagcgattctcctgtctcagcctcccaagtagctgggattacaggcatgtgtagccatgcctggctagtttttgtatttttagtagagacaagctttcatcatgttggccaggctggttgctggtctcaaactcctgacctcaggcaatctgcacacctcggcctcccaaggtgctgggattacaggcatgagccactgtgcctggccaaatgtttttaatatatgttttataattagttttttaaaaaatattttagaaattcagcagtgaacccatcaggtccttggcttttctttgaatgaagacattttattactggatttaatttttaatcattatttgttcagattttctgattcaatcttgatatgttgtatatatctaggaatttatccatttcttctaggttatctagtttgttgatgtataattgtaattgttcatagcagtctcttatgattctttattcttgatatcagttgtaacatctcctctctcatttctgattttatttgattactctctatatcttggttttgctaaatgcttgacaattttatccttttagaaaaccaacttttagtttcgttgatctattgtatttttttggcctctattttattcatttctgctctgatctttattttttttctgcctgttaactttgggctttgttcttattctagttcctcgaggagcaacgttgtttatttgagatatttcttttttgatgtaggcatttattgctgtaaactttcttttttttttttttttttgagacggggtctcactctgttgccaaggctggagtgcagtggcatgatctcagctcactgcaaccttcacctactgggttcaagcaattctcctccctcagcctcccgagtagctgggattacaggcacccacgaccactcttggctaatttttgtatttttaatagggacggggtttcaccatcttggccaggctggtctagaactcctgacctcatgatccacccacctcggcctcccaaagtgctgggattacaggcgtgagccaccatgcccagcttcctattagttttggtatggattgtttttattttcatttgtctgaaggtacttaaaatttttttttaatttttaaaatgtgtacatacatatatatatgtttgtagtgacaggttcttgccatgttgcctagactaatctcaagaaagcttcctgcctgggcctcctgaaatgatgagattgcaggcatgagccacctctagatgcttttaaatttcccttttaagttattcattgacctgctgattgttcatgagcatggtgtttaatttccatgtatttgtgatttttccaaaattcttcctgttattgatttctagtttcataccattttggtcagaaaggatacttgatatgattttagttttttttaaatttcaaaattttaaaagctcaaggatcgcttgagcccaggagtttgagaccagcctaggcatcgtagcaagaccttgtctctaccagaaaaacaaacaaacaaacaaaaaacaaaaacaaacaaacaaacaaacaaaacatagcctggtgtggtagcctgcatctgtagttccagctccttgggaggctgagatgggagggttgcttgcatctgggaggttgaggctacagtgagctatgatagtgtcagtgtactccagcttgggtaacagagtgaggccctgttttttgttgttgttgttgttgtttgtttgttttaaagccccactttctaatactatcatctttgtggttaggatttcaacataggaattgtgggggaacacaaacattcagaccattagtacttactgattttctttttcatagatctattctgttttcaaagtggggtactgaagtctcctactattgttgtattgctgtttatttctcccttcagtcatgttgatacttggtttatattttaggtgatcttaagtagatatatatttacaactgttatatcctcttgatgaattgactcctttatcattatataatgcccttctttgtctctggtgacagtttttgacataaattctatttttttctgatataagtatacccaaccctgctctcttttggttgctatttgcatggaatgtattttttccatcccttcactttcagcctatgtgtgtccttaaagctaaagtgagtatcttgtaggaaggaaatagatttgttgttttatccattcagccagtttgtgtcttttggttggagaaattaatccattacagttaaattaattattgataagtaaggacttaactattgtcattttattagttgtttcctgaatgttttatagtttctttgctcttcccttcttgctgtcttcctttgtgacttgattttttttttatagtggtatggtttgatcccttcttctttattttgtgtgtatcagctataatattttgcctgtggttgccatgacagttatgtaagacatcttataccagtttatttatttatttattatttataattgctgttattttttgagatggagttttgctcttggtgcccaggctggagtgcaatgatgtgatatcggctcaccgcaacgtctgcctcctgggttcaagtaattctcctgcctcagcctcccgagtagctgggattacaggcttgcgccaccacgcccagctaattttgtatttttagtagagacgggggtttctccatgttggtcaggctggtctcgaactcctgacctcaggtgatctgcctgcctcggcctcccaaagtgctgggattacaggcgtgagccactgcgcctggccaccagtttattttaagctgataaaaacttaattatgatcacataaaaagctccacattttattccttcccctctacattttgttttttgatgtcacagtttacatcatattttgtattaatgaacaagttaatgtaactgtagttactttaaatacttttttctttgaattttaaacaaattgaacataagctgggcatggtggctcctggctgtaatcccagcactttgggagactgaggtaggtagaatgcctcagcccaggagttcaagaccagcctgggcaacatggcaaaacctcctctctacaaaaaaaaaaataataataataataaataaataaaagaatataacactttacatatgtatggggtccatgtaactgtttgttacgtatgtagaatgtgtaatgataaagtcggggtatttggggtatccatcaccttgagtatttatcatttctatatgttggaaacatttcaagtcttctcttctagctatctgaaattgttgcctgactctgctattgaacattagaacttattccttccaactatatatttgtaaccattaaccaacctccccttttctcccctctcccacccacacacctttcctagattctggtattatcattctattttctacctccatgagatccacatttttagctcccacttctgagtgagaacatatgatatttgtctttctatgcctggcttcacttaacataatgacctccagttccatccatgttattgcaaatgactgtatctcattcttcttctttttttttttttttccaagacagggtctcacgctggttgcccaggctggagtacagtgatgcagtcttggctcactgtggcctcaactttccgggctcagatgattctcccatctcagcctcccgagtagctgggaccacaggcgtgcaccaccacgcctggctaaatttttctatttttagtagagacagggtttcacaatgttgcccaggttggtctcgaactcctggactcaaacaatccacccacctcggccccccaaagtgctgggattacaggcatggatcttattctttttatggctgaatagtactctgttgtgtatatgtaccacattttcttcatccattcatctgttgatggacacttaggttgattacatattttttctattgtgaatagtgctgcaacaaacatgcaagtttaagtatccctttgatatactaatttcctttccttcagataaatacccagtagtgggattgctatatcatatatagttctattataagtttgttttttttttttctgagaaatctccacgctcttctccatagtgcttgtactaatttacattctcatcaacagtgcataagaattcccttttctctgcatccttgccaccatccattaacttttgtctttttaataataggcattctgactgggtggggtaagatgatattgcattgtggttttgatttgcatttccctcatgattagtgatattgaaaatttgttcatatacttgtttggccatttgtatgcctttttttttttgagacggagtctcgctctgtcacccaggttgcagtgcagtggcgtgatctcggctcactgcaaccttcacctcctgggttcaggcgattctcctgcctcagcctcctgagtagctgggatcacaggcgtgcatcaccacacccagctaatttttgtatttttagtagagatggggtttcaccgtgctgggcaggctggtctcaaactcctcgattacaggagtgagccaccgcacccagccttgtatgtcttcttttgaataatgtctgttcatgtcctttacctcactttttaatgagattttttttaattgttgaggtgtttgaatatgttgtatattccagatattagtcccttgtagaatgaatagtttgcaaatatttttgtcctattcaacaggttgtctctttaatttgttattgtttcttttgctgtgtagaagccttttaatttaatatggtaccatttgtctattcgtgtttttgttgtctttttgaggttgtagccatatcatctttgcctagaccaatgtcctgaagcattttccctatgttttcttctagtagttttatagttttaggtcttacatttaagtctttaatctatcttgggttgatttttgtatatggtgagagacaggggttcaatttttttctcctgcatatggatatctaattttcctagcaccatttattgaagagaccaatttatgttcttgattgctttgtcaaaaattagttggctgtaaatatgtggagttatttctggattatctgttttgttccattggtctatgtgttgtttttataccaatatcatgttgttttggttaatacaggtttgtaatatattttgagtcaggtaatatgatgctgccagctttgtttgttgttgttgttgttgtttttgctcaggattgctttggctattcaagttcttttttaggattattttttctaattctgtgaaaaatgacattggtattttgatagggattgcattaaatctgattactttggacagtttggtcactttaataatatacactcttctgacccatgaacatgggatatcttttttttaaatgtttcctttaaactctttcaccagtgctttttagttctacttgtagagaactttcacctccttgattaaatttattactaggcattttttgtagctgttttaaatggggtatttttcttgatttctttctcagctagttcattaatgttgtatagaaatgctgctgatttttgtatgttgattttgtattctgcaagtttaccaaagttatttattagatctaggagttttttatggagtcttgaggtttttctagacataagatcatatcatcagcaaggacttcctcttttccagttcggatgccttttatttttttcttttgcctgattgctctggctacaacttccagtactattttgaataggagtggtgatagtggacgttcttgttttgttccagttgttggaagaaaagcttccagttttttttttttttttatgatgttagctgtgggtttgtcaaatatggcctttatcacattgaggtacatttattctttgtagtttgtgcttcactcccacccgagccctggtgctgctgggccccaggacagtgcgcagtctgttgtgggctgggctttcaaaatgatatcttgctgtatctgctcctgatttaggagtgtgggacccagccaagttccctgtctggaacagtgctgttgtgtggtttctaggcagctctctatgttattttcagggcctacaagggtctaggggcgttcctgtggctaggattgcaagagtccacaatggggatgtggtccatttggggtctctcactctttctctgcattggggagtctctctctcagctcgcagccaatcttggccaagcaagctgcctcacctccgtctccttttttgctttaggtttttcctgtaacttctctgttgaatttcagtgttctctcttggatgatctattgaagtattattatgtactattttggttcttattagtggaggaggtgagtatgagatgcctttagttagccatcttgaagctccttatcttttaactttcatagtatagttaaaagtgatttatgtaccaccattacaatattagaatattgtgagtttgagtatattcttacctttatggtgagttttatacatttatatgttttcatattgtttgttagcatccttttcttttattaataacttgaggaactctcttcatcattttttgtgggacagtggtgatgaactcccacagctttttgtttgtctgggaaataatttcttctttatttttgaaacatagctttactgactatattacaatattcttctaggcagttttttttctttcagcatgtagaatgtatcattcccaaccccttttggcctgcaaggtttctgccgagaaatctggtgatagtcttatggatagtcttatggagattgccttttatataagtcacttttctcttattactttcatgattctccctttttttttgacttttattaatttggttatattatgtcttagtgaagatctctttacattaaatttatttggctttctttgggcttcatggtctggatgttctctttgttgtccagattgcggaagttttctgtcattcccttatttaactaagctgtctgaccctttctctttctatatcctttttatgaatcctcctgggattcctatagtgttttttttgttgttgttgttgcttgtttgttttcctttatggagtcccataaattccataggctttcttcactctttttcattctttttttgtccctctgattgggtaatttcaaatggcctgtctttgagtttgctgattattctgcttcagagagtcttctgttgaagctctctgtatggccgtttttagtttcatcattgtattgtcctgctccaaaatttctgtttcattcttttttatgtttcttgtttttgaacctcttcttattttgcttatatattttctggttttgtttagttgtctgtgttcgcttgtaattaactgagctcctttaaggtgattattttgaattctttttcaggcagtttatagatactcatttctttagaattggtgactggtgctttaatttattcctttggtggtgtcgtttccttgattattatttaaaaagaatttttttaaacaaggtctcactctgtcaccaggctgcagtgcagtgttgtgatcacgactcactgcagcctcaacctcctaggcccaaagaatcttcccacctcagcctcccatatctgctgggaccacaggtgtgcgtcaccatgcctgactaatttttaaatttttgtatagatggggcctccctaagttgcccaggctggtcttgaattcctgaactaaagtgatcctcccaccacagcctcccaaagtgctgggattataggtatgagccaccacacctggccttgattattttttatctttgtggccttgagttggtatctgcacatttaaacaaataggcacactttttcaatatttacagacttgcttcagcagggaaagccctttaccagtctgcctgtctagtgattctgggtgggtcatctcatgaagaccatgggcaaattttctgctggagttctcaggtatgctgacctagtgcctgtgtctgcatggccagcctggaatctgggtttgtgtggtccatcctggcactgaggcaggccatgaacttgggtaagaggccagcataaagcttcgtgccatgaggactgatctagcactgaggctaatgtggtcagtctcctgttgggataagcctagagcctggggctatgggggtgggtccataactgggacacgcctggaggctgggttcatgaggcaagcctggagctttgggcaataggagctaacttggcgctggggcaggcttgaagtctgggtccatagtggtgggcctaagacctcctattttctagttatggtaaattaaatgtagggaacagtcaaaatggaagagttccagacatagatacagtaaaaatatagtttaaaacttctttgcttattaaaaaagttatttgtggttgtcataaaatcttaagcatcacaaaaatatgtattatggattgtaaagtgagcatctattccatactcaaaaacagaatcattgaaatggatttggaagatttaaggagttttttttaagtttttttcaaaatagattgcatttaaaaaagattaatggaatgaagtaaagccaaagagtatacacaggaaaatttgtaattggtgatctcctgttatattagagacaatgagataaattggtaaaataacagaagacatttgaattggacaacatccaagagagttggataaaaccctgaagatgttctgtaaaaaataatataacattgaccataataaatgagatttaatgacattacttctttgacttataggttagagactaggtccttatgcttataaattcttgaagaagagagttctttgtaggttaacaaaaatgagagtatttctcaatgcagagaaagggagctctgtgctgcttttctcccaatagggatacaaccagatcatagttttttcagcatccttcttttatggttacagtttatattatctttttttaaacaaacacgtaaatttattgctgctagattttggggatgttagtaaacgattgtgtaggcagtatgttaggggaggagtaaatttttgagatccttttccagcaccatttaaaattatctatatactaatctgaaacctgtctctgttggtaagtaatgtgagttgctttctattggtcaggaatagttttttttcttgacggaatatctctgagtttggagggaagtgtgtctcttttctgcctgtataaaacttattgtatacctctttgagttaaaagaaaaacccagcaaaaaatatactgttgctttctaaattcatagtgcttaggtttggtaaacctagattacgtaatttctttttttttattttaaatttgtatttgtacataacaggtatacatcttttcagggaacatgtgataatttaatatatttatatactttgtaaaacatcaaatcaatgtaattgggatatatatccatgaacttaaatatttgtcttttttttcttttattattatactttaagttttagggtacatgtgcacattgtgcaggttagttacatatgtatacatgtgccatgctggtgcgctgcacccactaactcatcatctagcattaggtatatctcccaatgctatccctcccctctcccagattatgtaatttctatactgcatttaaaagaactattatatttaccctaaggatagtatttaaataggggatatgtttatttattattgttttgcctttactatatttaggtaggaatatatatcaccagaggtcttatattgagaaataaaggaaataacaaagaaattataaatgtatttacgtgcacaaatattgatgttccatcccacaaggccaaaggacgtttgtaccagttttaatgtacttaatgttcattcctttattttcccttctcttctcagcctgaggccctgagaatctgacattattaggcaatgtgatctaagggaaggtctcagagctggcagaaaatttgttaatgataaactgtgaccttgaatcactcagttaactactatgtaccacaatatcctcacctgaaaaataggtgcaatattatgtgtgtcacaggcatggaatgaggataacagaagaaatatagtagttctttgaaaagctaagggtttacatatacggtgataaaattattaactaaaaatcagcctatacaaggcttatttttaatggaaaggtaggtattagcaccatctagtggaaacataatgaattgtataatagcattttcaatacggaaaataatttaatatagataactctttagagctggaagaaatcttacagatcacctatttagtaatttagagattatgttctgtggtgtccttatattctaccagaagagcctcaggacctcctttaagagaaagaagagtcttttccacaattctcagattctcatgttgcttcaaatagagaagttaggctttaatcagttttttatatatgtccttgtaagattttgtttgaaaaaatgattcaccttcttagaaaatgtttgaaaatgactgatttagattaactcatctttgtacagataaggaaatctaaatttagggagcttgagacttgtttgagggcacatagttggaacaatagatctctagtcttttaggaatagtttttctctaaaggtcagtagtgatgtcctttcttttattcttgattgtagtaatttgagccttctctcttcttttcttggtcagtgttgctaaaggtgtccattttttgatatattgaaagcataaacttttgagtttgttgatttttctctattgttttttagtgatcaatttcatttatttccattgtaatctataatttcccccctctgtgcttgatttatgcttagtttgctcttccttttcccttttcctaaggtgaaaggttagcatattgatttgagatcttttaaaaattactgatgtttatagctatacattttcctttaactgttgctttagttgtacctcctaagttttggtgtgtgcattttcctttttgttcatctcaaggtattttctaattccccttgtaatttattctttgacccatttggttatgtagacgtgtgttgttagattttcacacttggtaatttcctcatttcttttttgttcttgatttctaatttaattcaatgtagacaaggaactgttaaatctactatggccttttatggcctaggatatgttctattctgaagaatgttctatgtgcaattaagaatttatagtctgctattattgggtggattgttgatatggtttggctctgtgtctccacccaactctcatctcgaattgtaatccccacatgtcaagagagagacctggtgggaggtgattggatcatggggctggtttcctccatgctgttctcatgatagtgagttctcatgagatctgatggttttatcaggggctcttccccctttgccctctctctcttgcctgctgccatgtaacatgtacctgcttctatttctgccatgactgtatgtttcccgaggcctccccagtcatgtggaactgtgagtcaattaaacctcttttctttataaattaccctgtcttagacagttctttatggcagtgtgaaaatggactaattcaagtgcgctaccgatgtctattaggtctagtagatttatagtgttcttcaagtcttatatatactttttgatgttctgtctagttgttccatctattattattaattattttggctagatattttatttatttttaatttttgtgggtacatattaggtatacatatttatgggatacatgagatgcttcaatacaggcatgcaatgtgaaataatcacatcatggaaaatgggctatctatgccttcgagcatttatcctttgtgttacaaacaatccaattatactattttagttattttaaaatgttcagttgagttcttcttgactatactctccctgttgcgctatcaaatagtaggttttattccttcttttaaactattttttataaccattaatcatcctcacctcccctcaccaaaccacccccaaaccctttccagcctctggtaaccatccttctactctctgtgtccatgtgttcaattgctttgatttttaggtcccacaaataagtgagaacatgtgatgtttgtctttccgtgcctggcttatttcacttaacataatgatctccagattcatttatgttgttgcaaatgacagaatctcactcttttttatggctaaataagactccactgtataaatgtaccacatttctttatccattcatctatccgtggatacttaggttgtttccaaatcttggctattgtgaacagtgctgcaacaaacataggagtgcagatatctcttcaatatactgatttcctttcttctgggtatataaccagcagtggggttgctggatcatatggtagctcaatttttagttttttgaggaaactccaaactgttctccatagtggttgtactaatttacatccctgccaacattgtgcaagggttcccttttctccaccccttttctccacaccctcaccagcatttgttattgcctgtcttttggatataagccattttaactgagtggagatgatatctcattgtagttttgatttgcattgttctgatgatcaatgacgttgagcatctttcatgtgtctgcctgccatttgtgtgtcttctgtgagaaatgtctaaatcgtttcctcattttttgattggatcatcagattttcccctgtagagttatttaagcttcttatatattctgctcattaaccccttattagatgggtaatttgcacacattttcttcagttctgtgggtcgtctcttcattttgtttattgcttcctttgctgtgcagaagattttaaacttgatgtgatcccagttgtccatttttgcttttgtgtcagtgcttgtggggtattacttaagaaatctttgcccagactgatgttatagagattttctccaatgttttcttgtagtagtttcatagtttgaggagttagatttaagtctttaatctatttttatttgatttttgtatatgatgagagataggggtctagtttcattcttctgcatattggattccccagcaccatttcttcaagactctttcttttctccagtgtatgtgcttgacactcaaaatgagttcactgttaggtgtgtggatttgtttctgggatctctattctgttccattggtctatgtgtctgttttcatgccagtaccatgctattttggttactatagctctttagtataattggtagtcaggtagtgtgattcctccagatttgttcttttcgcttaggatagctttgactattctgggtgttttgtggttccatatacatttcaggattttttttttctatttctatgaagaatgtcattggtattttgatagggattgcagcaaatctgtagattgctttgggtagtatggacatgttaacagtattggttcttccaattcattaacatgtaatatctttccactttttggtgtcctctttaatttctttctttctttctttttctgagatggagcttctttcttttttttttctttttttgagacagagtcttgctctgtcacccaggctggagtgtagtggcgcaatctcagctcactgcaacttctaccacctgggttcaagtgattcttctgccacagcctcccaagtagctgagattacaggcacgcaccaccatgcccagctaagttttatatttttagtagagccagggtttcaccatgttggccaggttgttctggaactcctgacttcaagtgatctgccttcctcagcctcccaaagtgctgggattacaggtgtgagacaccatgcccggtcctcttcaatttatttcatcagtgttttatagttgtcattatagggatctttcacttctttggttaattcatagatgtttaattttatttgtggctattgtaaataggattacttcttttatatctttttcacattgttcactcttggcttatagaaatgctactgatttttatatgttgattttgtatcctgcaactttactgaacttttaaatcagttttaatagtttttggtgtagtctttaggtttttccaaatgtgacattatatcttctgcaagcaaagataatttgacttctttttttccaaagtggatgttcgtcatttcttcttttctgattgctttagctaagacttccagtagtatgttgaataatagtgatgacagtgggcatccttgttgtgttccagatcttagaggaaaggctttcagttcttccccattccttatgatactagctgtgggtctgttatatatggcttttattatgttaagttatgttccttgtatccccagtttttttgagggtttatatcatgaagggatgttggattttctcaaatgctttttcagcatcaattgaaatgatcatatggtttttatccttcattctgttgatatgatgtatcacattgattgatttgtatatgttgaacgatgtttgcatcccaagggtggatcacacttggtcatgatgatctttttaatatattgggcttgttgttgttgttgttttgagacaaagtcttgctctgtcacccaggctggagtgctggagtgcagtggcatgatctccattcactgcaacctctgcttcctgagttcaagtgattctcgtgcctcagccacccgagtagctgggattacaggcttgtgccaccacgcccagctaatttctgtggttttagtagagatggggtttcaccatgttggccaggctagtctcgaactcctggccttaagtgattcgcctgcctcggcctcccaaactgctgggattacaggtgtgagccaccgcactcggccatatattgctgaatttgatttgctaatattttgtcgaggatttttgcatcaatattcatcagatatattggcctgtagttttctttttttgatgcatctttatctggttggtatcagggtaatactggcctcgtagaatgagtttggatatattccctcctcctctatttttcagaacagtttgagtaggattagtattagttctttaaatattttatagaattcagcagtaaagtcattgggtccccagcttttctttactgggagactttttattatagctttgatctcattacttgttgttggtgtgttcaggttttggatttctttatgcttcaaacttggtaggttgtttgcttctagaaattttttcatttctttaaatttttcaattaattggcatatagctgttcatagtggccactaattatcctttgaatttttgtggtatcagttgtgtctcctctttgatctgtgattttaatatttgtatcttctgtatttttttcttagatagtctggctaaagttttgtcaattttgtttaacttttcaaaaaaccgcatttttgtttcattgaacttatgtgttattttctttatttcaattttatttatttctgctctgacctgtattatttcttttcttctgctaattttgggtttggtttgttcttgcttttctagtccttaaaggtgtattgttaggttgtttatttgaaaattttcttcttttttgatgtagggagttatagctataaacttccctcttagcatttcttttgctgtattccatacattttggtatgtgatgtttccattatttgtttccagaaaattttcagctttcttcttaatttcttcattgacccacggtcactcaggagcatattgtttaattttcatgtatttgtatagtttccaaaattcttgttgttgttggtttctaattttattccattgtggtcagagatgcttggtattattttgaatttttgcgtgtttacaacttgttttgtgacctaacatttggtctgtctttgagaatgatccatgtgctgaggaaaagaatgtgtattctgcagctgttggatgaaatgttctgtaaatatccattagatccatatgttctatagtgcaaattaagtctgatgcttctttttgattttctgtctggaagatctgtccaatgccgaaagtggggtgttgacatctacagctattattgtatgaagtctatgtttctctttatctctgataatatttgctttatatatctgggtgctccagtgttgggtgcatatatatttaaaattgttatatcctcttgtggaattgttccctttatcgttatatagtgaccttctttgtctcttcttatagtttttgtcttgacacctattttgtgtgatataaatatcagcactcctgctcttttttggtgtccattggcatgagatatttctgccacccaccactataactattttttttaattttttattttatttcaatagttttttttttcgaacaggtagtttttggttacatgagcaagttctttagtgttttttctgagattttggcatacccgacacctaagcagtgtacactgtacccaatatgtaattttttatccctaagcccccttccatcttcctccatctgagtccccaaagtccatcatatcattcttatgtttttgcatcctcatagtttaactcccacttataagtgagaagatacgagacttggttttccattcctgagtcacttcacttagaataatggcctccaagtccatccaagttgctgcaaaggccattattttgttctgttttatggctgggtagtattctatggtgtatatacattttctttatccactcattggttgatggtcatttaggttggctccatattttttgctattgtgaattgtgctgctataaaaatgtgtatgtgttttttcgtatgatttattttcctttgggtatatacccagtagtgggattgctggatcgaatggtagttctaattttagatttttgttttgctttgttttttgttttgagacaaggtctggctctgtcttccaggctggagtgcagtggtacgatcttggctcactgcaacctgtgcctcccaggctcaagccatcctcccacctcagcctcctgagttgctgggagtacaggcacacaccaccacacttggctaatttttgtattttttgtagagatgggatttttccatgttgctcaggctggtctcggactcctgagctcaagtgatctgccccctcagcctcccaaagtgctgggattacaggcatgagccatcatgcctggccctcattttaattctttaaggcagcagtccccaacctttttggcaccagggaccagtttcgtggaagacagtttttccatggagcggcggtgggggatcgggggtggggaatggtttctggatgaaactctttcatctcagatcattaagtattagatccttataaggagtgtgcagcctagatcccttgcatgcgcagttcacaatagggttcgtgctcctatgataatctaatgctgctgctgatctgccagaaggtggagctcaggcaggaatgctcacttgccccgccactcatctcctgctgtgcagcccggttcctgctttaggagcttcgaccccctgcttttaaacgtttttttcctgtttatatcttattgtactgtctgtgtcttgaaaagttgttgtagttattatttttgattggttcgttatttagtctttctacttaagataaaagtagtttgcacaccacagttacagtgtcataatattctgtgtttttctgtgtacttatattaccagtgagttttgtatcttcaagtgattacttactgctcacgaacatccttttctttctgattgaagtactctcttcagcatttcttgcaggacaggtctggtgttcatgaaattcctcagcttttgtttgtctgggaaagttttcatttctccttcatgtttaaaggatatttttgctggatatactattttaggataaaagttcttttccttcaacagtttaaatacatcatgctactgtctcctggcctgtaaggtttccattgaaaagtctgcttgatgtattggagctccattgtatgttgtttttttcttttctcttactgcttttaagatcctttctttatcattgggctttaggagtttgatttttaaatacttgaggtagcgttctttgggttaaatctggtgttctataactgctttgtatttggatattgatatctccttctaggtttgggaagttctctattattatccctttgaataaactttctttctttttttattatgctttaagttctaagggtacatgtgaacaacatgcaggtttgttacataggtatacatatgccatgttggtttgctgcacccatcaactagtcatttacattaggtatttctcttaatgctattgtgtgatgttccccaccctgtgtccatgtgttctcattgatcaactcccacttatgagtgagaacatgcggtgtttggttttctgtccttgtgatagtttgctgagaatgatggtatccagcttcatccatgtccctacaaaggacatgaactcatccttttttatggctgcatagtgttccatggtgtatatgtgccacattttcttaatccagtctatcattgatggacatttgggttggttccaagtctttgctattgtaaatggtgccacaataaacatatgtgtgcatgtgtctttatagtagcgtgatttataatcctttgggtatatacccactaatgggatggctgggtcaaatggtatttctagttctagatccttgaggaatcgccacactgtcttccacaatggttgaactagtttacactcctagtaacagtgtaaaagcgttcctatttctccatatcctctccagcatctgttgtttcctgaccttttagtgatcaccattctaactggtgtgagatggcatctcattgtggtttcgatttgcatttctctgatggccagtgatgatgagcatgttttcatatgtctgttcgctgcataaatgttttcttttgagaagtgtctgttcatatcctttgcctactttttcatggggttgttgctgtttttcttgtaaatttgtttaagttctttgtagattctggacattagccctttgtcagatgggtagattgcaaaaattttctcccattctgtaggctgcctgttcactctgatgatagtatcttctgccgtgcagaagctctttagttcaattagatcccatttgtcaatttttgcttttgttgccattgcttttggtgttttagtcatgaagtctttgcgcatgcctatgtcctgaatggtattgcctaggttttcttctagggtttttatggttttaggtcttacgtttaagtctttaatccatcttgagttaatttttctataagctataaggaagggatccagtttcagctttctacatatggctagccagttttcccagcaccaattattaaatagggaatcctttccccattgcttgtttttgtcaggtttgtcaaagatcagatggttgtagatgtgtggtgtctgaagcctctgttctgttccattggtctatatctctgttttggtaccagtatcatgctgttttggttattgtggccttgtaatatagtttgaagtcaggtagcatgatgcctgcagctttgttctttttgcttaggattgtcttggtaatgtgggctcttttttggttccatataaactttaaagtagttttttccaattctgtgaagaaagtcattggtagcttgatggggatggcattgaatctataaattaccttggcagtatggctattttcatgatattgattattcctatccatgagcatggaatgttcttccatttgtttgtgtcctcttttatttccttgagcagtggtttgtagttctccttgaagaggtccttcacatcccttgttagttggattcttaggtattttattctctttgtagtaattgtgaatgggagttcactcatgatttggctctctgtttgtctgtacttggtgtataagaatgcttgtgatttttgcacattgattttatatcctgagacttggctgaagttgtttatcagtttaaggagatttagggctgagaggatggggttttctaaatatacaatcatgtcatctgcaaacagcgacaatttgacttcctcttttcctaattgaatactctttatttctttctcttgcctgattgtcctggccagaacttccaacattatgttgaataggagtggtgagagagggcatccttgtcttgtgccggttttcaaagggaatgcttccagtttttgcccattcaatatgatattggctgtgggttcgtcataaatagctcttattattttgagatatgttccatcaatacctagtttattgagaatttttagcatgaagggctgttgaattttgtcaaaggccttttctgcatttattgagataatcatatggtttttgttgttggttctgtttatgtgatggattacatttattgatttgcatgaaccagccttgcatcccaggggtgaagctgacttggtcctgattgataagctttttgatgtgctgctggatttggtttgccagtattttattgaggattttcgcatcgatgttcagcagggctattggtctaaaattctgtttttttgttgtgtccctgccaggctttggtgtcagtatgatgttggcctcataaaatgagttagggaggagtccctctttttctattgattggaatagtttcagagggaatggtaccagctcctctttgtacctctgatagaatttggctgtgagtccgtctggtcctggactttttttggttggtaggctatattaattattgcctcaattttggaacctgttattggtctattcagaaattcaacttcttcctggtttagtcttgggagggtttatgtgtccaggaatttatcatttcttctagattttctagtatatttgtgtagaggtgtttatagtattctctgatggtagtttgtatttctgtgggatcagtggtgatgtcccctttatcattttttattgtgtctatttgattcttctttcttttcttctttattagtcttgctagcagtctatctattttgttgattttcaagaaaccagctcctggattcattgattttttgaagggttttttgtgtctctgtttccttcagttctgctctgatcttagttatttcttgccttctgctagcttttgaatttgtttgcacttgcttctctagttctttcaattgtgatgttagggtgtcaattttagatctttcttgctttttcttgtgggcatttagtgctataaatttccctcttcacactgctttaaatgtgtcccagagattctggtgtattgtgtctttgtcttattggtttcaaagaacatctttatttctgccttcattttgttatttacccagtagtcattcaggagcaggttgttcagtttccatgtagttgtgtgttttgagtgagtttcttcatcctgagttctaatttgattgcactgtggtctgagagactgttgtgatttcttttcttttgtgtttgctgaagagtgttgtacttccaatgatgtggtcaattttagaataagtgcgatgtggtgctgagaagaatgtatattctgttgatttggggtggagagttctgtagatgtccattaggcctgtttggtccagagctgagttcaagtcccgaatatccttgttaactttctgtcatgttgatctgtctaatattgacagtgggttgttaaagtctcccattattattgtgtgggagtctaagtctctttgtaggtctctaaggacttgctttatgaatctgggtgctgctgtattgggtgcatatatatttaggatagttagctcttcttgttgaactgatccttttaccattatgtaatggccttatttgtctcttttgatctttgttggtttgaagtgtgttttatcagagactaggattgcaacccctgcttttttttctgctttccatttgcttggtaaatcttcctccatccctttattttgagcctatgtttgtctcagcacgtgagatgggtctcctgaatacagcacaatgatgggtcttgactctttatccaatttgccagtctgtgtcttttaattggggtattcagctcatttacatttaaggttcatattgttatgagtgaatttgatcctgtcattatgatgttagctggttattttgcctgttaattgatgcagttttttcctagcatagacggtctttacaatttggcatgtttttgcagtggctggtaccggttgttcctttccatgtttagtgcttccttcaggagctcttataagacaggcctggtggtgacaaaatgtctcagcatttacttgtctgtaaaagattttatttctccttcacttatgaagcttagtttggctggatatgaaattctgggttgaaaattcttctctttaaaaatgtttaatattggctgtcactgtcttctggcttgtagggtttgtgctgagagatccgctattagtctgatgggcttccctttgtgggtaacctgacctttctttctggctgcccttaatgtttttttccttcatttcaaccttggtgaatctgacaattgtgtgtcttggggttgctcttctcaacgagtatctttgtggtattctctgtatttcctgaatttgaatgttgacctgccttgctaggttggggaaggtctcctggataatatcctgaagagtgttttctaacttggatccattctccccgtcagtttcaggaacaccagtcaaacgtagatttggtcttttcacatagtcccatatttcttggagaatttgtccgtttcttttcactcttttctctctaactttgttttctcactttatttcattaatttgatcttcaatcactgttatcgttccttccacttgattgaatcagctatcaaagcttgtgcatgtgtaatgaagttttcgtgctgtggttttcagctccatcagctaatttaaggtcttctctacactgtttattctggttagccagttgtctaaccttttttcaaggcttttagcttccttgcgatgggttagaacatgctcctttagcttggagaaatttgttattaccaaccttctgaagcctacttctgtcaacttgtcaaactctttctccatccagttttgttcctttgctggtgagaagctccaatcctttggaggagaagaggcactctggtttttggaattttcagcttttctgctctggtttctccccatctttgtggttttatctacctttggtctttgatgttggtgacctacagatggggttttggcgtagatgtcctttttgttgatgttggtgctattcctttctgttagttttccttctaacagtcgagcccctcagctgcaggtctgttggagtttgctggaggtccactccagaccctgtttgcctgggatcaccagtggaggctgcagaatagcaaatattgctgcttgatccttcctctggaagctttgtcccagaggggcacccacctgtatgaggtgtctgttagcccctactgggaggtgtctcccagtcaggctacacagggatctgggacccacttgaggaggcagtctgcccgttctctgaacctgaacaccatgctgggagaaccactgctctcttcagagctgtcagacagggacgtttaggtctgccaaagctatctgctgccttttgttctgctatgccctgcccacaaaggtggaatctacagcaaggcagtaggccttgctgagctgcagtgggctccgcccagttcgagcttcctggcctctttgttttcacggtgagcacaaaaccgcctactcaagcctcagcaatggcaacacccctccccccgccaagctgctgagccgcaggttgatcttagatgctgcgctagcagtgagcaaggctccttgggcatgggacccgccgagccaagcacgggagggaacttcctggtctgccggttgtgaagactgtaggaaaagcacagtatttgggcaggagtataccattcctccaggtacagactgtcatggcttcccttggctaggaaaggaaagtccccagaccccttgtgcttcccggttgaggcgatgcactgccctgctttggttcgccctccgtgggctgcatccactgtccaaccagtctcaatgagataaaccaggtacctcagttggaaatgcagaaatcactcatcttctgcatcaatcttgctgggagctgcagactggagctgtttttactcagccatcttggaagcctccccactttgaataaactttctaatcttatctctttctctgcttcttctttaaggccaatgatacttagatttgcccttttgaggctattttctagatcttgtaggtctgcttcattgttttttattcttttctcttttgtctcctctgaccgtatattttcaaatagcccgtcttcaagctcactaattctttcttctacttgatcaattctgctatttaaagattctgatgcagtcttgttcattatgccaattgcagtttacaactccagaatttctgcacagctccagaatttctgctttattcttttaatttcaaataaatttgtctgttaaaacttaacaaaaacttgttaagtttatctgataggattctgaatcccttctctgtgttatcttgaatttcttcgagtttcctcaaaacagctattttcaattccctgtctgaaaggtcacatgtctctgtttctccaggattggtttctggtgcattttacttgatgtggccatgtattcccggattgtcttgatacttgtagatgttcttcagtgtctgggcattttagtgttaggtatttattttagacttcacagtcttggcttgtttgtatccacccttcttgggaaggctttccccatgttcagaaggacttgagtgttgtgatctgagctatatctgttttagggggcatcccaagcccactaatgctctggttcttgtagacatatagaggtactaccttgatggtcttgggcaaaatctgggagaattctctggattaccaagcagaggctcttgttttcttcccttactttctcctaaacagagtctctctctctctctctctttctctctttctctctttctctctctctctctctcctgagctacctgaaacttggggtttagtgacacaagcactaccactttgactgtgctgggtcatacttgaagccagcacagcactgggtctcacccaaggtttgctgtaaccactctctacctaccacctatgtttgctcaagactgtggggctctatagtcagtaggtagcaaagccagccaggcctgtgttcttcccttcagggcagtgagttcccccacaccacagaagagtacagaagtgccatttgggagccagggactagagtcagaaaccttagatatttacccagtgctctattatattttactgtgactgagctgtcagttaaaccacaagatgcaatccctcccactcttccctccccctttccaaaggcagaggaacctcaccttgtggcaactgccatcccaggccacaaggagtactgcctgactactgctgaccactgtttccttaaggcccaagggctcttcagtcagcttttggtgaatgctgcctggtctgggactcacccttcacagcacccggctcccttctcactcacggtccagaaatgccattcaagagccaatcctggaattggggaccctaagagcttgcttggtgctctacttccctgtggctgagctggtacctaagatgcaagacacagtcccctttacgtttccctctatttttctgaagcagaagggcctctccctgaagccaccacagctgggaatgtgctgagtctcacctgaagtcagcaagtctcagggtctcacccgaagtcctcgacgtaggacctgactatcactgctggttattcagggcccaagggctctttggttagcagatgatgaatgattctagaactaggtcctttccttcaagagagggttctcttctggcccagggtttgtgcagaaatgtccgggagctaggacctggagaggaggcctcacaaccctaacccttgtcctatcctgctgtggttgagctggtattcgaagtgcaagacacagtcccctttatttttccccctgtttttctcaagcaaaaggagtttcgcctcatatccaccacagctagtaatgcactgagtctcacctgaagccagccagtctgaggctcacttaatgcccttgatgtagtacctgggtgtcactgttggttattcagggcccaaggactctttgttagcaggtgatgaatgatgccagaactgggtccttcccttcaaggtagtgggttccctgctggcccaggatttgtttagaaaaatgttcaggagctaggatctgaaagggggcctcacaaccctgacccaggccctatcctactgtagctgagctggtatccaagatgcaagacaaagttctccccactcttcgattttctctccttaaatggaaggaaggggtctcttttggagtcttgttgagctgtgcagcctggggttaggagagaggtgatatcagcactctctagccaccctggctggtgtctcagtagtttgcacgccctccccgcccccctcgccgcccaccccccccacccaaattccggtgactctgggcttagttcagcactaggactctcttaggagttgcagtctttgtggcctaggctgcctttaaagttcatttaccgacccacagtactttagcccacggtggcggggcttgtgggatctcaaggtctgactgctaggatcagcaattccattctgactcgggctggtttaaacaccccctccacgggcaggcgtcagctgagattggtcctgcttttctttctgctataatggagcagcagtgagttcaatgcctcataattgttgtgctctccttcccccagcatacagcaatgctctttgcaccaccgccactgccaggggacgggaaaagggtggcttctgcgattcaagactgtttttctacctctttagtgcctcttttagcaatatgaagttaaaaccaggtactgtgagtttccacctgatttctggttcttaggaaggtgatttttttgtgtagatagttgttaaattggtgtctttgcagcaggagggacgattggtggagccttctattccatcatcttgttccacctctggaattgctgatcttaggtgaatattttatagtatactattttaatttttgtaacattttttggattacgttttcttgtctttttcttttctttttttttttttttttttttgagacagagtatcgctctgtcacccaggctgggatgcagtggtgccatctcggctcactgcaatctccgccccccgggttcaagcaattctcttgcctcagcctcccgaacagctgggattacaggcctgtgccaccacgcccggctaatttttgtatttttggtagagaaggggtttctccatgctggccaagctggtctccaactcctgacttcaggtgataaaagctttactacttcatagctttattctcttttcttttttggtgattattattatacttactatgtctatatatgtttaaaaactcaagtatgcatggttataattattgctttgcaaaatcttatgtattttaaagaagatgagacataaaacagaacacaaacatatttattgtgtttttaaattttcaaccttcttataacttttggttcacttcatttcttcttttagatttgaactaccatctggtgtaatttcctgaatttctttcccacccaatctgctcttttgtgttaatcgttatcgaatatattacaaatgttatgccccagtaatacaccttaagaatttttttacacagttgctttttaaataaattaagaaaggaaagtagaagacatatataatcatactttcttttataattacctccataattactagccctgtttattttttcatatgaattcaaattattctctagtgtcacttgctttcagcatgaagaacctccttttgtatttcttataagacagattggctaacaagaaattctctcactttttgcttacctgggaatgtatttatttactcttaattttgaaagatagcttttctagatataagattctaatttcacagatttttttttcttttttttgtttattatactttaagttttagggtacaagtgcacagcatgcaggttagttacatatgtatacatgtgccatgttggtgtgctgcacacagtaactcgtcatttaacattaggtatatctcctaatgctatccctcccccctccccccaccccacaacaggccctggtgtgtgatgctccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcgttttttatggttgcatagtattccatggtgtatatgtgccacattttcttaatccagtctatcattgttggacatttgggttggttccatatctttgctattgtgaatagtgccgcaataaacatacgtgtgcatgtgtctttttatagcagcatggtttataatcctttgggtatatacccagtaatgggagggctaggtcaaatggtatttctagttctagatccttgaggtatcgccacactgtcttccacaatggttgaactagtttacagtcccaccaacagtataaaagtgttcctatttctccacatcctctccagcacctgttgtgtcctgacttttatatatatatatatatatatatatatatatatttttttttttttattatactttaagttttaggatacatgtgcacattgtgcaggttagttacatatgtatacatgtgccatgctggtgcgctgcacccactaactcgtcatctagcattaggtatatctcccaatgctatccctcccccctacccccaccccacagcagtgcccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaaaccagtctatcattgttggacatttgggttggttccaagtctttgctattgtgaataatgccgcaataaacatacgtatgcgtgtctttatagcagcatgatttatagtcctttggctatatacccagtaatgggatggctgggtcaaatggtatttccagttctagatccctgaggaatcaccacactgacttccacaatggttgaactagtttacagtcccaccaacagtgtagaagcgttcctatttctccacatcctctccagcacctgttgtttcctgactttttaatgattgccattctaactggtgtgagatggtatctcattgtggttttgatttgcatttctctgatggccagtgatgatgagcattttttcacgtatcttttggctgcataaatgtcttcttttgagaagtgtctgttcatgtccttcgcccactttttgatggggttgtttgtttttttcttgtaaatttgcttgagttctttgtagattctggatattagccctttgtcatatgagtaggttgcgaaaattttctcccattttgtaggttgcctgttcactctgatggtagtttcttttgctgtgcagaagctctttagtttaattagatcccatttgataccaaagccaggcagagacacaacaaaaaaagagaattttagacccatatccttgatgaacattgatgcaaaaatcctcgataaaatactggcaaaacaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaacactggaagcattccctttgaaaactggcacaagacagggatgccctctctcaccactcctattcaacatggtgttggaagttctggccagggcaattaggcaggagaaggaaataaaaggtgttcaattaggaaaagaggaagtcaaattttccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattgaaaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcgatatcgtgaaaatggccatactgcccaaggtaatttacagattcaatgccatccccatcaagctaccaatgcctttcttcacagatttggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattacctatttaataaatggtgctgggaaaactggctagccatatgtagaaagctgaaactggatcccttccttacaccttatacaaaaatcaattcaagatggattaaagacttaaatgttagacctaaaaccataaaaaccctaaagaaaacctaggcattaccattcaggacataggcatgggcaaggacttcatgtctaaaacaccaaaagcaatggcaacaaatttcacagatgtttgaatacatcctttttgccttctttactccatgaactctgaggggtgtcagctgttaatcttattgttactcccctttatgtgatgagtcatttttctcttactgttttcaagattttctcttcatctttgatgttcaataattttcgctcatcatgtgtctggatgtagcttttttaatgcttatcctgttgaatttcattgagcttcttggatgtgtcgattattgtttttcatcaaatttggagagttttaagaccatcatttctttgaatatttatttgtccttttctttcttttcttctggtactcccattatgtatatgttggtgtgcttaatggtgtcttacatttttctgagcccatgttcatttttcttcatttttttttctgtttgttcctcagatttgtatcgtttctattgctcttcaggttagtttattgtttcttttgcctgctccaatctgctgaatttttcatttcagttattgtacttttcaactccagaatttccatttgtttcttttttaaaaaataataagcattaggagatatacctaatgtaaataacgagttagtgggtgcagcacaccaacatggcacatgtatacatttgtaacaaacctgcaggttgtgcacatgtaccctagaacttaaagtataataaaaaatatataaaaaaataataatttctatctcttaactgatacactcatattctccatatgatgagtcattgttatcagaccttcctttaatttttaaacacgattttaaaaaattctttggacgtaattataaaagttgctttgaagtctttttctattaagtgcaacattggggcctcctcaaaggaagtttcttttgctttttttcttctgtgtaggtcacactttttaattgtatgtcttacaatgttttgttaaacactagacattttggaaaatatattgtagcaagtctagatacagtttctcctctttctggggcttattgtttttattgtttgtttagtcatttatttgttcagtcacttggctggactaatttggtggaatttattttccacacactgtgtggcctctaatattcctgctcagaatttttccccttgtttttatcttttcatgacttcttatggagtcacccctgcatccacatagttcacttactggctaaaggttgtgctgaagctcacttagccagttagattttttcatcctttcctggatgtatgtttgtttagagactgcttttatagttctgggagagactaattcagtcggggactaatagcttgtagattctttatctgctcatacccaagaaagcagtcttgagcatgtgcacagtctcccagatccctcagtatgaggtcgatttgatttttaagctgggttccctggatcttagcttacctttcagttggtgtttggtcagacgatctgcttaagccccttgagccaatgaggctcaaggtactttgctgatagatctgtttatgccttgggtaatgcttttcagtttgccccaacactttctctgattgtgcgtgagtgggtgcagaatggcacatgggcacagtcttctggacccctagagataagtgtgaccccagaggttttcttcttggctgtttccctgattctctggtaaccttctggttggtctgctgtttcccttattgctaccattatcatggagctaccagctccctcttaattgctcactatcaagatctccattgttttcagcagtgtccttagacatgatcttctccatgctctgttttaaatacatcattcccctcaggaagagatgcagagttcttcctctttgcttctgttctttctttctggtcagaacctctgtgccacacgactagagctgggctcatggcatgcttctcttgaaatggcacccctaccatattagtaaattagtaaattctggcggtatggtagcccttggtcttcttagtgtgcccttttgacatgaaacctctgcctgatgagccagctggagtaaagatgatcaggatctcagtattcttgacctgtcacatttggggtagaatccttaccctaagagtgagagctgagtgggcaaagaaaagccagtcctctccatcgtacttgcccagaacacttccatgacacaggcctgagaatggcaagatagtctggcagcctgcttctctgcaggtgaaaccatagcctaggattttaggagctggcgggagagggaattcctatcttcttggctgcacccatctggagcagcttccatcacatggagccagtatagatgggagcagtttatagttcaaatgccatagactctcactggttatactgagatttagtttattttcatgaataaatgttttccattttctgtgtgcccttaggacaatttcaattttcagagactaagtggttgttttaatgaattttccagatgagtggttgtttcgctggggagagtgtctaaagagctccttatatcaccattgcagaagttccacccctcactggttatttaaaaaagtggaagtataaggttaatgtactaaaggagacctctatgaaatagggcttacaatgactaagccagcattatatctttgttagcaatctgaaaactcagtttggtagttctgggtcatttatagtttatgtttatttatatttatttatttatttcgagacacagtttcactctgtcgcccaggctggagtgcagtggcacagtattggctcactgcgacctccacctcctaggtttaagcgataatcatgcctcagtctcccaagtagctgagattacaggcatgtgccatcactccggctaatttttgtattattagtagagacggggtttcaccatgttggccaagcttgtctcaaactcctgacctcaagtgatccaaccgcctcaggatcccaaagtgctggaattacaggtgtgagccactgtcattggcctagagtttttttttttttaaggaatatttcaaagtattgtcttcaagttagttcagttcaccaacattttattgacatactcccttggaatactaattttatggtgaataatctttgatttgctttgtaggtattaggttttgaaaccttgaaactagtattaatatattatttgtggttactggaatgtcccatagataatatggtttgataattaaagcagagaactgaaaatcaaatttctctgctccccaacccctcaccctcattttcgataccaatctaggaaatatcagaaataattttatttctatattggtttagtcagccgcaaaatggagctaatagtgcttcagaagggtggtgtgagacttaatgaatattgctaaagcgtttgtttctgtgaaaacaactgtatttgttttattttaaatatatatttatacttattcggggtcgggcccaacactttgggaggctgaggctggtggatcacttgagctccggagttcgagaccaacctggccaacatggtgaaaccctatctctactaaaaatacaaaaaaaaaaaaaaattagccacgcatggtgatgagttcctataatcctagctacttgggaggctgaggcaggagaatcgcttgaacttgggagatggaggttgcaatgagtcaagatcgtgccactgcactccagcctgggtgacagaatgagactccatctcgaaaataactaagtaaatcattaataaataaatatatatttatattccttcaactttaaatggccaactaagagcttgtatacacttgtaaagtattttaatgcagtatgtattataataatttaatgcagtaaattatatatatttaatgtagcatattaagttatatatatttaaggcagtatattaaattatacctatttagtgcagtatatattatatatattcaatgctatatatatagccaaatggaaaaaggcatcaatataattgtagtgttgatttattgggtatctcctaaggaaattgttttctacagttagaaagtattgctttatatcattatatcatatggataataatctgttgtagtgcaaaacagaaaagttggaataaagtatgcttataccatgtcttcttagtaatatataatcttgaaaattatatataatttgaaatggatatatgtttatatatatatatatattttttttcctttttaatgatagccaaagctatgatattgggaagatggataagaaatctactgggccagaaatgctggtaaggatcatgttaaatattgtagaaataggttgaataacctgctttattttattgttataaaattataatagcgtactccccatttatgagtagattagctattgggcacaacatttaacatctcagtgtatttgtttttgtatatttatataataatataatctaactcataggcatgtacccatgaattaatatatgtagagtgctttgaacaatgtttgggtatgtaaattttaactttcttttctgtgtgtgtgtgtgtgtgtgtgtgtgtgtgtgtgtgtgtgtgttttgagatagagtctcgctctgttgcccaggctggaatgcagtggtgggatcactgcaacctctgcctcccaggttcaagcgattctggtgcctcagcctcccaagtagctaggactacaggcatgagccaccacacctggataatttttgtgtttttagcagagacggggttctgccatgttggccaggctggtctggaactcctgacctcaggtgatttgcccaccttggcctctcaaagtgctgggattacaggagtgagctaccgtgcctggcctagttttaacttttcttattgcatattttgaagttgcagatttttccccaactgcccagacagaacgtgcttggatatggaaattaatcttaatatgtaatcaagcaaaatgtgattgtgtaaataaatgtgatgtaaaattactacattctatagcaaaatggaatcttttgaatatccatttgattcttactattacagcatattaatcaaaatgtaactggatacctttttaatgtatttaccactgtaatatatggggaataaaagagaagcataaaatgtagcttctgcccttaaggaacttatgattaaaggataaaactagtacaagtgactacaatgaaatattatcctggcttaataaagaaagaaatctgacacatgctacaacatgggttaactgtgaggagactacgctgagtgaaacaagccagtcacaaaaagacagataatgtatggttccacttatgtgaggtatgtagagtagtcaaattcatagagacagaaagtaaaatggtggttttagggggtagggagaggggagaattgggaactattgtttagtgggtatagagtttcagttttgcaaggtaagagagttctcgagatggatgctggtaatgattgcacaagagtgtgaatatacttaatactactgaactgtacacttaaaaatgtttaagatggtcatggagccgggtgcagtggtgtgtacctgtagtcccagctactcaggaggctaagccaggaggattgcatgaaaccaggagtttgaggctgcaatgagctgtgatcatgcctgtgaatagccactgcattccatctgggcaacatagtaagactccatctccaaaaaaaatttttttttgagacagggtcttgtcacccaggctggagggcagtggtgtgatcagctcactgtaaccttcaaactcctgggctcaagcagtcctcccttcttaacctactgagtagctgggactacaggtacactccaccacatctggccaatttttaattttttatagagacgggggtctcactttgttgcctgggctggtctcaaacacctggcctcaagtgatcctcccaccttggcctcccaaggttctaggattacaggcatgagccactgcacctggcctaagattttaaaaaaagtttaagatggtcaattttatgttatgtgtattttaccacaattaaataaattatttatatataaatatataatatttatatttatatatagtgacattgtcacttattatataacagtgagactcaattaactataataattgcaacgatatggatgttctcacctataatattgaacaaatgaagcaagatacaaagtagtacttactgtatgattccataaatgtaaatgccaagaacagtcaaaatgaatatatggtgttggacatcagggaattggttacccctatttgaaacagggtctgaaaagaagcatgagtgggcttgttgctgttaatgttctgtttcttaacttttttgttgttaacatacatgtgtttactttgggaaaattcgtagagcctagaattcataagagcatagagctcttgagatttttatacttttctgtaagtcttttatacttcaatgaagaaaaatagaatttaaaaaacactactagaagtgaaacaatttgggaagataatgataaactttgtggtactgacctgaagtatgcagaagggcatatagaaaaggagattatcaagattagctagagtagttgtaggagccttttggtaggagacaggcctttttggggtccacacagttaaaagggaggaagaaaatgactccaggcaagggatctagatgggagatgtctaagaaggaaataaggatggaagataggatacaagcttgattaaaatggaatattcatattccatattgtaagtttagtgaggtaatactatgcagtaattttttatttcatgccagcagtcatttatttgaggtgtaatttatatacagtaaacttcacaagtctcaagtgtacagcttgatgagttttaatatatagtagtcttgtatattacaccatacagatcaagatacaaaaacttcccaacacccccaaaagttcccttggccccattctagttaatacccacctctacttccaagaacaaaaaaacaccattctgacttttactactctagattatttttgactgtttttgagctttgtataaatggaatcatacagttgtcctgttttatgtctggcttttttaaaacatacattgtgagattcgttcattttgttacgtcttttggatgatttgacactttcactgttatgaaatagctacagtatttctcagaaatgccatatttactccataaaagtcatttgggggagcttataaattcttagagttgttccacgataataatgtggtggtaagctgattaaatgaaatattgctctgcctcagtttccttattttaaaaggggggatgataaaatacgttaaatactgttaagaaaataattatattaacataattatattaaatgtaaataagccaggaatatagccattactgtaacattcttagacaatattttatatgggtagcataatgatgagacatattccaagactgtggtcgcttaaggaaatgctatttcataaagatgacttatgtttgagaagatgcctgtcactgtgggagtgctagtcagctgttgtattgaagtttaaccatcagatatgtgctttttttctttttttttttcttacaggctaaagttctacggctattagccacgaattatttggattgggatgacaccaaatattatgataaggctctcaatgctgtaaacctagcaaacaaggtatggggcttgtatttttgaatactaacttaatgtattttttgaagtcttgatcacattttgaaatccagtttagacatttgcttcagcatttactctcacagattgttataatctcttctatagcacagaaaggaaaaataaaatattgctataatctgaatgtttgtgtccccgcaaattcctatgttgaaatcttaacccccaaagtgatgatattaagaggtggggactttttggtgtagaatggacgtaaaaataaaaaaggtggggactttgggagatgataaagtcattgggcaaacccctcttgaatggtattactgcccttataaaagaggtccacaggagtttgttcaccccttttatcatgtgaggacatgagaaggcactgtctttgagtaagcaggccctcaccagacaccgaatctgcgagcaccttgatgttggagttcccagccttcagaactgtgagaaatcaatatctgttgtttgtaaagtatctagtttatggtattttgttatagcagcatgaacagactaaaacaaatatacttctttgaacaccagagatttttgagaaaattttcttttctgtgaaacagaaagggatgtctctactgtgagtttttaggatgaagaagtaaatgataaaatacgcagaataatgggatttaattttaaaaacaactccagtggttgactttcagctcatgttcacacatacctaaaaacatgaatacaaagcgggcgtggtgacacatgcctgtatttccagttgctcaggaggccaatgtgggagatttgcttgaggccaggagttcaaggctgcagtgcactatgattgcatctatgaatagtcactgcacttcagcctgggcaacataatagcaagaccccatctctaaaacaaacaaaacaaaatgtgtatatatctacactcctggacaaggaacactgaaaggctggtgaccctttaaaaatagattcaggctgggtgcggtggctcatgcctgtaatcccagcactttgggaggctgaggcaggcagatcacaaggtcaagagatcgaaaccatcctggtcaacatggtgaaaccccatctttactaaaaatacaaaagttagccaggtgtggtggcatgtgcctgcagtcccagctactcgggaggctgaggcaggagaatcgcttgaacccaggaggcagaggttgcagtgagccgagatcgcaccactgcattccagcctggtgacagagcaagtctccgtctcaaaaaaaaaaaaaaaaagaaatgaaataaaataagagagattcaattaggatcaatgtgttttacttaataaggcaattaaatatactgatacactttagaaaggtttttttcaacagagtggaagcatgaaaatgaatagctcgatcaaccagaatgttaaatttgtcaaacagagcatttacttgaactatattttcctgaaatttatgttatgtggatggggttatttaatgctgaaaaacttgttcaacattaaaattaaaaaattaatgtagaaatatttatagacaggaatattttctttttttaaattttactttaagttctaggatacatgtgcagaatgtgcaggtttgttacataggtatacatgtgccatggtggtttgctgcacctatcaacccgtcacctaggttttaagcccttgcctgcattaggtatttgtcctaatcctctccctccccgtgcctcccaccccctaacaggccctagtgtgtggatgttcccctccctgtgtccatgtgttctcattgttctactcccacttatgagtgagaacatgtggtgtttggttttctgttcctgtgttagtttgctgagaatgatggtttccagcttcatccatgtccctgcaaaggacatgaactcattcttttttatggctgcatagtattccatgctgtatatgtgccacattttctttatccagtctatcattgatgggtatttgggttggttccaagtccttgctattgtaaatagtgctgcaataaatatacgtgtacctgtgtctttacagcagaatgacttataatccttcgggtatatacccagtaatgggattgctgggacaaatggtatttctggttctagatccttgaggaatcaccacactgtcttttacaatggttgaactaatttacactaccaccaaaagtgtaagagcgttcctatttctccacaaccttaccagcatctgttgtttcctgactttttaataattgtcattttaactgtcgtgagatgttatctcattgtggttttgatttgcatttctttaatgaccagtgatgatgagctttttttcatgtttgttggccgcataaatgtcttcttttgagaagtgtctgtttatatcctttgcccactttttgatggggttgtttgtttttttcttataaatttgtttaagttccttgtagattctggatattaaacttttgttagatgggtagattgtaaaaattttctcccattctgtagattgcctgttcactctgaagataatttcttttgccctgcagaagctctttagtttaattagatcccatttgtcaattttggcttttgttggaattgcttttggtgttttagacatgaagtctttgcctatgcctatgtcctgaatggtattgcctaagttttcttctagggtttttattgttttggttttacatttaagtctttaatccattttgagttaatttttgtataaagtgtaaggaaggggtccagtttctgttttctgcatatcagccatactatttttcttagcaactgtatcattttaaattcccatctatagtgcacaagggttgcaatttcttcacgtcttcagcagcacttgttatcttctattttttaataatagacatcattatgagtgttaggttcacctttgttttttgaatgatattttttccaggtatagaatttaaaccagacagctttttttggggggggggtattttaaatatttcattccactgtattctcattctgttgtttctgttgagaaatatggtgccattcttatgtttgttcttttttatatagcgtgtcttcttttctgaataagttttggattttttatcattggttttgagcaacttgatgttatgcttttaagtaattttatttacgtttctcgtgcttggggctctttgtgattttttggatgtctaggagcataattttcattatgtttgaaaagttccagtatttcttcaaattttttttctgctttcccccaagtactctaattaaccatgtattaggctgcctgaagttgtgccatagtttgcttatactcttttcacttaaaacataatttgttatttttgtttcattttggactgttttgtattgctattacttttaagttcattaatctttcttctgcaatgtctaatcatctgttaatctcatcccatatatttttcatttcagactttgtagtttttatctctaaaagtttgatttggtttatttttatatcttccaagtctctagttaaatttttgagcatacgaaatacagttatacttactcttttaatgtctttctttgataattctaatatctatgtcacttctagattagtttccatctattatctccccattattgattgtttttgcctgctctgtctttcactgggtgccaactattttacatcgttggctgctggatatttttgtaatactataaatcttattgagctttattatgggaaacaggcaagttatttggaaacgatttgatcccgctgttcatgtgaactcctgactcttgcttagtatgaaatatttccttctttgttttgtaattatggatatgttaatttatgttcagtgagtgttaagtttttagaatcctattcaacctggattgagagcatggccctgcagagaaactttttattggcatcagccagatgtaaaagagttaccactcttttggttacttttattttactttctcagattggaggtttttggaccacatgagtaatgtaaatttgaactctgtatctacatgaaggcagagcccattaaaaaattatccaaaccaaaaaacttatctacacaaactttttttttttttttgcctcactcagagcttagctagaagacaaacttcctatgccattagataaaagaaaaaaactcaggaaacttaccacctccatatggttcacttctccaagttttgttgcctcactacaatctttgtttttgtttacttttaagagtcctcaggttgttgctttttatatcttgttcagagttcttagttgtaattagtagaaggtataggcttagttgtcttgcttcatatctgctggaactgaatctgatagtaaatttttaaaggagaaattaaaatttggtatgcctatgttgtttcacaaaattacctttgaaaatgtattagtgcaatgaaataaatataaaaggcataggtgcttagatactacaccaaaagcacaagcaaaaaagaacaattaggtaaaattaagtctcattaaaattaatttttttgcttcaaaggaaatcatcaagaaaatgaagacacaatccataggatcctcccaacagaatgggagaacatatttgcaaatcatatatctgttgtctattaaccataatataaaaaagaactcttactattcaataagaagacaaacaacccaattgaaaatgggctaaggaggcaaaggagctcaatagacattctccaaataatacgtaccagtggccaataagtacacaaaaagatactcaatatcattagttatcagggaatgcaaattagaagcacaatgagaaaccactttacatccactggtatggccctccgacttgtttttatttcagaattgttttggctcttctgaatctcttgcattttcatattttggaatcagcttgttgatttctgcaaagaagacagctgggaatttggtagggaatttgttgaatctgcagatcaatttgggaattattgctatcttaacaatattaagttttcaaatccaggaacatttattcattgttttgtagttttcaataaataagttttgtccttcttttgttaaatttattgcttctttatgcttttataaatggaattattttcttgacttttggattgttcattgctagtatatagaaatgccattaattgaaaaaatactgatattatatcctacaatcttcctgtacttgttcttttagctttaatagttttttaatggattacttaggattttctgtatacaagatcatattttctggccggacgctgtggctcacacctgtaatcccagtactttgggaggctgaggtgggtggatcacttgaggtcaggagttcgagaccaacccggccaacatggtgaaaccccatctctactaaaaatacaaaattaaccagacatggtggtgcatgcctgtaatcccagctatttgggaagctgaggcaggagaatcacttgaatccagaagggagaggttgcagtgagccaagattgtgccattgcactccagcctggacaacaagagcaaaactccgtctcaaaaaaaaaaaatcatattttttgtaaataaagatagttttacttcttgctttccaatctgcgtgccttttgtctctttttcttttctaatttttctagcaagaacattcattactatgttaaatagaattggcaagagcagtatctttccctaatcttagagagctttcagtattttgccattaagtatggtgttagctgtgggtttagtatagatgccctttgtcaggttgaggaagctcccttcattcctagttttttgagaattgtacaaccacgttaaaaaacagtttgaagttacttgataaaataaaatttgatcatactggaccacccagcaacttcactcctaggtagtgaagcgctagcatttgtatacaaggagaggtatacagaatgctgattccaggattgttcataatagcaattgcgttggaaacagcttaaatatccaaagtagaatgtgcaaataaagtgtgaattattcataaaacagagtactatacaacagttgttcttaatatttagcttgtgtaagtattacctagagtgtctgttaaacacagtttgctcatttgttaccttactaaacagataatagaatttatgttgaattggaaactttccataatgcaaatcaataataattattttacacattttcccccacacatgcacatacaatttgctaggcaatactcccagagtttctcatttagtaggttttggatggggcttgaatttctttttttttctttttttttaaattatactttaagttttagggtacatgtgcacgacgtgcaggtatgttacatatgtatacttgtgccatgttggtgtgctacacccattaactcgtcatttaacattaggtatatctcctaatgctatccctccccactccccccaacccacaacaggccctggttgtgatgttccccttcctgtgtccatgtgttctcattgttcaattcccacctatgagtgagaacatgcggtgtttggttttttgtccttgcgatagtttgctgagaatgatggtttccagcttcatccatgtccccacaagggacatgaactcatcattttttatggctgcatagtattccatggtgtgtatgtgccactttttcttaatccagtctatcactgttggacatttgggttggttccaagtctttgctattgtgaatagtgccgcaataaacatacgtgtgcgtatgtctttatagcagcatgatttatagtcctttgggtatatacccagtaatgggatggctgggtcaaatggtatttctagttctagatccctgaggaatcgccacactgacttccacaatggttgaactagtttacagtccgaccagtagtgtaaaagtgttcctattttttcacatcctcaccagcacctgttgtttcctgactttttaatgatgccattctaactggtgtgagatggtatctcactgtggttttgatttgcatttctctgatggccaatgatgatgagcattttttcatgtgttttttttggctgtataaatgtcttcttttgagaagtgtctgttcatatccttcaccaacttgttgatggggttgtttgttttcttcctgtaaatttgtttcagttcattgtagattctggatattagccctttgtcagatgagtagattgcaaaaattttctcccattttgtaggtcgcctgttcaccctcatgatagtttcttttgctgtgcagaagctctttagtttaattagatcccatttgtcaattttgtcttttgttgccattgcttttggtgttttagacatgaagtccttgcccatgcctatgtcctgaatggtattgcctaagttttcttctagggtttttatggttttaggtctaacatttaagtctttaatccatcttcaattaattttagtataaagtgtaaggaagggatccagtttcagctttctacatatggctagccagttttcccagcaccatttattaaattgggaatcctttccccattgcttgtttttgtcagatttgtcaaaggtcagatagttgtagatgtgtggcattatttctgagggctctgttctgttccatttgtctgtatctctgttttggtaccagtactatgctgttttggttactgtagccttgtagtatagtttgaagtcaggtagcgtgatgcttccagctttgttcttttggcttaggattgtcttagcaatgcaggccctattttggttccataggaactttaaagtagttttttccaattctgtgaagaaagtcattggtagcttgatggggatggcattgaatctataaattaccttgagcagtatggccattttcatgatattgattcttcctacccatgagcatggaatgttcttccatttgtttgtatcctcttttatttcattgagcagtggtttgtacttcttcttgaagaggtccttcatgtcttttgtaagttggattcctaggtattttattctctttgaagcaactgtgaatgggagttcactcatgatttggctctctgtttgactgtttttggtgtataagaatgcttgtgatttttgctcattgactttgtgtcctgagactttgctgaagttgcttatcagcttaaggagattttgggctgagacgatggggttttctagatatacaatcatgtcatctgcaaacagggacaatttgacttcctcttttcctaattgaataccctttatttccttctgcctgattgccccggccagaacttccaacactatgttgaataggagtggtgagagagggcatccctgtcttgtgccagttttcaaagggaatgcttccagtttttgcccattcagtatgatataggctgtgggtttgtcatagatagctcttattattttgagatacatcccatcaatacctaatttattcagagtttttagcatgaagggttgttgaattttgtcaaaggccttttctgcatctattgagataatcatgtggtttttgtcattggttctgtttatatgctggattacatttattgatttgcacatgttgaaccagcctcgcatcccagggatgaagtccacttgatcatggtggataagctttttgatgtgctgctgaattcaatttgccagtattttattgaggttttttgcatcaatgttcatcagggatattggtctaaaattctcttttttggttgtgtctctgcccggctttggtatcaggatgatgctggcctcataaaatgagttagggaggattctctctttttctatgattggaatagtttcagaaggaatggtaccagctcctccttgtacctctggtagaattcggctgtgaatccatctggtcctggactttttttggttggtaagctattgattattgcctcaattttagagcctgttattggtctattcagaggttcaacttcttcctggtttagtcttgggagggtgtatgtatcgaggaatttatccatttcttctagattttctagtttatttgcgtggaggtgtttatagtattctctgatggtagtttgtatttctgtgggatcagtggtgatatcccctttatcattttttattgcgtctatttgattcttctctcttttcttctttattagtcttgctagcggtctatcaattttgttgatcttttcaaaaaaccagctcctggattcattgagtttttgaaggcttttttgtgtctctatttccttcagttctgctctgatcttagttatttcttgccttctgttagcttttgcatgtgtttgctcttgcttctgtaattcttttaattgtgatgctagggtgtcaattttggatctttcctgctttctcttgtgggcatttagtgctataaatttccctctacacactgctttgaatgtgtcccagagattctggtatgttgcgtctttgttctcattggtttcagagaacgtctttatttctgtctttattttgttatgtacccagtagtcattcaggagcaggttgttcagtttccatgtagttgagcggttttgagtgagtttcttaatcctgagttctagtttgattgcactgtggtctgagagactgtttgttataatttctgttgttttacatttgctgaggagtgctttacttccaagtatgtggtcaattttggaataggtgtggtgtggtgcagaaaagaatgtatattctgttgatttgggttggagagttctgtagatgtctattaggtccgcttggtgcagagctgagttcagttcctggatatccttgttaactttctgtcgtgttgatctgtctaatgttgacagtggggtgttaaagtctcccattattattgtgtgggagtctacgtctctttgtaggtctctaaggacttgctttatgaatctgggtgcttctgtattgggtgcatatatatttaggatagttagctcttcttgttgaactgatccttttaccattatgtaatggccttctttgtctcttttgatctttgttggtttaaagtctgtattatcagagagtaagattgcaacccctgcctttgtttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcgcattaacatgtaaggttaatgttgttatgcgtgaatttgatcctgtcattgtgatgttagctggttattttgcccgttagttgatgcagttcagccttgatggtctttacaatttggcatgtttttgcagtgtcttgtaccggttgttcctttccatgtttagtgcttctttcaggagctcttttagggcaggcctggtggtgacagaatctctcagcatttgcttatctgtaaaggattttatttctccttcacttatgaagcttagtttggctggacgtgaaatttgggttgaaaattcttttctttaagaatgttgaatattggcccccactctcttctggcttgtagagtttctgccgagagatcagctgttagtctgatggacttccccttgtgggtaacccgacctttctgtctggctgcccgtaacattttttccttcatttcaactttggtgaatctgacaattatgtgtcttggagttgctcttctcgaggcatatctttgtggcgttctctgtatttcctgaatctgaatgctggcctgccttgctagattggggaagttctcctggatagtatcctgcagagtgttttgcaacttggttccattctccctgtcactttcaggtacaccaatcagacgcagatttggtcttttcacatagtcccatatttcttggaggcttttttcatttctttttattcttttttctctaaacttctcttctcgcttcatttcattcatttgatcttccatcactgatacccttttttccagttgatcgaatccgctactgaagcttgtgcattcatcacgtagttcttgtgctgtggttttcagctccatcaggtcctttaaggacttctctgtattggttattctagttagccattcgtctaattttttttcaaggtttttaacttctttgccgtgggttcgaacttcctcctttagcttggcgtagtttaatcgtctgaagccttctctcaactcgtcaaagtcattctccatccagctttgttctgttgctggtaaggagctgcgctcctttggaagaggagaggtgctctgatttttagaatttccagtttttctgctctgttttttccccatctttgtggttttatctacctttggtctttgatgatggtgacaaacagatggggttttggtgtgcatgtcctttctgtttgttagttttccttctaacagtcaggaccctcagctgcaggtgcattggagtttgccagaggtccactccagaccctgtttgcctgggtatcagagcggaggctgcagaacagcggatattggtgaacagcaaatgttgctgcctgatcgttcctctggaagttttgtctcagaggagtacccggccgtgtgaggtgtcagtctgcccctcctggggggtgcctcccagttaggctactcgggggtcagggacccacttcaggaggcagtctgtccattctcagatctcaagctgcgtgctgggagaaccactactgtcttcaaagctgtcagacagggacagttaagtctgcagaagtttttgctgccttttgtttggctatgccctgcccccagaggtggagtctacagaggcaggcaggcctccttgagctgcagtgggctccacccagttcgagcttcccagcctctttgtttacctactcaggcctcggcaatggtgggcgcccctcccccagcctcgctgctgccttgcagtttgatctcagactgctgtgctagcaatgagcgaggctctgtgggcgtaggaccctccaagccaggggtgggatttaatttcctggtgttttgtttgctaagaccgttggaagtgcgcagtattatggtgggagtgacctgattttccaggtgccatctgtcactcctttctttgactaggaaagggaattccctgaccccttgtgcttccctggtgaggcgatgcctcgccctgcttcggctcaggctcagtgcactgcacccactgtcctgcacccactatccaacactccccagtgagatgcacccagtacctcagttggaaatgcagaaatcacctgtcttctgtgttgctcacactgggagctgtagactggagctgttcctattcagccatcttggctccaacccatggcttgcatttcttacaagttcccagatggtgctgattcagggaccaccctttgacagccatgctgtatagtaatgaaaacaaataagtttcacatatctacatggttgaatctgaaaaaacatgatttgaatgaaaggaatcacagaagaacttagatacattatgattctgtttaagtgaagttcaaatgtaggcaaaactaaataattgtgttggctagcttgagctgttataactaaatactataaactgggtggcttaagcaacagaactttatgtctcacacttctagggactgagatgtccaagatcaaaataccagcctttttggttcctggtgggggcctttgtcttggtttgaagatggccaccttctttctatatcttcatttggcagagaaagagagagagagagagatcatctctcatctctctcatgtcttttcttataagggcacttatcccattcatgagggctcagccctcatgaccaaattacctcccaaagcccccacctcaaaataccatcacattggggattagatattcaatatatgaattttagaaagacacaaacattcggtccatagcaactgtatattgtgtatatataaagaaaagcaagggaattactgcacaaaattcaggatggtgtttacctctgtgaggtgaggaggatgcctatgggtaaggatacatttgaggctttttatgtggcaataatctgtttcttaaccttggtagtgaggacaccggtgtttgttttattattattctgtaaactatacatatacattgcatatacatatgtttatatactcatgtgtgtgtatgtgtgtatgtgtatgatacacttcacactagaaatgagtacattatctttagagcttgcaaaatatccagatagtgtagtaatgcctgccatgatagacagagcttcaagggaggcagcatattgtaatggaaagattatgtcctttagagtcagagagatctgaattcaaatttcagctctactacttaccagttgtgtgaccatgggtaagttacttaactttatctggccctgcaaaacaagattcacaatacttatcttgtatgtttgttgtacctggagcctgtttctcagtaactggtgaaaagaaaaaaatcagcaaacaaaaatctaaggaagggagccaggcatggtagttcatgcctataatcccagcacattgggaggctgagacaggaggattgcttgagcccaggaagtggaggctgcagtgagccgtgtttgtaccactgcactccagcctgggagacagagtgagactctgtctcaaataatgaaaaaaaaaaagcagccaggcctggtggctcatgcctgtaatccctgcactttgggaggctgaggcaggtggatcacttgaggtcaggagttcgagaacagtctggccaacatggtgaaacctcgtctctactaaaaatacaaaaatgagccagatgtggtagagtgtacctgtaatcccagctactcgggaggctgaggcaggagaattgcttgaacctgggagacggaggttgcagtgagccgagattgtgccactacactccagcctgggcgatagagtgagactccatcatgaataaataaataaacaaacaaacaaagctatgaagaatgagaaataacagtgggaaaagttacagagaagacaaggattttgatagtagggagaaagctgatggatttagcaggcaatcttcatgacttctggaagtgtagttttaagagacaataaggatggacaatatacggtgcaaatgtttacagaagtgaagacatgatgataacagaagtaaaatgtccattatctggggttgtttggtaatgaaatcagtgaaaatcatatctggaattgtttggtagaaaaaaaccagaatgttaaatttgtgtgagaatagcagactcaaggaaaacagatgttgccaagatctggaagacctctatgtctctgaagataaaagggaattgaatccaacacatacttcaacaaacctacaggaaagatggtaatgcaataaatcaaaattggcaacttcagtttattctttgtactagtgtcatctatatttgcaagcccttttaataccagtgcttactttctccaactttctatttttaagacatctcacatatgaatacctgtaattatgtgcagagtatggagctaatcagtacggtgttcatgtaggggttaattggctttgtagagagaaaagttctgttctgtgggcctagactgtacttttagtcttagaaagttgtttaaagatgtaccctgtcaggcgaaagtggaaccgggaagatcacagatggcttagggccaactaacaatgatttagaaataacgttgttattaatggtaaacacgacaggcatatcttatggaaaagacaatacattttctattttattccgccattgtttgcaaaggaccttagtcaataaatctcaaaagaaaataaaactagccggtttgtggttttgcttacaaagaatatggcctgagatttgtacagtttaagtattaatcttgtcattaaatgtttgtcactcattggaaatatttacatgttcttttccatatattatttcatttagattgaaaaaatattgggaaatatcctcagggatagaacaaatgttatgatatggtcttctgtaatttcgatttcctttgattatgagttatcccaaggtggttgaataaagcaggcaattacttgaaaattgtcttttacattccacaattttaatatcattgtgatttctttgtttaaaataggaacatttaagttctcctgggcttttcttaaaaatgaaaatcctcttgaaaggcgaaacatctaatgaagaactccttgaaggtatgatctctgtatgtgaagagcacaccattttgaaacatcactacaatttgttaaatataagatcttttgtagtatactaacaataggtgtaatttgatggtggctgagaaggaaaatgatcacccaggaaagggaaaatattgtcacccaggaagaaagagagaaagaagaaaaaatagtagcaaatttaaaaggtgtttttttttttaaaaaaagctgaataaaagcaatcagttttcttttagtccagcagagaactgtagctacccaacccttctgaagttgtctaccaccatgaagaaagaaagattacctattaatgggaaaagcctttgtaatgctgtgatttttataattacttgtttataaacattgctatttatttttcataattctccaaggaccagaatgtacactgcacaaaagttggtcattgggcaagtcacttaactttgctttgtttcttcatttagcaaaagagatattattattatctacctcatcatgttgttttgagaatcttgtgagaaaatgtgtataaagcatttaacaccatacctggtgcatagtgtgcaatatatgttacctattactgtagttattattattactgttattactactatatagatgcattacatgaagcaaaactatgcacactagcccttaacatttcagttttgtttagtcataaaaattatttactctaattcttttaatgttgtacatgcttttcagtaatctttaagagctgcattatttgtactatacaaaattatatgttagtatagttactgattatccaataaataataacaatttgttatagttagaactaaaattcaatttggcagtagccctaaatttagtactactgaatctttcggcggcctctagaattttagccaatcacttaagagacctcagaagctcaaatgtattggggattctgcatctctaggcaacagtatcacctcagcatacacagattgaaaaatgttagaaaccaggaagacaactctacttttttgcattgggggaataaacaaaccaactaaccaactaaaataatacacttactccaactaagacaacataggaagaccagagagatgattggagtcaccaagttgaagtacattagtttgggatgataattccttatgacagtgtttatccaaatgtaggtaagaagcagagtttaaaatgaaattgttctttattcacagattgcttttacttaactcaatctagatactcccgaagttgcaatgtcagtcatagtttgattacagattaggaggctaacccaaatccaagttttttatatttaaaaatactagattttgcattgaaagaatatatgaaacttgcatttttatattctgtttgttgctttgctggtgaaaatactttactcttaaaatggtcagcctaactgctggcattattgcactgatattttttgtagtagaaagattgaaatttaaaaataaacatttttcattgtgaaaggatagcacataataatttaagacatttttggaaaatactaaaaattctcatggtcctaccatccactagaagctccttgacagcaggaatatttgttatgttttatccactgctaggttctcagcacaaagcacaatgcctggtacagataatatgctcattaaatatttgtcaaataaatagaatctaaacacaatcacttttagaaatttgatcacttattttcagtattttttctcttagtttattttgcttttattacagaattgtaactatatagtacataaaagtttgctttctaatttttcacttactaatcttatacatttttcatattagtgtatattcattttttccactttatttcatactcaacagttttaatggttgcacaatagtttattgctaccctgtaatagacatacagtgtatacttcttttctattattattataatctacactgcttttaatatttttgttcataaactttccccatatttattccaggtgacttttcagaagcacaatttcttaaagggaataataatagcagctgccatttattaaatgcttactaagtgctaggttctttgctatataatttccatacattatctcaggtaatcctctcaacaaccctgagaaattggtggtatattctccattttacaggtgacaaaactaaggtatagagagcataacttgcctatggccatacaagtagcaagtggtttcaaatttagatctgtctgacttcagataccaagctctctaccccagtgttcttagcgtatagtattgccaagttgctttttgaaaggattgcaccagattactttgctatctgtgcaagagtgcttgtgtcatgacactctccagcactggatgttaatactttaaaagaagattttgataaatttttaggcaaaacatggtatatggcaaacatttagtaagtagattttgaatagaggaaaattattgaaaataactaagcttcctcaaaaattaaactgataattatttcattttttcatcttgttagctgtcatggaaatactacatcttgacatgcccttagacttctgtctgaacattgctaaactgctgatggatcatgaaaggtacagaattgatttccctttctctaaagactgacagtttttggctaggcaccagtggctcacacctagaatcccagcacttggagaggctgaggcgggaggatcccttgagcccaggagcttgagaccaaccttggcaatatagcaagaccccatctctacaaaatattttttaaaaaattggctggtatggtggcatgtgcctgtagtcatagctactcgggaggctgaggcgggaggatcacttgagcccagcagttcaaggttacagtgaactatgatagtgccactgcattccagcatgggcaacagagcaggactctctcaaaaataattttaaaaatttagtccctccttcacactagccatgtatcaaatccaaatagctgcatgtagctaatggctgccttattggacattacagattaaaaaaatttccattgtcacagggaagttctattgggcagcactgttttagaccctgtatttcttttaatgcagacaacatttaaaatagttcttttctggcagctacatcatatggttaatttcctggacttatgaaactatatgcctcatatcctccacttttatggttaagaacccattaaccatactttataaactattaaatttcagcctgattgttacagcctattttttcagttcttctgatctttgtgaatttcacttctatcatgcagtgtattaactattcctcccagtttgtgtcatcttcaaatttggtattgccacctgtcttcatctaattcaggggtctgcaaacttttcttacaggttaagatataagtatacattttgggcttgtgggccacacagtctctgtcacaactagtcaactctgccgtcgtggtgcaaaagtagccgtagactaatcataaacaaatgtgtgtggcttttattccagtaaaactttattcataaaaacaagcagagcagctggactgcaggccatagttttctaactccagataatttgacaaacagcaaaactgaggccagaaccttcgtggcagcatagattaatctccaggttaacagcaatccattaattgatactttttagtgtacaatcattgaacctgttataaatccacctaattatagagctagatgacctaatttccttcatgttgttcacaaaaatttcatggaacttaatttttattttttaaagttttggttgcttttatccttccttcttccaaaaagaatttgaaacttcttatattcaagtgtataataaagctctgaaaattgaaatagacaatcaaaaccctgaaaaggaggaagcaaacacaccaaacacaatggctaatatagttgctgtggtagagcattcaatttaatggtaagctttcttgcagccagggagaaggggcaatgtgatattttatacaattttcattattaaataacaaaagctaacatttactgatacttgctttttactaggcactattctaaattccttacattataaattatgaagtacctctaacgtaatttgattaaccccattttgcaggtgagaaaaatgagggttagatagaaaaagtaatttgcccacaattgcatagctaggaaggagcagagctggaatttaaatatgtttgcagagctcacactttttattactgtagtagaaggaatacattcaatactacattccaaatcaattaatcactagaaaaagtttacaaagtggtggactatgggctgggtgtggcgagagatgtgttgcatatagttgaattagttgccaacattaaacattcaggaaatttcacataaaaatatggttttcatatatatatatatattatatatatgtatataatatatacatagaaaatctgtgtaatgaaaaataattcaagaaaaggactgaaatttcaactgggtttattttggaaagtgaataaaataagcaatcctgttgtaaaatgcagttatgtagttatatattaagggaaaagattgcccaggcattagctctcttacagatgacaactttacaaaaaagtgtctactgagtcacacaacatattcttttttttttagtaccttctttttttattatactttaagttctagggtacatgtgcacaacatgcaggtttgttacttatgtatacatgtgccatgttggtgtgctgcacccattaactcctcatttacattaggtatatctcctaatgctatccctacccccttctcccaccccatgaaaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacataggacagggactcatcctttttatggctgcataatattccatggtgtatatatgccacattttcttaatccagtctatcattgttggacatttgggttggttccaagtctttcctattgtgaatagtgccacaatgaacatacgtgtgcatgtgtctttatagcagcatgatttataatcctttgggtatatacccagtaatgggatggctgggtcaaatggtatttctagttctagacccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtatcttttggctgcataaatgtcttcttttgagaagtgtctgttcatatcctttgcccactttttgatggggttgtttgttttttcttgtaaatttgtttgagttctttgtagattctggatattagctctttgtcagatgagtagattgcaaaaattttctcccattctgtaggttgcctgttcactctgatggtagtttcttttgctgtgcagaagctctttagtttaactggatcccatttgtcaattttggcttttgttgccattgtttttggtgttttctgttgcatagacataaataataatgcccagtgaagcatatttatttgtggtgtcaatgagaattttgatatgatagaacttttgaacatagtgcctgtgtcttaagtttaatgtagactggtcaaaataacttaagtatgactacagaagatatttctgcaatggttaacacaagacttgatatgaaacttaaatccaaagtggcagtgtttttaaagataaaaaacttcagtgtattaattgtataattcaccaggaaacactgtcctaaaaagataaaaaatgaaacgtgtatataataacaatatatgtataccagatattattctgtggcctcaaccgagattattgctttttttggatgaattggatgcacaatacagtagttgcttctgcttcttgtagattagggggcttagttgtatgtggtgttgtcacaggttgggttgccctggaagcaaattttgagatggaggttaacgtgaagataatttattaaagggttctttcaggatcaacacctgtgaagggaaggggatgcagctggactaatgggagaagttggcctagatatagtcagaaggcctcagccttacttattgggagctctgaagctgggatggtccctccaaattgtcctcagctaaggtcagagggccggtccttatagcccaatgttgactagtctctgtatgccagttaccctgggaaaggagaatgaccttgggtgtggtagcttttttcagcctagcgaattcctaaagagcaactggggaataaatacttcagttctgaaggggagtttcgggatgtagtgcagcatttatgtcaggtgctgaagatatattttttgaactgttgaaagaattcaacttgttcatgtcatccaagggaaaatccctgactcagttcagtgactgacctttttggtgaatatgataatccatataaacactctgaatctttctcgcgaaagtgctcataagtagttacacaaatgtaaaatttaattcacatgttcttagtgaagtcattttttggggaaatgcttttggcaaggaataatccggcttacttttctgtgctgaaattggtgtccagagatggaagtgattacttaaactacgtattcacaattgcaggtttaaagagtgaattccaaaaaggaagttttctgatttccaacattgtggcaattaaaaatattgcctattttgtctttttcaattaattttactaatgtcagtaaagaactacaaattgaagaaattgaactgcactgtagtgtggtactgaatcctaattagacaactttggaatatcagtatgtagtagacatttgctgcttttggccatccatcattttattcattccactttcctcttgatacggtacccgaatttccacttaagtatctacttttccctatcagcccatgtggacactgacatattggtgtagaagaaaggattttagctttctatttacaagtcaacaaagtaatcaatttcaaaggaaaatttgataaattatttatatttttagatttcaaatttaaaatatagctgctcttttcctacctgttcatactatttgttaatgtgcttataccatcgttcggttaatgataaagtttaattacatatctggcagtggatttttttacagtctgcttcactcatttatgttacatatttggcttctgtagacagtgtaggaagttgcattatataatggacaatgcttttagtaattttatagcaagagcataagtatattttacacagtaaagtttttttttttaagcaatgaaagctaagcatgcagaacattaactgttagaaagtgaatgaagtggccaggcgtggtggcttacgcctgtaatttcaacactttgagaagctgaggaagatggattgcctgaggtcaggagttcaagaccagcctggtcaacatggcaaacccctgtctctactgaaaacacaaaaatgagcgggctgtggtggcacatgcctctaatcccagctactcaggaggctgaggcatgagaattgcttgaacccaggagacggaggttgcagtgagccaagatcgcgccattgcactccagcctgggcgacagagcaagactccatctcaaaaaaaaaaaaaagaaaagaaagtgaatgaagttctgtaatggactaagctaatgtagttcagacctagttttctgatgatccatcttgatgcaaggataaaattttgaatatatagaatggatggaaatactatgtctcttaagcgatctttttttttttttgaaatttcaccttttacagtcaagcttcattaggagacagagagcagacaattccaggttatatacttattagatcctagtaatatccagtactatttaagggaagagcataggctttggattctagaaaagcaggtgaatggcttgatactgttattgaatcatttttctgaatttgttagattatatctatttactctctgacattaacatttaagtaaacttgcaaaagataagattaattggaggtggagccaagatggctgaataggaacagctccagtctacagctcccagcgtgagcgacgcagaagacgaatgatttctgcatttccaactgaggtaccgggtgcatctcactggggagtgttggatagtgggtgcaggacagtgggtgcagtgcactgagcctgagctgaagcagggcgaggcatggcctcacccggaaagtacaaggggtcagggaattccctttcctaggggtgatggatggcacctggaaaatttggtcactcccaccataatactgcgcttttccaatggtattagcaaatggcacaccaggagattatatcccgcgaatggtttggagggtcctacgcccacagagcctcgctcattgctagcacagcagtctgagatcaaactgcaaggcagcagcgaggctgggggaggggcgcccaccattgccgaggcttgagtaggtaaacaaagaggctgggaagctcgaactgggtggagcccactgcagctcaaggaggcctgcctgcctctgtagactccacctctgggggcagggcatagccaaacaaaaggcagcaaaaacttctgcagacttaactgtccctgtctgacagctttgaagacagtagtggttctcccagcacgcagcttgagatctgagaatggacagactgcctcctgaagtgggtccctgacccccgagtagcctaactgggaggcaccccccaggaggggcagactgacacctcacacggccgggtactcctctgagacaaaacttccagaggaacgatcaggcagcaacatttgctgttcaccaatatccgctgttctgcagcctccgctctgatacccaggcaaacagggtctggagtggacctctggcaaactccaatgcacctgcagctgagggtcctgactgttagaaggaaaactaacaaacagaaaggacatccacaccaaaaccccatctgtttgtcaccatcatcaaagaccaaaggtagataaaaccacaaagatggggaaaaaacagagcagaaaaactggaaactctaaaaatcagagcacctcttctcttccaaaggagtgcagctcctcaccagcaatggaacaaagctggacagagaatgactttgacaagtggagagaagaaggcttcagacgatcaaactactccaagttaaaggaggaagttcaaaccgaagacaaagaagataaaaaccttgaaaaaagattagacaaatggctaactagaataaccaatgcagagaagtccttaaaggacctgatggagctgaaaaccatggcacgagaactgcgtgacaaatgcacaagcctcagtagccgatgctatcaactggaagaaagggtatcagtagtggaagatcaaatgaatgaaatgaagtgagaagagaagtttagagaaaaaagaatacaaagaaatgaaaaaagcctccaagaaatatgggactatatgaaaagaccaaatctacgtctgattggtgtacctgaaagtgacggggagaatggaaccaagttggaaaacactgcaggatattatccaggagaacttccccaatctagcaaggcaggccagcattcagattcaggaaatacagagaacgccacaaagatacacctcgagaagagcaactccaagacacataattgtcagattcaccaaagttgaaatgaaggaaaaaatgttaagtgaagccagagagaaaggtcgggttgcccacaaagggaagcccatcagactaacagctgatctctcagcagaaactctacaagccagaagagtgtgggggccaatattcaacattcttaaagaaaagaattttcaacccagaatttcatgtccagccaaactaagcttcataagtgaaggagaaataaaatcctttacagataagcaaatgctgagagattttgtcaccaccaggcctgccctaaaagagctcctgaaggaagcactaaacatagaaaggaacaaccggtacaagccactgcaaaaacatgccaaattgtaaagaccatcaaggctaggaagaaactgcctcaactaacgagcaaaataaccagctaacatcacaatgacagggtcaaattcacatataacaatattaaccttaaatgtaaatggactaaatgctccaattaaaagacacagactggcaaattggataaagagtcaagacccatcagtgtgctgtattcaggaaacccatctcacgtgcagagacacacataggctcaaaataaagggatagaggaagatctaccaagcaaatggaaaacaaacaaaggcaggggttgcaatcctagtctctgataatacagactttaaaccaacaaagatcaaaagagacaaagaaggccattacataatggtaaagggatcaatacaaaaagaagagctaactatcctaaatatatatgcacccaatacaggagcacccagattcataaagcaagtccttggagacctacaaagagacttagactcccacacaataataatgggagactttaacaccccactgtcaacattagacagatcaacacgacagaaagttaacaaggatatccaggaactgaactcagctctgcaccaagcagacctaatagacatctacagaactctccatcccaaatcaacagaatatacattcttttcagcaccacaccacacctattccaaaattgaccacatacttggaagtaaagcactcctcagcaaatgtaaaagaacagaaattataacaaactgtctctcagaccacagtgcaatgaaactagaactcaggattaagaaactcactcaaaaccgctcaactacacagaaactgaacaacctgctcctgaatgactactgggtacataacaaaataaagacagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacattacaattaaaagaactagagaagcaagagcaaacacatgcaaaagctaacagaaggcaagaaataactaagatcagagcagaactgaaggaaatagagacacaaaaaagccttcaaaaactcaatgaatccaggagctggttttttgaaaagatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctacacaaacaaactagaaaatctagaagaaatggataaattccttgacacttacactctcccaagactaaaccaggaagaagttgaatctctgaatagaccaataacaggctctgccattgaggcaataatcaatagcttaccaaccaaaaaaagtccaggaccagatggattcacagccgaattctaccaaaggtacaaggaggagctggtaccattccttctgaaactattccaatcaatagaaaaagagggaatcctccgtaactcactttatgaggccagcatcatcctgataccaaagcctggtagaggcacaacaaaaaaagagaattttagaccaatattcctgatgaacatcgatgcaaaaatcctcaataaaatactggcaaaccgaatccagcagcacatcaaaaagcttctccaccatgatcaagtgggcttcatccctgggatgcgaggctggttcaacatatgcaaatcaataaacgtaatccagcatataaacagaaccaatgacaaaaaccacatgattatctcaatagatgcagaaaaggcctttgacaaaattcaacaactcttcatgctaaaaactctcaataaattaggtattgatgggatgtatctcaaaataataagagctatctatgacaaacccacagcctatatcatactgaatgggcaaacactggaagcattccctttgaaaaccggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaggcattcttatacaccaataacagacaaacagagagccaaatcatgagtgaactcccattcacagttgcttcaaagagaataaaatacctaggaatccaactttcaagggatatgaaggacctcttcaaggagaactacaaaccactgctcaatgaaataaaagaggataaaaacaaatggaagaacattccatgctcatgggtaggaagaatcaatatcatgaaaatggccatactgcccaaggtaatttatagattcaatgcaatccccatcaagctaccagtgactttcttcacagaattggaaaaagctactttaaagttcatatggaaccaaaaaagagcccacattgccaagtgaatcctcagccaaaagaacaaaactggaggcatcactcttcctgacttcaaactatactacaaggctacagtaaccaaaacagcatagtactggtaccaaaacagagatacagaccaatggaaaagaacagagccctcagaaataatgccacatatctacaactatctgatctttgacaaacctgacaaaaacaagaaatggggaaaggattcccaatttaataaatggtgctgggaaaactggctagccatatgtagaaagctgaaattggatcccttccttacaccttatactaaaattaattcaagatggtttaaagatttgaatgttagacctaaaaccataaaaaccctagaagaaaacctaggcaataccattcaggacataggcatgggcaaggacttcatgtctaaaacagcaaaagcaatggcaacaaaagccaaaagtgacaaatgggatctaattaaactaaagagcttctgcacagcaaaagaaactaccatcagagtgaacaggcaacctacaaaatgggagaaaatttttgcaatctactcatctgacaaagggctaatatccagaatctacaaagaactcaaacaaatttacaagaaaaaaacaaagaaccccatcaacaagttggcaaaggatatgaatggacacttctcaaaagaagacatttgtgcagccaaaagacacgtgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacctaaaggattataaatcatgctgctctaaagacacatgtacacgtatgtttattgcggcactattcacaatagcaaagacttggaaccaacccaaatgtccatcaatgatagactggattaagaaaatgtggcacatatacaccatggaatactatgcaggcataaaaaaggatgagttcatgtcccttgtagggacatggatgaagctggaaaccatcattctcagcaaactatcgcaaggacaaaaaaccaaacaccacatgttctcactcttaggtgggaattgaacaatgagaacacatggacacaggaagaggaacatcacacactggggcctgttgtggggtggggggagtggggagggatagcattaggagatatacctaatgttaaatgacgagttaatgggtgcggcacaccaacatggcacatgtatacatatgtaacaaacctgcacaatgtgcacatgtaccctaaaacttaaagtataaaaaaaattaatttgctatatctttctcagtgaatccttgttgctttatgttagtgcttctcaaactttaatgtgtatatgattggctagatcagctgaagatcatgttaagatgcagattctgatttggtgggtctggaatgggacctgatctgcatttcttagaagctcgcaggtgatgtcaatgctgttggtctgtggctcattctcagagtagtatggtttgggaatccactgcctcctaaaaaaaaaaaaaaatgagaacttttcctgtccccagtcttcatcacccctccatttatccgtaattcctgaaagacttctttaatgtataagtctcatctacaaattatcttagtcctagatgtaaatttatttgatccaggggtcctgaacacttttatggcaactaagttacttttactcctaaccttggactttaatcctcttttagaattttgtatctatttaaaaaattctacaaacatgctatgactgtaatgaaaaatttaaaacaaaaaagatcacatctaatattattatcctaacaatctgcttttagttttttctttcctttaattccttatgcgtattggtgcataatttttcctagttacaatgttaacatttgtcatttatgttgttattggtgaaaggcgtcaggcccccctttttttttgatgctgattaggtaagcttaatcagttactgtttattccagtgacaagaatactaaatcaaataaacaaagggatcttgaattgcagttagactaccaagacagaatcagaaacctagagatagtgatctaggaaagtcaatgcaccaaataaaaatacagaacaagaatgtgggagatcagattgacattgccaaactaaaatgaagaagagaggagagcagcagcaggcttgtgaagtcaagatcagaatccttggaagtcacataagagatacagggaagcaatttgttcaggctcatcaagtaaaaagaaagaccagaaagccttgcatcttaaccattttattcccagctttcctgttgcataaagcctgatattgtttattaatataatagtttttgaacacactgttgaatgttataataaaatatttcagagctatctagattctacacattaaatgagttcctgaaaagttctgttcagagaaaatttgatatggtattatttttccataaacttacactatacaaataaaatgatttacctccaaaaaatgtttggctctaagatatgataaaattatacttaagaatgtagcagaattttacaattatatgtttaaatgaaatacattcttatgataatgtaataatacgtacttgaggtgagttgcagaaatggcatgctagctgagtgagaatatcctgataatatagaaaaagagataggtacaatattgaagacctcatactcaataataattcctttctgggatagatctaaaaggttatcagccactgagaaataaaagcaaacatcaactgacccttgagattttaattaatcatgtttattcagatattcccatgtaacagccactatctgagctcagtattggtgattggtatcaccctagatctttctcttctcctgcttcaggttgaatatccctgtaatgtattttgtaggacattcgtattttttgttgtaatgaacattacattatgagtttattttcaggaatcatagttccagtctgtaggaagtgaaggtggtacagaatacacactcagttcctgaatcttcagtatagataagttttgttgaaatagataagtttgtaggttttttccctagagggattggttttagggttcttgagatgggaaaaggagttttttttttttttaattatttcaacttttattttagatacaagggacacatatgcagcctagttacatgggtatattgtaccctagtagtgagcatagtacccaataggtagtttttcaacccacatgcccttcacctctcccccctctactagtccgttgtctattattcccatgtttatgtccatgtgtgctcaatgtttagctcccatttataagtgagaacatgtggtatttggttttctgttcctgttttaatttgcttaggattatggcctccagttacatccatgttgctgcaaagaacatgacttcattctttttatgactgcatagtattccatggtatatatgtaccacatcttctttatccaatccaccattgagggacacctatgttgattccttgtctttgctattgtgaatagcacagtgatgaacatatgagtgcatgtgaggttttttttgtataatctgttttcctttgggtatatacccagtaatgggattgctgggtctaatggtagctctgttttaagttctctgaggaatctccaaactgctttccacagtggctgaactaatttacatttccattaatagtgtataaatgttcccttttcttgcagcctctccagcatctgttgttttctgactttttaataatagccattctgactggtgtgagatagtatctcattgtggttttgatttgcatttttcttgtgattagtgctgatgagcattttttcacatgtttgttggcagcttgtatatcttcttttgagaagcgtctgttcatgtcctttgcccattttttaatgaggctatttgttttttgcttgttgatttttttaaaaaatcacctttctgacaagcttgttgatttttttaaagttccttatagattctgggatattatacctttgttagatccatagtttgtgaatattttaatattcttttgatagattttttttatgctgtgcagaagctctttagtgtaattaagtctcacttgtcaatttttggttttgttgcaattgcttttggggacttaaccaaaaattatttgccaaggctaatgtcaagaagggtgtttcctaggtttttaaaggttggttgctcctggagaaagagttcaattttccttacctcattgtgtgcactgacattcattttatcaacaaaaattgtgcctagtgcaacatgttgtctagggtctggttgtagatacaagaaatataacaaacacacatttccctagtgaatttatagcctactataataaattaagcatatatatgcttgatcagttgagtaacaataaaattcagaatatgagaaatgtatggtataggcaaaaacagtatatgaattcagagagagtgaaagatcactgttagctctattagtcagggaatgcttgatggaggaggtggggtcttagaaatggataagatttgcataggtgaaggagtaggaattactagcaggaagatcagagtgagcacaaggcaggtgtggggacaataatttagtccaataaagtatttagtatcgtttatgcaaagggtaccatgtggaaaacataggcaccacttgcaaagaatttacaagtcttactggaaagagagtatatgtaaagataataatataagacagcacatggaaaatggggataagtgacaaattggtataggaattcagaagaagcctagaccatcatggactaggaacatccgaaagtcttatttgaaggtgaggtttgagctggcctttgatggtagggtaggatttagaatagtggaaaggaagagttaggacacctgtggtagggactatagcataagtagatatggggacaacatggtctatttagaatatgatgactaatgaatccgagaggatttagcataagttttatataaggagtataatgaaatataaagttagagaagtaaattggagtcatttattaaattccttgatactgggttaaaggactatatgatataggcaaatggggacccactgaaggtttccaaataggatagtgacatgctaatagcaataatatgcaagaatttgagagatagggagattaattgagttgttgtaagtagctcaaatatgaagtaataagagcctgaaactaggttgatagcagtggaaattcattctttcacgtttgagttcctacaatgtaccagtcattttgttgctaggcattgaagatgcagagataaaataatatgcatgtccctggtggtctcaaggatatcactacttaatggggaagataagctcaaaattatgaaacaaatacaatcacagaatatttttataccataaaagggggggttagaggataatttatgaagacaaaactattctacttcttgcctacctatttggcattagaattaatacagttttgactgacttgccagctgcacactatccttaggacctatctttttttatatatactttaagttctagggtacatatgcacaaagtgcaggtttgttacatatgtatacatgcgccatgatggtgtgctgcacccattaactcgtcatttacattaggtatatctcctaatgctatccctccccctcctcccaccccacaacaggccccagtgtgtgatgttccccttcctgtgtccaagtgttctcattgttcaattcccacctatgagtgagaatatgcagtgtttgattttttgaccttgcaatagtttgctgagaatgatggtttccagcttcatctttgtccctacaaaggacatgaacccatccttttttatggctgcatagtattccatggtgtatatgtgccacattttcttaatccagtctatcattgatggacatttgggttggttccaagtctttcctattgtgaatagtgccgcaataaacatatgtgtgcatgtgtctttatagcagcatgatttataatcctttgggtatatacccggtaatgggatggctgggtcaaatggtatttctagttctagatccttgaggaatcaccacactgtcttccacaatggttgaactagtttagagtcccaccagcagtgtaaaagtgttcctattttttcacatcctcaccagcacctgttgtttcctgactttttaatgatgccattctaactggtgtgagatggtatctcattgtggttttgatttgtatttctctgatggccagtgatgatgagcatttttcatgtgtcttttggctgcataaatgtcttcttttgagaagtgtctgctcatatcctttgcccactttttgatggggttgtttgtttttttcttgtaaatttgtttgagttctttgtagattctggatattagccctttgtcagatgagtagattgcaaatattttctcccattctgtaggttgcctgttcactctgatggtagtttcttttgctgtgcagaagctctttagtttaattagatcccatttgtcacttttggcttttgttgccattgcttttgcataggaagaatcaatattgtgaaaatagccatactgcccaaggtaatttatagattcaatgccatccccatcaagctaccagtgactttcttcacagaattggaaaaaactactttaaagttcatatggaaccaaaaaagggcctgcattgccaagacaatcctaagccaaaagaacaaagctggaggcatcacgctacctgacttcaaactatactacaaggctatagtaaccaaaacagcatggtactggtaccaaaacagagatatagaccaatggaacagaacagaggcctcagaaataataccacacatctacagccatctgatctttgacaaacctgacaaaaacaagcaatggagaaaggattccctatttaataaatggtgctgggaaaactggctagccatatgtagaaagctgaaactggatcccttccttacaccttatactaaaattaattcaagatgtattaaagacttaaatgttagacctaaaaccataaaaaccctagaagaaaacctaggcaataccattcaggacataggcatgggcaaggacttcatgtctaaaggacctatcttttttttttaaacatttcctagtaaagccataagtcatacaaattagcacttgtcataaacgataaaagtaaggaatgtttctctcagattccagaataggaaatggaaagaagtgatggaagtgaaagacattatgatggaagaataaagaagatatgtaactgggtataggaggtggggaacagggagacagaagaggatagatagatggcaacagactcaagatgatgcagtgtcctggaggagctggtataaatagtatagaatgtatgtatacaatgtacttgaacagtaaagaatgaagattgagaaaaagaataatgatttcgagtactggactcagtagtaacttcaaacatctttataatagctatcattcactgaattcttactttgtaccagacactattctaagggcttttaatttaatatattatttaacctttcacaaatacactgtgaggtaggtactattagcatcttccacattatacagatggggagtatattagtccattctcgcactgctataaagaaatacttgaggctgggtaatttataaagaaaagaggcttaattggctcacggttccacagactgtacaggaagtgtggcagcatccgtttctggggagacctcagggaacttttactcatggcagaaggcaaagcaaaagcaggcatcttacatggcagaacaggagagagagagagagagagagacagagacagagagggagagagagagagagagagagataccacacactttgaaatgaccagatctcgtgagaactccatcatgagaatagcaccaaagggatggtgctaaaccattcatgaaggatccacctccatgattcaatcacctcccactaggcccgacctccaacactggagactacaatcgaacgtgagatttgggtgaggacacatgtccaaaccataccagggaagttaagaaacttgaccaaggtcacagagctagtaagtagtggagcaaggatccaaacccaggctggcaagtttcagaacctgtactcttaattgcagtgcgatacatatggcctatctaaagcaaatgtagaacagacaggagaaatgcgagagataaatgagatgttaggaattagagatagctgtagtagatcacctatctgtttggaatattttggcagtaaattggaaagaaaggataaaaatggtagagggacaaatgggaaaatccaaccccactaacaccagtataggggagattgtgcatgtccaaggcagaggaaaagtatcctatatggagggaggtatccagagggctaaaaagaaggtgtaattgagaaagttcaagctcctaatatataacggaagtagtatactgatagggagagggcactagctctaggatcagtaggcctggtttcaaatcctagcaattctctttactagctggcaggttgcttgtgcctcactttcctcatctgcagttttcttatatgtaacatgagatatgatattataacactttctagggttgttgtcagattacaagagattatgtacataaaatatgtagaagttataaactatgataggtattcactaattattaacttttttgattattatttgttgagaggcaatattgtgtagtggtcatgagtatgctgcttagatctgaatccttgttccaccattagccagctgtatgactttaggtaagtttttaacttctttgtgcctcagtttcctcattttaaaaatagagatatcaaagtacctacttcataaggttgctgtgaggactaaatgtattaatatctgcaaagtgttagaattgtgcctgatgcataataagcactatataaagtttgccactatataaagtttgctactactatgatttggggagcccttcatacgtagtggacaataaaccttgtctgttatatgtattgcaaatatcttcccctttctgtcttttaccctacagaggtcttaaaatttggtgaggatgttgagtgaaaaaaaaggccaatctcaaaaggtgacattacaggaatctatgtaacattcttgaaacaacaaaattatagagatggacgacagattaatggttgccaggaattagggatggtggggagaaggagagaagtagatgtgactgtaacagggtagcatgagggatatctttgtggtgataagacagttcttgtttgccatggtagttgcatgaatcttcatgtgtgacaaaatgacatagaactatatgcaggcaaacatctcagagatatgcatttggttccagaacactgcaataaagcaagtattgcaataaagtgagtcacacaattttttttatttctcagtgcatgtaaaagttaggttactatatactgtagtctattaagtatgcaatagcataatgtcttaaaaaccaaatgtgcatactttaattttaaaatacgttattgctaaaaaaaaataataatctgagccttcagtgagttgtaatctttgtgctaatgaagggtcttgtcttgatgttgttggctgcggactgatcaggatgatggttgctgaagttggggtggctatggcaattgcttaaaataagtcaacagtgaagtttaccacattgattgactcttcctttaatcaaatatttctgtgcagcatgttgtgctgtttgttagcatttcacccacagtagaacttcttgcaaaattggagtcaattccctcaaaccctgccactgctttatcaactaaatattataatatactaaatcctgtgttgtctttcaacaatgtacacggcatcttcaccagaagtagattctatctcaagaaaccactttctttattcatccataagaagcaacttctcatccattcaagtcttatcatgagattacagcaattcaatcatatcttcaggccccagttctaattctatttctcttgctatttccgccacatctgcagttacttcctccactgaagtcttgaacccctccaagtcatccttgacgactggagtcaacttcttccaaactcctgttaaatgttgatattttgaccttcttccatcaatcacaagtgtttctaatggcatctagaatggtgaatactttccagaatgttttcaatgtactttgtccagatccatgagaggaataactatctatgcagctatagccttgcaaaatgtatttcttaaataacaagacttgaaagtctaaattactccttgatccatggatgttgtattagcaggcatgaaaacaacattaatctccctctgcatctcccttagaactcttgggtgaccagatgcattgtcaacgagcagtaatcttttcttctgagcaatggttctcaacagagggtttaaactattcagtgagccatgctgttaacagatgtgctatcatccaggctttgttgttccatttatagagcacaggcagagaagatttagcataattcttaagggccctgggatttttggaatggtaaataagcattggtttcaacttaaagccaccagctgcattagtctctaacaagagagtgagcctgacctttcaagctttgaagccaggtattgacttctctctagctataaagttctagatggcatcttcttccaatgtaagaatgtttcatctatgttgaaaatttattatttagtgtagccaccttcatcagtgatcttagatcttctggataacttgccgcagcttcttcatcagaacttgctgctttgcattgtgcttttatgttacggagacagcttctttccttaaaccacaagaacgaacctctggtagcttcaaattttgcttctgaagcttcctcacctctctaggccttcatagaatgaagagagttaggacgttgctctggattaggctttggctcaagaacgtgctgtggctggggttgatcttctatccagaccactaaaactttgtccatattagcaataaggctgttttgcttttttatcatttttgtgttcactggagtagtacttttaattgccttcaagaactttttgtttgcagtcgcaatttggctgtttggcacaagaggcctagctttcggcctagcttggctttcaacatgccttcctcaccaagcttaatcatcactggcttttgatttaaaatgagagatatgtgaatattccttgtacttgaacacttagaggccattgtagggttattaattggcctagtttcagtattgctgtgtctcagggaataggggtgcccaaggaaagggagagagatggggaataattagtcaatgaagcagttagaacacacacatttgggcttagtttatggtaccccaaaacaattacaatgttgacatcaaagatcactggttacagttataataataatgaaaaaaattgaaatattgcgagaattacttaaatgtgacagagagacacaaatagagtgcatgctgttggaaaaatggtacctgtagacttgacttgcttgattcagggttgccacacatcttcaatttgtaaaacaaacaaacagaacagtatctggtggcacgtgcttatagttctaactactcgggaggctgagactactcaggaggcttgagccaggagatcaagacggcagtgagctatgatcacagcacttcactccagcctgggtgacagagtgagaccctgtttcaaaaacaaacaaacaaacaaacaaaaaactagtaactgtaaagtacaataaagagaagtgcaataaaatgaagtatgcctgttcacacatcgtaccaatgctgtttcctgctttgatattgttctatagttatataagatttaactataggaggaaactgggtgagggtacatgggatttccttatacattttttttttgcaatttcctgtggatctatagttatttcaaaggtaaaagttaacaaagttttgatgaaattaaattgtcagccttctttttttatgacttgtggattttgtgtcatgcctagaaaggccttttgtaaaccaagatgataaaaggtatctcaagcaacaatctattagaaaatgatgatgatgatgatgatgatgatgaccataaacagatccagtgcatggtgacaaacagtttaaaggcttttatcgtttgttttctacatttactttctttcctcatgggtcactttgttcattttggtgcttctctttaaggttgttcattttcttcaaatgtctagtttcttcagatgatcttgattctcttcatatttttaaaagaaaagatctgctaccaatagtttgtggtttgatcctttgacatcctttggaataacttcccacatgagtgttccggctagccgcgggtgtctccactctgtcatgtagacaggtgggatttcgttgggtctttgggttatctattgttgtgtagcaaaccaccctaagatttagcagtttgaatcactagtttattattatctcatggtgctgtgggttgattgggctcaacttaggtggttattgcctggagtcttacatggttgcagtcagatagtggctggtgttagagtcatctaaattttagattctaaaggcttggatgggctgaacactctatgttttcttcactcatgtgtctgttgtctaggctggaagtcactggatgctacccagacatctctgtctctttcttcatgtgtctaggttagaattcctcccagtgttacatcctcagggtagttggacttcttactgatgattagcttcatccaaagttccaagagaccaggcagatactgcaaggcttatgtcttattagaagtcatgcattgttaaaagcaagtcacagagccagtctagattcaaggggagaggactacaagggcatgaatactaggaagcataatttattgggagtacatctttagagactagttattacagtgggctagagacactagcccccacctccatcttgatatgcaaagtaggaaattagttctcttgccatataaggattttcactactgtgctgattgattttcctctttactccttttctcatatctacagtcttcctgtcccttatgctcaagctgggaggttcccataactgatcccttaaatcatttagaaggtttgacagcagagcctggggtcaaacatcaatggcctctactccttgcatgcacaacagagaattggaatagtttctgcagttcctctaggatcatcacaaatttttcctgtcccctactaattaatttctaattttgtggagtttcctagggtgttttttttttttgctggggggaacctatctatttcttcaatggcctcctttttggcttctgttgggtttcaggattctcacctcttgatttttccatcagtctgattgcttttaattatagaaattctttaaagtttcttaccaaagacaatatattttcctgctctctggctctactatagatttattcttacattcattctatttttttgaggtaaataactgtactcaatctgctgttttaaactgaaggttagatagatggaataaaatctagcattcagtagcacaatagggtgactatagttagtaataatttattgtatatttcaaaacaactaaaagtgaaattgggacattcacaacaaaaagaaatgataaatgcttgaggtggtgggtatcccaattaccctgaattgatcattacacactgtatgcttgtgtcaaactattgtatgtaccccataagtgtgtacatactatgtacttataaaaatgtacatattatttacttataataataaaaaataaaaataaaatgtaaatctaaacaagcttcttcagaaataaataaataaaaattaactattcatccagtatagaataattttaaaatgtggactttggcgtcagattacatgttttcaagttcttgttcctccactttgcagatgcttaaccttatgcaaattatttaaactatatatgcttcagtttactattcatgaatagtacttacctgttggggttttctgaagattaaataaggaatgtaaaattcctggcatatgataagcattcaacactttagctgttatcatttctggaaaagtattagaactaatacaataaacataatatttcattccaagttgagctgtatgtctgtggaatagaattcaaatccatcattttacataaggttagtattcctggacaagatcatgctgcatttagcttctttagcagttttatcagcacttgtgagctatgtctaagagtaaattgcaagacagttttactaacactgagcccatttacaggcattaaagtgatgattgctaaaacaccatttagcatgagcagtgagtatatgttagcaagaggtgacatgtggtatattggaacgagtccttgctactaactaaatgaccatgcgacctcagacaagtcatttagcttctcagggccagtgacaagcagaataatgtccccaaaggggcttccatgccctaatctctggggctgtgagtatgttaccttacatggcaaaattgattctgaatatgtaattaaagtcactaaccagttgaatttaaaatagggagatcatcctggattatctaggtagccccagtataaccacacaagctcttaaaagcagaagaggaatacagaaaaagtagtcagatagattcaaagcacaagaagtatttagcacaccattactggctctgaagagagaatgaaccataagccaaggaatacaagtggcctctaggagctgacacaaatcccagccaacagccagcaaggaaatgggacctcagccctagaatctcacagaactgaatttcgtcaatagcctgaatgagcctagaaatgtattctcccccaaagcctccatataagagcccaggatggccagtatcttgcctttggccttgtgtgagcctaagcctgaatggatttctgagctacaaaattgggaaataataagtgagtattttggggtttttttgttgtttgtttgtttgttcgtttgtttttgagatagagtcttgctctggcacctaggctggagtgcagtggcgtgatctctgctcactgcagccttgacttcctgggctcaggtgacccttccacctcagccttctgagtagctgggactacaggcgcacaccaccatacctagctattttttaattttttttgtagagacagggtctcactgtgttgcccaggctggtcttgagctcctgggctcaagcgatcctcctgtcttggcctcccaaattgttagaattacagacatgagccatccacctggtgagttttgttttaaatcactaagtttgtggcaatgttttacaacagcaatagaaaactaatatgaggccttagttccttttgtaaatgatggggtaggaggcagtgtggaggaagtcagaataaatgaactttaaggttccttctagctctaaattctgtgattgcaagattcttattcagctgctagtttgtgagctaaagtccagcaaccataagtagtatggacacacacacacgtacacacacatatatacgtgagcactttcaaggatacatatgaatatggcaaagctaaagttttaggggactccatagtggcagatcaaccagatagatattggagtgggttttgcaactgcaaagcaaatggttgcaaccagggttaaggtttttcaggtagatcctgaaactaagaatcaatgaaaaagtgactttatatgtgcacagttttcataccctgaaatggaaaaatgatcattattattaaactagaaggtcagtggtgtctgtatttgcgttataacaatttacagttcttattcttttaaagaatcaattatgtaccccatatttctaatacatagtgaattctcacaatttgctatatttggcaaacatactctttgttttctatgaaactaactccaaggagctgagattccagtaaaacctggaaatgaatagtatattccttagagatgtaaacctctttagagcaatctccagggttctctatgcaagttgacactaaatttataatgataattctagctggccttcccacccacctctagcaattatgcaaagaaatgcccaattttatgttatattgttgttttttaaaacagctttatgaaggtgtaatcaacctacagttaaatgcatatatttggaataagtgtacaataagctttgattacacatacatacttatgaacccattatcgcaatcaggataataaacatatttaccacccccaaaaggttccttgtggtcttttgtaatctctccctacctctccttcatcagacagccattgatcactgaatgtcactatagcttcatttgtattttctagatttttatataaatgaaattgagtatactttttagtctggcttctttaactcagtatgattccctgaggtccacctatgttgttgcatatatctgtatagtttatacttttttattgctgagtagtagtctgttgtatggatagcctacaatttgtttatctattcagctgttcatagacattttgattgttttcagttttaggacattacaaataaagctgctgtgagcattcacgtgtgtctctttgtatggacatttgctttcatttcttttggtaaatacatagaagtgaaaagtctggtttggatggtaggtagtgctatggtttggatatggtttgtccccagcaaaattcatgtttaaatttgttctccaatgtggcagtgttaggacttgggaggtgtttgggtcatggaggtcatgaataacttggggctgttcttgcagtagtgagtgagttctcgtttcaagaggctggatgagtccttacagggatgaatcagttctgaggagagtgggttgttataaagccaggatatcacttgggttttgcctctttgctcctatccgcttcccctttgaactttctccaccaagttatgatgtagcacaaaagccctcattagaagtcagggccacgctatcatactaaaactgtgagctaaataaacttttctttataaattacacagtcttaggtattctgttacagcaacacaaaatagactaatacagtgctatgtatttaaattttcaagaaattgccaagcttttccaaagtagttacaacattcatttaacattcctaccagcagtgtttgagagtttcagtttctccacatcctgacccacatttggtatagtcagccttttaaataggtatgatgtctcattgtggctttaatttgcacttttataatgactaataatgttgagcatttttttcatttgcttttcatgtgtgtatccctttttgtgaaatgcctgttaaaatcttttgccctgttttgtttgtttgttttgttttgttttgttttaagtattgagttagaaactcctttcaggccaggcacggtggctcacgcttgtaatagcagcactttgggaggccaacgtgggcagatcacgaggtcaagaggttgagaccatcctggccaacgtggtgaaacctcgtctgtactaaaaatacaaaaattagctgggcatggtggtgtgcgccagtagtcccagctactcaggaggctgaggcaggagaatcacttgaacccgggaggtggaggttgcagtgagccaagatcgcaccactgcactccagcctggcaacagagtgagactccatctcacaaaaaagaaaagaaaagaaaaatgaagctcctttcaatatttggggttttttttaacttttattttaggttcagaagtacatgtgcaggtttgttatacaggaaaacttcctttcaatattttgtaaacaagatcctttttcaactttattgaagtataattgaaaaattgtatacagtcaaggtgaacaatatattttgatatatgcatacattgtgaaatgattaccacaatgaggctaattaacatatccatcacctcacatagttacttctttgtgtggtaagaatacttaagatccactctcttagcaaatttcagtacataatatattattgttaactatagtcaccatgctgtacattaggtcaccagaacctattcatcttgcataactgcaagtttgtaccctttaactaaaatcttcctacccacccctcaccccagccctgccactactgcccttggtgaccaccattctaccttgtttcaatgagtctgactttttgagagaccacatataagtgaaatcatgcagtatttgttgttctgtgtctggcttatttaacttaacataacatccctacaagttcatccatgtttttgtaaatgagggaatttctttctttttaaggatgaataatattccattgtatataaatatataccacattttttaaaccattaaccactaatcatcaaggaaatacaaatcaaaaccacatgagatatcacctcacacctattaggatagatactttttttaagaaaagataacaagtgttggcaaggatgtagaaaagttggaatttttttttttgagatggagttttgctcttgttgcccaggctggagtgcaatggtgcaatctctgctcactgcaatctccttctcctgggttcaagtgattctcctgcctcagcctcccaagtagctgggattacaggcgtgcaccaccatgcccagctaatttttttgtatttagtagatacggggtttcaccatgttattcaggctggtcttgaactcctgacctcaggtaatccacctcggcctcccaaagtgctgggattacaggcgtgtgccactgcaccctgccagaagttggaatttttgtacagtgctggtgggaatgtaaaatggtagaacccctgtggaaaacagtatggcagtttctcaaaaaattaaagatagaactaccatatgatccaggaattctacttttgggtatataccccaaagaactgaaagtaggatctgaaagagatatcttcactcccatgttgattacagcattattcatattcactaaaatgtggaaggcaacccaagtgtctattagtggatgaatgggtaagcaaaatgtgatatatatatatatacatatatatatacacacacgcaaacgtatacagatacatatatatgatggaatgttattcaaccttaaaaagaaggaaatcccactatttgtgacagcatggatgaaccttgaggacattttgttaagtgaaataagctagtcacaagacaaatactgtgtgattccacttctgtgaggtatctaaaatagtaaaactaatagaaacagaatagaatggtggttactaggggctgggaggtgggggagagggggtattgttgctcaatacgtataaagtttcagttacacgatatgaaaaagttctagagatctgtacaatgtagtgcctgcagctaacaataaagtattgtgcactcaaaattgtgttaagagggtagatatcatgttaagaattcttacaccaaaaaacaaaagaaaaaaagcacagagacccaagggagcttttggaggtgacggatatatttattacattgattgtggtgatatcttgagtgtgcacatatgtcaaactcatcaaattgtatacattaaacatgtgcagtgtttattgtatattaactataccacaataaaaataaaaaatatagccactcctacttttgattaatggtttcatggtatatttttttccaaacttttattttcaaccctcctatatcagtttttttgaagtaagtttcttgtacacactctacagttaggacatgtttgggactttcccctacctttttgagatataattgacaattaaaaattgtgtatatttaatgtgatgttttgatatacctacatattgtgaaatgattaccacaaccaagctaattaacatatccacttcatggttacctttttttatagagaggatacttgagatctgttcttagcaaatttcaagtatataatacattattattaactatagtcgccatgctgtacattaagtctccagaacttaatcaatttttaacttaaagtgtatatcctttgaccagcatctcccccattcccccacccaatgaaactctggtaaccaccattctattatctattactatgagtttaaacttttttttagccttcacatattagtgagatcatgtagtatttgtttttccgtgtctgacatatttcacttagcatagtgtcctccgcgtttattcactttgttgcacatcacaggcttctttcatttgaaggctgaataatattccattgtatgtatatacatcacattttacttatccattcatctgtcaatggacacttgggttacttccacattttagcacatgtgaataatgctatgaatatgagtgcacaaatatctgttcgagaccctgctttcaattattttggatatgtacccagaagtgatattgctgtgtcatatggtagttctatttttaattttttttgagaaactgccatattattttccatagtggctgtaccattttacattcccaccagcagtgcacaagagttccaatttcttcacatcctcaccaacacttatcttttgactttttcacaatagccatcctaacaggtagttttcatttgcatctccctgatggttggtgattttgagcatctttttaatatcttttggctatttgtatgttttctttgggaaaatgtctgtacaagttctttgcagatttttaaatcaggttgtttgatttttttccccttgagttaaatgagttccttacaattttagatattagcctcttattggatatatggtttgcaaatattttcttccattctgtaagttgccttttgattttgctgattgttttcttggtgtatttttttttagtctatgctgccaatttctttcttttaattggcatatttagaccatttacattatttgtaattattgatgtgttacagcttaagcttgccacttaaatttttattttctgatctatatacacttttaaaacctttttaaaaatatttatttattagagacagggcctcactcttagcacccaggctggagtgcaattgtagctcactgtaacctcagactcctggactcaagtgatcttcctgcctcagcctcctgagtagccaggaccctaggcacacaccaccacactcagctaattttctttttctttttaatttttttgtagagacagggtgtcttactatgttgcccaggctcgtcccgaacttctggcctcaactgatcctcctgtcttggcctcccaaggcacggaaattacaggcgtgaaccattatacctaacctctgctttatattttagtttacttttagttttacagaaaaattgggaagatagtacaaagagttgccatatacactctacacagtttcccctagtattgccatcttatatagtacctttgtcataagtaatggaccaatattgatacatcattattattaacctaaaatcaatggttaattccaatttcctttgttgttacctaatatcctttttctattccagaatcttacctgtgatatcacattacatttagttgtcatatctccttggacttcatttggccatagtagtttcttagatatatttttctttttgatgattttgacagtcttgagactacccatcaagtattttgtaggatacctatgtattagattttttctgatatttttctcatgattagactggggttatgggtttggggaggaagatcactcagataaagtaccattttcattacatcgttatcaagggtatatactgtcaatatgatttatgtatgttgatattagccttgattagttggctgagtattcatcaagtgtttacaccttgaagttatccatttttcctttttacatactatattctttgcagttgtggagttatgctcccctgcttaaaggcatacttatctagataaattattttgaattcttctacatgggaaatttgtctcttctccctaattcgttaatttgttcaaccatttttatatcaatacggacttgggaatatgtattttattctttaggttataattcaatactacatttttgttgttcagattgttttagctttggccattgggagctcttttaattgactcctgcacccttttgacataccccaatcagtgtgggtggttttgttttttataagcaattcctttctttctgacaacacagaatgttctaggttcatcttgcacatttcttgccccaatcctggaatcaaccatttctcctaggaggtctagttcctctcactggcaaagtatattagtaaccaagatctgaatgttagttgtgcttgttgctactggggtgtcatttcttctaggccttattagttgacggagcaaagaaaatatatgtgtgtatactaatctgagtatatagacatatatatataaatattttggtatgtaaacatctgtatctatattaagttaaacgtaagttattactgatgtttcctattctaattcattagcacttagatcattctagccttgcttgcagattacccttgcttatctgttcccaatccaacagtgggaaacctggctcttaccatccatcattcatttacttaattttttaattgttcaattttagtatacatgtaaagcagtatcagaattgttcacctgtaccctcatgagaaacaactttgtcaactagagtacagtgcttatgtgcagttctttttgcctttattcttacagactctacttatttccagagttacttaggtcagtatctagtcctcctatttcctttagtgaagttgttccacacatttgttagagtctcttgtcacagtctctattatatctgaggattcccccaacctcccaaattatatatatatatataaaatatcaaattatatataatatatataatacctagttatatataactatatatataatttgtatgcattgagattgacttgttgtgtggtaaagtcctgtggattttgacatgcataatgacacgtatctgctattatagtatcacacgtagtattttcaccatcctaaaaatcctctgtgcctcatctcttcatcttcctgagatgctggcaaccacatcttttcactctctatttttcttactggctcttctttttgcttttgtgccatttctgcaatgtcacataattggaatcattcagtatgtagtctttttagattggcttcttccacttagcaatatgaatttcaggttcctctatgtcttttttgtgactgatagctcatctctttgtttatctatttacctattggaggacatcttggttgcttcctgtgtttggtgattatcaataaagttgctgtaaacattcacgggaagatttttgagtagatctaagttttcaaatcaagtgggtaaattcctagcagtgaaatggctcctgtaggtaaggtatcatttctctttctgtgcattcaagatttttttctttgtcttaggatggaatttgactatgacatgtcttaggatggaatttctttggatttatcatgtttggagtttgcaccgctctttgaatctctaggtttatgttttttcccaaatatttgagacattatttctttgaatatttatttgttctgccctacctttcttctcctcttccagggttctgatgacataatgtacattttttgttgtcttacacgtcgctgaggctccatgcagtttttttttcagtctgttttctctctgttgttcagatgaggtaatttctacttttttatttttccttctccttccttccttccttccttttctttctttttcttcctttctttcctttctttcttttctttgaaacaaggtctcactctgttgcccaggctggagtgcagtggtataatcatagctcactgcagcctcaaacacatggactcaagcagtcctcccacttcagcctgccaaatagctgggattacaggcaccaaccactgcacataactctactttatttcaaattcacttattctttcctttgtcctctccattctgctgtaagctcatctgttgagttatttttaagattttggttattgtatatactagttttctgagtattgtaacaaattaccacagatgggatgacttaaaacaacagaaatttattctctcacaattttggaggccagaagtccaaaatcaaggtatttgttggctttttttttttagattaaaaagacttagatattttaatcaattgaaatgtatgaatcttattcagatcctgagtcaaacacttaaaatcaataatgtatgagacagttacataaatgtgaacagtaattaaatacttaagaatattgaggatatcttgttaagttttaaactgtaatgatagtattatgtttatgatttttacaaaaaatagtttctatctttaagagatagataattaaaatacttggaagtggattaataggatgtcttgaatttacttcaaaagcatgagtgtgtgtgtgtgtctgtgtgtgtgtctctgtgtgtgaatgaggtggaaagatgggttaaataaaattggctttgatgttgttacagcctgataataatgatgtgtaggttcattacattattttctccactttggtatatatttgaaatttgtgtagcagagagttaaggaaatacttattgattcaaagtaaaccgatctaatcataacccttgcaaatggatgtctacctatgtataaataaggtacttctttttttaaaactatgggtctctttttattaaggcgagatctcttgcaactggtgtttcatgaatagagttgccagataaaatacaagactcggttaatttgaaatttcagataaacaatgtctagtattttagaataagcacatcccagctattgcactggacacactaatactaaaaaaataatttttgtttatctgaaattctaattttactggggcattctgtattttttttttttttttactttaagttctggatacatgtgcagaacgtgcaggtttgttacataggtatatgtgtgccatggtggtttgctgcacctatcaacctgtcacctaggttttaagccccacatgcattagctatttgtcttgatgctctccttcccctcaccctcacctcccgacaggctccagagtgtgttgttcctttccctgtctccatatgttctcattgttcaactcccacttatgagtgagaacatgtggtgtttggttttctgttcctgtgttagtttgctgagatgatggcttgcagcttaatccatgtccctgcaaaagacatgatctcattcatttttatggctgcgtagtattccatggtgtatatgtaccacattttctttatccagtctatcattgatgggcatttgggttggttccatgtctttgctgttgtgaatagtgctgcaataaacatacgtgtgcatatatctttataatagaatgatttatattccttgggtatatacccagtaatgggattgctgggtcaaatggtatttctgattttagatccttgaagaatcaccacactgtcttccacaatggttgaacaaaagctgaaattgacaaatggggtataattaaactgaagagcttctgcacagcaaaagaaactatcatcagagtgagcaggcaacctacagaatgagaaaaaatttttgcaatctacccatctgacaaaggtctaatatccagaatttacaaagaatttaaatttacaagaaaaaaaaaaccttgtcaaaaagtgggcaatgaatatgaacagacacttctgaaaagaagacatttatgtggccaacaaacatatggaaaaaagctcagcattactgatcattagagaaatgcaaatcaaaaccacaattagataccatctcacaccagtcagaatggcaattattaaaaagtcaaaaaacaacagatgctggcgaggctatggagaaataggaacacttacactgttgatgggaatgtaaattagtttgacttttcattttattgaagttttctttgcagtgcagaagctttttagtttgacatagtcccatttgtttgtttttgctttaaaaattttttttgcctttgcttttggtgttctatacaaaaaaatccttaccaaggccaatttcaaagagcttcttccctatttttttcttttaggagttctacagtttcaagtattacatttaagtttttaatgcactttctgttgatttgtgtgtgtgctgtaggatgtgttcaatttattcttttgcaggtggatgtccagttgtccaaacacatttttttttgagacagagtctcactccaacacccaagctagagtgtggtggcatgatcttggctcactgcaacctgtgtctcctgggttcaagtgattcttgtgcctcagccctccccgcatagctggaattacaggcatgtgccaccacatccagctaatttttgtatttttagtagagatggggttttgccacattggccaggctggtctcaaactcctggcctcaagcgatccaccaacctcggccttctgaagtgctgggattacaggagtgagccactgcacccagcccaagcacaaaagagactgtgctttttccattgtgtattttgggcacctttgtcaaatactagttggctatatatacttggttttttggggtttttttctgggctctcgattctgttccattggtctatgtgtctgtttttatgccagtaccatactgctttgattactatagctttgtagtataatttgaaatcagaaagcgtgatgcctccaattttgtttttgtttttaaggttgctttggcacagagtcttttgtggttccatacaaattttaatattagcttttctatttctgtgaaaaatgccattggacttaagatagggatttccttgcatttgtagatcactttgagtagtgtggacattttaataatactaattctttcaatcaatgaacacaggatatctattttatttttgttttcttcaatttcatcaatgttttttagttttcagtgtacagatgtttcacctacttggttacttttattcatatatatttgagatggagtctcactcactctgtcacccaggctggagatctcggctcactgcaacctccacctcctgggttcaagtgattctcctgcctcagcctcctgagtagctgagattacaggcatgcaccaccatgcccagttaatttttgcatttttagcagagacagggtttcaccatgttggccagtctggtctcgaactcctgacctcaagtgatccaccctcctcagcctctcaaagtgctggaattacaggcatgagccactgtgcccaactattttatatatttttgatgctattgtaaataggattgttttcttgatttcctttttggatattttattgttggcacaaagaaacgcttctgggttttgtatgttgattttgtaacctgcaactttactgaagtaatttattagttcttagagttctttggtggagtctttagagtcttccgtatataggatcacttggtcccatggaaacagttttttagctcttccatttgggtctttgatccattttgaattaatttttgtatatgatatgagataagaatccaatttcattcatttgcatgtggaaatcccgttttcctagcaccatttgctgaaaggactgtcctatcaccatttgctgaaaggactgtcctatcaccattaaatggtcctggcacctttgtcacaaataatttgatgatatataacaagatttatttctgcgttctctattccattccattggtctatatgtctatctttatgccagttccacacattttcattactatggctttgtaataagttttgaaatcagaaagtacaaatcctctaattttgctctttgttttcaagtttgtttagggcttttggggtcccttgagcaaagtccatattaattttaggatggattttttccatttctgcaaaacacatcattgggattttggggtttttttcagacagggcctcagtctgtcgcccaggctggagtgcagtagcccgatcacagcccactgcagccttgacctcccagggtcaggcagtcctcccacttcagccttgctagtagctgagactacaagcatgcgccatcacagctgccaattttttgtagagacaggcttttgccatcttgcccaagctagtctcaaactcctaggctcaagcagtctgcccacctcagcctctcaaagtgctgggattacaggcgtgaaccaccacacctggcctgggattttaatagggataaatatctgcaaatctgtagatcactttgggaatatcaacacattaacaatatttagtcttccaacccgtgaactgtttacatttttaaatagaagatactagtgtattatttgtgtaatcaaacataaacaagtttttagaaagaggttttggccgaggaactagtaaatttctcatgtcttttcatgtaacttcactggatctcggtaaccaatttttaaagcttgcaatcagttctgggaaaaacataaattagatattaggagagaaatgattatctgactataggtgttaatagaaaatgtttatggcttaataaactgaaattaaattaaatcatgtaatattgacaaattaagcttatttagacatttaataacattacctgagttcagatatgcttttatctggcttattttgctcacactgaaatacattttagtcccattgatcaataaccagtttttctgttcgcattgcttaaaattgtgtctcattgtacagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttaggtcagtaggattttcgcaagtgttttagaaacgtattaatttgtgtataattcttagatgtcagagtaatagcaaaatcctcaagtcaatggatttcttccacttcctttttttcttcctccctaatggtcttttaacagtaacacctcacctgtccacatcccacaaattgggcaagtggaatgagaaactaagcaaaaataagaaaccatcattgaaaacagacaaacttctgagcttaaagctcacatgtggtggaatattgtgaggttacaagcctaatttaatatctctagtttgatctcaatttagctgtgtacctttgaacaagtcaaaggaccttgatttttttttcaactataaaatgatgattgtgaactaaactcctggtttctaacttcttttcagcagcagcatccttttgtgatgcaatcttatatgaaccccaccctgaatgaaatagattagagtttttctggttaaagcagagatgtagagccaaatctgctcagcattcccctaatcctctgcctccctgcagaacttctgtaccctgaagaacacagatagtaagatccctttcttagaaaattctcttcaccacttcgtccttccaactaagtgcatgtagagatataattggagtgatagtcactaaatgttaactctggggtttattctgaatggtggcattttaggtgacgtgttgctttcttctaaatactctaccatattgtttgaatttttataagcacaattcatgtttctataaaaacaaagtcattaattttttaaaggaagtcatctgagtagatgatctctaagagccatattttactgataacaccctccctccaggcatttaccaattatttttagacccagttttgataaacttggttatccggttttcctactcttaacattttgatggtagcactttgcaaatagagaaaaggtttaaagggaagtatacagatagcctgaccatagggaggaaaaaaaactctaccaattttataaaacagattcaaatttttaatacaacaatctgtactgtataacaactcccaaaggcatcactgtgatatattaatagtacaataaaataaaatagttgttaatgttgacctcaagtggtcaagaaaaagttgaattatgcttaagaaaactaggaagtttgtttactttttagaaaatttaagaactttcatgaaaatattcagactttttaaattcagaagtgatttttatttaaagaaagtaaactgccagttgaccagaaaacttgattacacagaattactcattttcctaaaattccacttagactgttctattatgacatctaagttacacttacactctcaaagtattataatatttcaagtagatacatttagtagctgtttactctcatgtgagtatttttaagtaagtcatggaacaaactacatttgctgactgggctagagggtcagagattcctaatgttctagtcaagacttttgtggaaattgatagtttatgccaaagggcagaagaggaggtgcagaattctattatagtttagactttaccttaatgtgctaatgtatttgaactctgtaaatgtctagaccagaaacaatcaacgcaagttaagatttaaagtaataaagtttatgtgtaagcatggtcttaaagtattttacaaaggctttaaggcataattggcctttcttgtgaacttgatctgatctatttagcacataatagtataagcacttcttattaatgatttctggcattgctgtctgctcattcacaataaccttattaaggcaccagatgatgatctaatttggaatgtggaaaatcagttaaaaagagagtaggctggaaaactatcacagattgatgggagaattactgtgattctagcaaactctgattgcattatattatcaattatggtagtaaacctaaaattgatgatgaaaacctgtctgaatttttttgtgtgtagccattacttaaagattataggttctgagtatagttagctctctttacttaatgtaatagaccgagattctttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccacctttcccccctttctattccacaaaaccgccactgtcatcatggcccgttctcaatgagctgttgggtacacctcccagacggggtggtggccgggcagaggggctcctcagttcccagtaggggcggccgggcagaggcgcccctcacctcccggacggggcggctggccgggcggggggctgaccccccccacctccctcccggacggggcggctggccgggcagaggggctcctcacttcccagtaggggcggccgggcagaggcgcccctcacctcccggacggggcggctggccgggcggggggctgacccctcccacctccctcccggacggggcggctggccgggcggggggctgacccccccacctccctcccggacgggcggctggccgggcggggggctgacccccccacctccctgcctgacgaggtggctgccgggcagagacgctcctcacttcccagacggggtggctgctgggcggaggggcttctcacttctcagacagcgcggctgccgggcggaggggctcctcacttctcagacggggcggttgccaggcagagggtctcctcacttctcagacggggcggccgggcagagacgctcctcacttcccagatgggatggcggccgggaagaggcgctcctcacttcctagatgggatggcggccgggcagagacgctcctcactttccagactgcgcagccaggcagaggggctcctcacatcccagacgatgggcggccgggcagagacgctcctcacttcccagacggggtggtggccgggcagaggctgcaatctcggcactttgggaggccaaggcaggcggctgggaggtgaaggttgtagcgagccgagatcacgccactgcactccagcctgggcaccattgagcacggagtgaatgagactccgtctgcaatcccggcacctcaggatgccgaggctggcggatcactcgcggttaggagctggagaccagcccagccaacacagcgaaacctcgtctccaccaaaaaaatacgaaaaccagtcaggcgtggcggcgcgcgcctgcaatcgcaggcagtcggcaggctgaggcaggagaatcaggcagcagtaccgtccagcttcagctcggcatcagagggagaccgtggagagagggagagggagaccgtggggagagggagagggagagggagagggagagggagacaatagaccgagattcttattttcagagctttttttttttttcagctcaccaaacaggaagacaactgacagcagaatcaatgaactggttacacaacattctgtggagacaagctgccagtagttttgaggtttgagaataatctctttttcattctttatttctccactgcaacaaaaaatagtgcattcactataaaaataaaagagcatcaaatacttcaataatctctgtctgtttagataccatatatttattaaatattcacaatatagagtgttaatgagcattgtgcaagagtttattaaaaataataagacatgattcctctccattgagagcttacagtgtagggaaatgtcatcgctgatattaagatataagaatgtaatttttttaacatgagggctgagaaagagttttattccctttaaaaacttaatggtgtaataaaaaatggaaaaaaaaacctttacaagacaactcaggtttcctgtaaacctaaagataagtttttttaaagcaaagaacaatcatttataattttggtatatttccttctaatctttgtgtattatacatttgtgtccctgtgtatataaatcagatgggacgtaccattaaaaaaaaagttgtgtttgcttccacttgcaattaatatgtagtaacagggactgttttatgtcccttcttgaacaacaagcccctctccacaaaggacaagacaaaatagacgaaaagaaaaaaaaaggcttttatgaccctgaacatcaggcaatgaaggagaatggtccctgggagataagaaataaagcgagcattggccgggcgtggtggctcacgcctgtaatcccagcaatttgggaggctgaggtgggcagatcacaaggtcaggagatcgagaacatcctggctaacatggtgaaagcccatctctactaaaatacaaaaaattagctgggcatggtagcacacgcctgtagtgtccgctactcaggaggctgaggcaggggaatcgcttgaacccgggaggcagaggttgcagtgagccgagatcgcgccactgcactccagcctggcgacagagcaagactccatctcaaaaaaaaaaaaaaaaaaaaaaggaaagaaaagaaagaaagaaagtgagcattacaattgtgcagcttactgctttgagtttccagggtatagcacaagaaggggatctgaagcagagcctggcaagcgtcctgatttgagatgcagctgagtctgaggagaccaaggcagccagaatttataagacaaagtactgaagaggaccacatagcgtagattaggcattgtaaaagaaaagattgataaacttgaagtcagagcaaagaagctattcaaaattaaacacactgaataaaagacttaaaagagcttcagtgagatgagggtcctcttccaatgtttaacagagttctgatcaggacatacatgaagcaaaattacctgaagctaggagaataaccatctaaaaatattagcgggaacagtgcctagcactcacatggggttgagaataaggcctgttcttatcacccagtctggaaaacctctaattcatggggcattgggaagaaaactcagaagggtcttgtctcagaagaggggaataattagtcctacactaagtcctgctccagaactaccttaaaaattataaacctatggtgtgaaaggatcaaattgatcccaaggaacttaattgcttcccagagcagagttcaagaatatttataggaatataaaactgtacagcacccaacaggataaagtttacaatgtctggcatccagcaaaaaaattactgagcatgtgaagaggcatgaaaatgcaacctataatgaggagaataagcaatcaatcgatactgacccagaactgacatagaagttagcattaacagaggacatctcttataattgtatttcatgcattcaaaaagttaagtggaggcatggaagatacgtaaagacccaaatcaaacttataaagatgaaaactctgtttaggatgagaagcacattggacagtattaacatcatattagacattgtagaagaaaagactgatgaatttgaagttatagcaaagaagctattgaaaatgaaatacacagggaaaaaacccttaaaaaaattaaaagagttcagtgaggttagggacaattttaggtagcttaatatacgggtaactgggattcccaaatgaggatggagataataaatatttgaagaaataaaactttcaaaacttaatgaaaactctaaatgcacagatagatagaaaaatcttaacaaaccccaaacacaagaaacacaaaacgacaccaacgcacgtaatcaaaattctcaaaaccagtgataaagagaatgtcctaaaagcagccagataaaagtgacaccttatatacagaggaataaattaaagagaacgtcagatttcttgttggaagtaatgcaagcaagaactcagtggagcagcatctttaaaataatgaaagaaaattaaaacctgtcagccaaaatttctgtatccagcacaagtattgtttaaaatgaaagtagttggtacaaatgtaaaatagtgtagccactatggaaaacagtatggcagctcttcaaacaattaaaaatgttattaacatatgatgcagcattttcacttttgcttgtatatccaaaagaattaaaagcaagatatttgcacacccatgtttatagcagccaaaaggtggaagcaacccaagttccatcaacaaatgagtggataaataaaatggggtatactcaaacaatgaaatattacttagccttaaaaagcaaggacttctgatacatgctataacatggatgagccttgaggacattatgctaagtgacataagcctgtcacaaaaaacaatactgtgtggttccacttacatgaggtacctagagtagtcaaatccgtggagaatgaaagtagaatgggccggatgcggtggctcacacctgcaatcctagcactttgggaggccaaggcgggtggatcacttaaggtcaggagttcgagaccagcctggccaacatggtgaaaccccgtctctactaaaaatacaaaaattagccaagtgtggtggtgcacgcatgtagttccagctactcaggaggctgaggcaggagaatcacttgaacccaggaggcagatgttgcaatgagccaagtttgtgccactgcactccagcctgggcaacagagcgagactctgagaaaaagaaaagaaaagaaacagaaaggaagaggggaagagaagagaagagaaacgagaagagaaagaagagagagagagagaggaaaagaaaagaaaaagaaaaagaaaagaaagaaaggtggtttccaggggctaggaggaggggaaaatgtggagttgtttaatgagtatagagtttcagttttactagatgaaaaagttctggagattggttgcagagtagtcaattttatgctatgtgttttttaccataataaaaatatgtttttaaaaaatgaaagcaaaatagtcttccagacatttaaaagctgaaataactaatcactcaaagatctacattacaaggaagtcctctgagcagaaggaaacttacaccagatggaaatatgaatctatacaaatgaataaagaataccagaaatggtaattatatgagtaattgataagatttttttcgtattattacaatctctttaaaagatagtttattgcttaaacaaaaataataacattgtattctgcagtttataacctgtaaaagtaagatgcatgacaagaacatataggccaagaagagagaaatggaagtataccataagtgaggtggtataacatcacttgaagatagactatgataagttaaacatgtatactatgtaccctaaaacaaccattaaaatagcaaaacaaagagttttttttaaaaatgagataaaatcaaatcataaaaatattcaaataatctaaaataaggcagaaaaaggaaagacggatcaaaaaagatggcacaaatagaagacaaatagcaagatgatagatttacatctaagcatatgaaaaaaaaatcacattaagtgaaaatgacctcaagaccccagtgaaaaggcagagattgtcaaactggataaaagagcaagacccaagtttatgtactgcttaaaagaaatgtactttaaacataaagatacaaattggttataaacaaaagcatcagaaaaatatagagagacaagattgttctaaaatttatatataaaacaatggaatgaaaatagccaagatacattattaaaaagtcaaaaaataatagatgctggcaaggttgtagagaaaaaggaacacttatatactgttggtgggagtgtaaattagttcaaccactgtggaaagcagtatggctatttctgaaagaactaaaagcagaataccatttggcccagcaatcccattactggatatatacccagaggaataaaaatcattctatcataaagacacatacatgcaaatgttcattgcagcactattcacaataggaaagacatggactcaacctaaatgcccatcaatgacagactgaataaagaaaatgtggtacatatacaccatagaatattatgcagccataaaaaagaaaagatcatgtcttttgcgggaacattgatggagctggaagctatcgtcctgagaaaactaacacaggatcagaaagccaaataatgcatgttttcacttataagtgggagttaaatgataagaacttatgaacacaaagaaggaaacaacagacactggtgtctacttgagggtggaggatgagagaagggagaggagcagaaaagataactattgggtactaggcttaatatctgggtgatgcaataatatgtacaacaaacccctgtgacatgtgtttacctatgtaacaaaccttcacctgtacccctaaacctaaaataaaaattataaaaagaaaatagccaaaacaacctgagagagaatagaacagaaagaattaccctattcaatttcaacactttttatatagctacagtaatctagactgtgtggtatcattagagacatagatccatagatcaatggaacagaatggaaaaccaaaaaataatcccacacaaatatgctcaactgatttttgagaaagcacaaaagtaattcaatggaaaaagatggtgttttcaactaatggtgctggagaaattggacatccatagaaaaaaaaaaacccttgaccttaacttcacattttatacaaaaattaaatagattataaaattagatgtaaaatgtgcaataaaaatacataggagaaaatcttcaggatctaggccaggtcatgtgcagcctattccctgcatgaactgcacttgatatgtgactaaagacaaggatgttaagaagtttatcattcaaaatatggtagaaagccaagtgtggtggctcctgcctgtaatcccagtgctttgagaggctgaggcgggaggattgctcgagcctaggagtttgggaccaaccagcctgggcaatataaaggagcaccatctatacaaaaataaaaaatttagcctggtgtggtagcatgcacctgtagtcccagctactcaggaggctgaagcagaaggatcctttgagcccaggagtttaaggctgcagtgagctgtgatcatgccacttcactccagcctgggtcacagagcaagatcctgtctcaaaagctaaaaacaaagaaaacaacaaaacatagtagaggccacagctatcagggacatagctgaagccagtgtctttgatgtctatgtgcttcccaagctgtttgtgaagctacattactgcatgagttgcaccattcacagcaaggtagtccagaatcaatctcgtgaagccggtaaggaccaaacaccccaaccctgatttagacctgtgggtgctgcccaccaacctccaccaaagcctacatatggagctgagtccttaaggactgaaaaaaaagctatcctctgaagaaaataaagtgaaaattatactttaaaaaaaagagatcctgttgaatagatgaaaaaagctagagactgggagaaaaattttcagaccatgtatacaataatgggctagtagctaaaacatagaaagaactctctaaactcaatgtacaaagaaaaacaattcaaaaattagcaaaggatatgaacagacatttcaccaaaaagggatatatgcatgaaaataagcacccaaaaaagatgacttatgagtcattagggaaatgcaaacgaaaaccccaaggagataccaatacataattcttagaatagccaaaatggaaaagattaaccataccaaatgctgacgaagatgttgaggaactggaacttcatggtggaaatataagatagtacagacggtttggaaaatagtttggcagttttctaaaatgttaaacttgcccctatcatgtgatccagccatttcaatcctatgtatgtactcaagagaaaaggaattatttatccatacaaaaacttgcatgtaaaagctgatagcagctttatttataatagttaaaaactggaaacagccaaatgtccatcaacaagtgagtggataaacaaactggtatgtccttcaatgaaatactactcagcaatgaaaaggaatgaactattgatagatgcaataatggggataaatctagaaactgttttgctgagcgaaaggggccaggcaaaaaagtattaatacatattagatgattccattgtataaaagcctataaaataaaaattaatagttatagaaagttatagaaagcacatccataactgcttggggtatgagagaccagaatgaactggattgagggattacaaagaaaaaatggttgtgatggatgtgttcactccgttgactgtgttgatggttttagctatgtgtgtgtgtatatatatatatatatatatatatatatatcaaaacaattgtacagtttaaatattcatagtgtttcatatgtcaattgtacctcaataaaactgttttccaaaaaatgttatggtaggttttgtaggagaaagatgtgaagagaaaaaagggaacaaaatctgagaaacaaagaattagacccaagagaaggaaagagaatcccttataggagcatgtagaaacctaggtcttatggttaggtaccacaagatagaatgatattcgtattctcttttagaaggcctttatttatttttttactgaataggtgaagaactacttcagaattcccattcttctattgattctttttctttcctctcattttccagtcttgctgaataattttcttaaaacatccacttccaacactggagaggaatgtaatcttatttctaattgactatttctaatatgacatatttctaatctactatgactaatgtaatagtcaaaggcagtgttttacctatttagcataattgtttctagttgaagagggtgttttattccttgaaggtcctaatggctcctattcttaattgaaaaatatgaagcttcttgatagggtacaagggaatcatttaccttaccttggtttataagcagtctcagttttcttagattaagaaataattatccaggttattcctatcagattttccctagctagcttcttaccattgaaaattttaaatttactcaagagaaaaatgtatttttatatacaaatacagcagcatcaattacaatagtaaaaaccctgcaaattcactaaatagctaacattaagaaaatcattatatacttgattaaatgttatgtatctcctaaaattgattactgtgaagactacatagcaacatagattaatatgtacaaaacaaaattaaatggaaagaatagaacatgaaattctatataagctacgattacaactaggtaaatatacaaaagaatacagttaaaattgaacatagataaatgaaaatagctgcattagcatggtgaattatgggtgttctcttttaaaatttttgtcgttgttgttttaataacttttaaaatagattttaagttttctggggtggtttactacactcttagactcttcatcctatgtgtgaaatttctaatgtgtaggaaaaagaaagaatactgattgccaccttatctaaaacttatgttgaccaagactgataataaaatgcacttagaaccctatataaaggatattgtgttttgattgcctaaaaaagaaaccaacagcatcttttatttgtttctagaggtgacttgggaaagatagggtagcgacatcgctgtgattttgttgtttctttttaaactttaggtacaaaattacactgatgccctacaatggtactattattctctgaggttttattcaactgatgaaatggatctggacttcaccaagctgcagaggaacatggcttgctgttacctgaatttgcaacaacttgataaggtcctttgatttatctattttcagaggtagcaaatgttcttatgtgcagtggcagagagatagatgccatgctgtgacttcctggctgttagtttaggatgtctgagagttccctcatatagaacaaggtcaaattgacattttcttgatttgcacactgtaaacatagagtgaaacttcccaaagaaagagagaatttggaataccattaattctattacttaccctttatttttcacacctattctgaaaggtaatatatcattggaactcctgaacaaagttatctgctactaaccatctgtaatattgtcctttgcagcaagctaaattttgaagtacacacttttgtcaagcattcattgagaccaaatacttgaatgaagtggccattctttcactttctaggttgttatctcttgcctttccaaccaccctagaaaatgttctttaactgatttcttatcaggacaaaattctagaaggtaaagaagataaaagcttgtttaaagatagaacggaaatactttccaaagcaattaggacatttcttcctttggttatcatatggtatgcacgtaatgaggggtattggctcttagaaggacaaagaactagaaggacaagtgtgaacccaaatgaaatatgaaggtttttgttgcctttcaagttttaatgacaggtctaacctttgttcacctaggtgattaagggtaatgattccagatgttttctttgaaggtttatttttgaagagttgtttatctgacttaaatactttagattttctttcaagaaaatatttgctatttagtttatatgttataaagtcacagccctggaagagaacttgaaatgttacttaattcatcataatgttgtacaggctagcatttaactgtttcagaaaatagttacctacagtttaagatctaaaaggaagatgatcatgtagattttgttacctaattctgcacaggacagcactatttcagaaaggtagttgcctactgtttacttaaagactaataaagaaggcaatcacagagcctttataacttccatgatttatgacacagtgagctaggcagcttgggaaggacctatatctggatgtagacatgctagttggggaatggatgcatttgcaggccaagggaggatatctaatcagccagtcaggaaagaaagaaagaacacagtaccagacattatgctaggctctgaggttacagagatgaacaaagtatagttgccttcaactcactcaagcagctgacatcatggtatcctaatgggcagataagcagagcatggcaatgagagaaatctaaatgttggaaatagtccgtaagtcaggcacacaggtggttggcatcacataaacataacagcagggaacagggtttcaatcacagatatttggactctgagacagtacacaaatctttgaggaataggagtgtgtgcagacatactagaaagagcaaagtagatctccacaactaaaggggccaggatatgaggctgtttttaagagcagatcccctgcatagggagccaaactgggaagcaatgaccagaagaggaatacaagttgactagatacagttttctgagacttaagcaatgctacttacatctcttctaatgtcaagtttggtcctagagcctagtatagcactgactttataattggaaattcaaatggtattaatagtgaggttaggaagaataggagaacagtaaaccaggtgtattttaatggtgcgtactcaatatgtaactgtatcatttatggccagattagtggtgaaaccaaaggatattttgaatatattcaaggtaactttgttggttactgttagtatatttctccatttcatccttgtcttgaatttagcagacattgattggataccctccatatacaatgaatatcctcttatgcactaggacagacagaaaggtgaaaaaaatacacaatccatcatattttaataatcccacctcgccagtgtctaacctttgttagctttcattgtctttcttcactccttcctttgagttgcttgagcattgttgggaaaatttatgaaaccatgtttattgggtttgctaaaatttcatggtttttcagctaggtagtcaataatactgactcttgttgagtttttatcacattccccacagtgataattccaaaacattttttttctgtccttaagcacccatgctttctcctttgttgtagcaaaagatcttatcgtgtgatttgctgagcttgtagccactgacatgaacttcatcaatttctcacctcttcacccatcctttcttttctcttacctacgagaaagaagtaactttgtctggggaccttactctacagatctcaaccctagctgtttaatcattctctactgtttcttttttattttttttttttgagacagagtctcactcttgttgcccaggctggagtgcaatggtgctatctcagctcactgcaacctccgcctcctgagctcaagcaattctcctgtctcagcctcctgagtagctgggattacaggcatgggccaccacgcctgggtaattttttatatttttagtagagacagggtttcacctttttggccaggctggtctcgaactcctgacctcatgatctgcccgcctcggcctcccaaagtgctgggattacaggcgtgagccaccgcgcccggcctactgtttctttctcctgtcactataattaccttgaagtcttctttatccaaaaaccttccttcaactttgtaatcctcctcaaacttcagttctgtgtccttctttttgttgccaaactttctaatccaattttttagtgttcattcattcaaaaatatttatttattgtctcctatgtgttaagtactgttctaggcattggggatatagtaatgaacaaaatatataaaaacctttatccacatggacaaatactgctgtccccattattttccactaggagaggcaaacaataaaaagataaataagtattatgttatattataggggtcaacaaactttctgtaaagaaccacagtaaatattttaggttttgcaggccatacagtctgtgctgaaactaatcaactctgttgttgtgccttgaaaatagccatagacagtatgtaatcaaattggtgtggctgtgttccaataaaactatgttttggaatactgaaatttgaatttcatgtaatttttgtgtgtcataaaatatgattcttttgatttatttcaggcacttaaaatgtaaaattgttctaacttatgaactgtacaaaaaatatggtgagccagattttgcccaaaggctatagtttgttgactcctggtatattaaatattgataagtgctaaggagaaaactaagcaggaaagggtgatattaaatgtttcagaggcggatgaatggttgaacttttagatagggtggtcagggaagtcctcactgagaagattgtttttaagtagagacctgaggaaaaagagcattccagatggagggaataacaactgcaaaggccctagggtatttaaagaatggcaaagagacctttgtggctggagctgagggaacattaggagaattaggagatgtgatcagggaagtagtggtgtcttagtctgtttcgtgttggtataacagaatacctaagactgagtaattaataaagaaaataggtttatttaagctcatgattctgcaggctgggaagttcaagggccatggtgctggcatttgcttggcttctggtgagggcttttgtgctagatcaaaacatagcagaaagtcaaagggaagtagactcatgccaggagacataatccaaggggctttctggctttataacaacctactttcatggaaactgtttctgttttatttccttgtatactatgtttgtcctcaactggagtacttgctgcttcctagccatgatctatgttttctacctcagtatcttttttcatgcttcttcattgcaaattacctctttcctgcatccctaaaattcccttttcaaagcctagcttaaaattccctttttcaaagcctaactcttaatgacattcttagcttcctgaggaaatttccttgtcttgcctttcctccaagactttgtaacagttctgtttatccctagatacttgttttctcattatattttagttatttctatacctgccttagtcatctattggactgtcagtcacctccttgaggacagagaccatatcttatctttatttgcccttgtacccagcatagtgcctaatgcatagtagatgctcattacattaaaaatagttataaagactcaataaatacctgtcaatcaacttcttctgatataggaattccatttcctcatgctatttctgtccttgctactatgcataatttggaaattaatagtgattaagatctgtgagtgctctttgattatcagaactgaatgagattatattattaaaaatcatcccactataactttctccagctcagctcttttctcttttgagggtgagaacgcattttattttgatttaaaatgaaatattgaatcataggtcagaagttaatttgggcaggccaatggagttgagaaatagactcccttgaactttttagtagattaggttacagattcattagctcgcacacttggcaacctctttttgagataacaatgccaattatagatcatttctttggtttgttttctaaattgtataaataaaaattttttaattgctattatccattcagatatcttcagtactttgcatgagacaatattaaacaatgttgtttcatagatatcaactctgcctttgaggtgtttgtagtgccttaagcctggtatcctgattttgctatattatttttgaggatttaaaaatatttggtttgtgcaagtcataggtttgaatggattaaggatgaaggaaatgagcttgggttctaaatacagaagcagtttatcacaccttgatataatgggattttgctgcaaaccataataaaaccttaatgttagttgacagatggataatgacttgttttggtgatagtctgtgtaagttaatgggaatgcacaattgggtactctttaactcagtacagaagtcccatcctcagcttgcaactgcagtttaggtacatgaatgtcattagcactactatagtttgataaaactgaaccacactctcaaaccacagaatggctgtaagacttacaacagacacaaagatgagactattcatagaatatttatgtgacctaaagtgaagacagttatgtctcatgtgctggttatatattgtttctctttaccatataaagttcgaaaaatgagcttgggaccagcagacataaactagtgatattcactagatggcactgtggcctctgtacttcatcagcttgtgcttgactgattctgagggtttttttttttttttttgtaattcttaggtagatgtacctttcccacaaatgcatctatatggatgcaaaaaaaaaaaaccactaaagaaacataagatgaaggtcagctgtgactcatttgatacagctatactgtaaaaataccctgactgagattccaactcaacaaatattaaatgcctaatctgtgccaagcactatagaataagtagaagacatgatctattctgtaagtgagcctaaaatattaatgcagaaacaatatttacatatataaaataattagaaaataataaaaggctgttcaatcacacatcattgtgtggtatgtaccatatgaacttagaataggaatatatagatgaggacgtttgtgaatattgattgaatgtacatatgatgtgaagctgaaaagggtaactgatttgttagaagatagagtcagatctgaagggaccttaataggttgaaatgatgagcctattctagcaagacgaagacaaacaggaaacaacaaaacatcctataattggatcccaaaaccaattgtacaagaacaaagtagataaaatatggctctaaaagcagcatatgtgagtcacttggtacattttattgactataagcactgcataagccaaaaatactaagaaagtttactcaaattaggttgaatcaatagagatttaatgtatagaaggagaaaaagtggcaatcaccctctattctgctctggttagaatatatctgaagtacagattcaatcaaacgcagactgaaaatattcagaaaaaagcaatttagaaaatagcaatacaacatagaaaataatgcaaatataaaacaatacagtgtaactactatttacagaacatttacgttgcattaggtgtaagtaatctagagattatttaaagtatacaaaaggatgtgtgtaggttatatgcaactactataaggaacttgagcatctgcagattgtgatatccgagggtgtcctggaaccaatcctctaaagatacgagggaacaactgtatagacagcccttgacttacaagggttcgatttaggatttatcaatcttatgatagtatgaaagcaatactcattcaataagctcctcaagttaccatggggttatgtctggataaatccgtcataggttgaaaatgcactttctatttaggatattttcagtttaccatgggtttatcaggatgtaaccccatcattagttgaggagcatctgtattgtattggattgaggggcaccacttataaaggaggatattgacaaacccaagtgtgccaagaggaaggcactgaggatggtgagagcactaaaaatcatctaatttgaagaataaaggaagtgtggatgttaaacttgggaaatggaagatttacgagaaacacgatagctttcttccaatatttgaatggctgtcagggagtaaagaaattaaatttatttcatgagtgtttccatgggtgagacctacaaggagtgagattttggattatcataaggaaaccctttcttaattatttgacctaccaaaacaatgaaatggattttcttaaaatagagtgaattctgtcttcttgaatatatttaagtaaagactgaatgacttggtataaatgttatagaggagattcaagcatcagaagaattttttgactaagagaactttgaggtatcttctgcccacatttttctgaaatatcagtataacctgataaaatgtattatagtcaaagaggattttgtgggggactaggctcattaatcactgaatttgaaaactaaaggaacccttgcaagtcattactaatttattttaaaatgaatttataaaaatataatttacatacaaaaatgcattcattttaggtatagttcaataattttgacaactttataccccaaatttacccactaccatggtctagatatagaagacttccattatcctgagagatttccttgtgttccttcccagtcaatcctcacctccactcccagccccaggcaatgactggtatgctttctatcactataggttagatttatctttcctagagtttcatataaatggaattacacggtatgtactttaccttttttttaaatctggcttctttcactcaattttagaattttagagaatctcttctggcttgtagagtttctgccgagagatcagctgttagtctgatgggcttccctttgtgggtaacccgacctttctctctggctgcacttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaatttggttgcattctccccgtcactttcaggtacaccaatcagacatagatttggtcttttcacatagtcccatatttcttggaggcttttttcatttctttttattcttttttctctaaacttctcttctcgcttcatttcattcatttgatcttccatcgctgataccctttcttccagttgatcgaatcggctactgaggcttgtgcattctccacgtagttctcgtaccatggttttcagctccatcaggtccttgaaggacttctctgcattggttattctagttagccatttgtctaatcttttttcaaggttttttacttatttgccatgggtttgaatgtcctcctttagctcggagtagtttgatcgtctgaagccttctctcaactcgtcaaagtcattctctatccagctttgttccgttgctgatgaggagctgcattcctttggaggaggagaggcaatctgatttttagaattttcagtttttctgctctgttttttccccatctttgtggttttatctacctttggtctttgatgatggtaatgtacagatgaggttttggtgtggatgtcctttctgtttgttagttttccttctaacagacaggaccctcagctgcaggtctgctggagtttgctggaggtccactccagaccctgtttgcctgggtatcagagcggaggctgcagaacagtggatatcaggcaaatgttgctgcctgatcattcctctggaagttttgtctcagaggagtacccggctgtgtgaggtgtcagtctgcccctactggggggtgcctcccagttaggctacttgggggtcagggacccacttcaggaggcagtctgtctattctcagatctccagctgcatgctaggagaaccactactctcttccaagctgtcagacagggacagttaagtctgcagaggtttctgctgccttttgtttggctatgccctgcccccagaggtggagtctacagaggcaggcaggcctccttgagctgcggtgggctccacccagttcgagcttccgggctgctttgtttacctactcaagcctgggcaatggcgggcgcccctcccccagctttgctgccgccttgcagtttgatctcagactgctgtgctagcaatgagcgaggctctgtgggcgtaggaccctctgagccaggcgtgggatacagtctcctggtgtgccgtttgctaagacccttggaaaagtgcagtattatggtgggagtgacctgattttccaagtgccgtctgtcacccctttccttggctaggaaagggaattccctgacccccttgcacttcccgggtgaggcaatgcctcgccctgcttcagctcacgctcggtgtgctgcacccactgtcctgcacccactgtccaacaatcctcagtgagatgcacccagtacctcagttggaaatgcagaaatcatttgtcttctgtgtcgctcacactgggagctgtagactggagctgtttctattcggccatcttggttccatccctaatttttgtatttttaatagagacgggatttcaccaagttggccaggctggtcttgaactcctgacctcaggtgatccacccaccttgacctcccaaagtgttgggattacaggcgtgagccacctcgcccagccttttattgctattttagagtatataaaacaaaattataaaacaaaattaactgtaaaacagcctcagacaggtccttcaggaagtattccagaagaaggcattatcatagtaagtgacagctccatgcatgttattgcccctgaggactttccagtgggacaagatgtggaggtggaagacagtgatactgatgatcccgagcctgtgtaggtctaggctaatgtgtttgctcatgtcttagtttttaacaaaaagtttgaaaagtcaaaaaagattttaaagtgttaaaaatcaaaaatcttgtagaataaggatataaaaaggaaatttttgtacaactgtacaatgtttgtattttaagctcggtgttattacaaaatacttaaaaagttttttaaatattaaaaagtttataaagttaaaaagttacagtaaactccattattgaagaaagaaaaatatccttttataaattgagtgtagcctaagtatacactgtttataaagtctacagtagtatacagtaatatcctaggccttcacattcactcagcactcactgactacccagagcaacttccagtcctacaagctccatttatgtaagtaccctatacaagtgtaccattttttatgttttataccctatatttactgtattttttctaggtttagatatgtttagatatataaatacttaccattaaaattgcctacagtattcagtacagtcacatgctgtagagatttgtagcctaggagcaatgggctataccatatagtcatgtatagtaggctataccatctaagtttgtgtaagtacactatggtgttcacacaaagatgaaattgcctaatggcacatttctcagaatgtacccctgttgttaagtgacacatgactgtaccacattttgtttatcctttcatctattcattggacacttgggttgctttgacattttggctattatgaataaatacttctatgaacatagatattacaagtatctttttgagttcctgctttcagtttttttgagtatttacctaataatataatcattggatcatgtggtaattctgtatttaacattttgaacaatcatcctacttttttccacaatggttgtaccattttacattcccaccagtaatgcacaagtgttccaatttctccacatcctggtcaacactcactgtttttaagttttttgataaaagccatcctaatgggtttgaagtgttctcttattgtgtttttgatttgcatttccctaatgaccagtgatgttgaacatattttcatgtgcttattggccatttgtgtatcttctttggagaaacatctgttgaagtcctttacccatttttaattgggatttgtattttatagtggttgaattgtaggaattatttatatatttcagatattaaccccttaccaaaatatgattagcaaatatgttttcccattctgtgggttgtctttttcttagtgtcttttgaagaacagtagattttaaaaaatttttgatgaggcccatttatctgatttttcttttgttgactgtgctttgggtgtcatatccaagaagtcatttgcaaatccgatgtcatgaagattttcgcatgtgttttcttctaagacttgtatagttttagctcttatgtttacacctttaatccatgttgagttaatttttatgtgtgatataaggtaaagatccagcttctttcttttgcatgtggatatcctggtttcccagcaccatttgttgaaaagactgtccttttcccattgaatagtttgggaacccttgtcaaaaaccatttcaccatatatgtgagggttcatttctgggctctctattatatgccattggtctatatgtcagtccttatctcagtactatactgttttgattactatatcttcatagctaagtcttgaaatcaggatcccttgaaacttcatatgaattttaggatgggtttttttatttatgaaaaaaaaatgcccttggaattgtcatagggattacattgaatctgtagatcactttgggtatcttcatttttcagtgtttatcttttactgtggtaaaatatacattatcttcattccttcttaacttcaaattttttcttgtttttgacttttagtctcttttggcattattggctgtatttatttacttttgactttcttcttgttagtcttcatttctgaaatgacttcttttacttctaatattttccttagctctaccacctcatttctgagtttttctaattattactatgggtttttttgtttgtttgtttgtttttttgagactgagtctcgctctgtcgcccaggctggagagcagttgtgctatctcggctcactgcaacctccgcctcccaggttcaagcaattctcctccctcagcctcccgagtagctgggattacaggcacccgccatcgtgcccggctaatttttgtatttttgtagagatgaggtttcaccatgttggccaggctggccaggcggaactcctgacctcaggtgatccgcccttctcagcctcccaaagtgctgagattgcagatgtgagtcacgacgccccaccgctaattcttatttaggttgatctttcatatcttgtatcattttttaaatttttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtacctacaaaggacatgaactcatccttttttatggctgcatagtattccatggtgtatatgtgccacattttcttaatccagtctatcattgttggacatttgggtttgttccaagtctttgctattgtgaatagtgccaaaataaacatacgtgtgcatgtgtctttatagcagcatgatttatttttaaatgtgtttagctcatttttaaatagtcggttatgattttgacctgttttttgagcacatttttctgacatgctttcattttctgtggggatactttgctgctgctgatgctgctgctgcttttttttttttaattttttacaactttttagggtatttaccttaaagctttactgtttctcattttgatgtgaaattagttttccttaacttataaaaaggtagacatttagaaagtgttactacttcacagagctcccttttttgtttttggtttggtttggtttgttagtgtttaaaaataaggcagcttttattctgagatttcctggctctgcttctctctgtcttttggtgtacacccacactgtccaatatgatagcaatgaggcatgtgtggctatgtacgtttaagtttaaattaattaaaattaaataaagttataaaaatttatttcttcaattgcagtagccacatttcaagtgctaaatagccatgtgtggctaatgactactctattgaatagcacaaatatagaatatttccatcatcacagaactctattggacaacactgatctatactttttctttcatctttgttgtcactgtcctgttcagttttttattgtactctcagcagtttctccttagtgtggagcctctcagaggggagctctagtgggtaagctttaagggttcatagggcctagactactatcgcttctttagtacatctttgatatgaggtccttgcactcactcaataatggagaaagcaaattatctcccaatttcaactgctgttctccagtttccccatcatgctattcagttgatttctacaagccaattttggggtcctccttttctatatagtccattagacgcttccctattacttccttttttttcttcatcctgtacagatgctgacataatgcaggtcttgtagctgttgttgctttttctccacccacttgtgtttcttaatgcctcgggatattttgtcactcagttttgttataaacgctgtctgtggtttttggttttgccatctgcatgctcagttgtttttcatgagaattcagagaaatgttacctctaccacatatttccagaatcattttgtatagtttttttttcttcctacctacctaccgacagggcctcactttgtcacctaggctggagtgcagtggtgtaaacacagctcacagcatcctcaacttcctgggctcaagtaatcctcctaccttaacctcctgagtagctgggaccacaggcatgcaccaccatgcctggctaatttaaaaaaatttttttgttgagacgggggtcttactatgttgcccaagctggtctcaaactcctggactcagatgatcctctcacctcagcctcccaaagtgctgggatcacaggcatgatcagccatgcccagcctcatatggcatatatatatatatatatacacagctacctttgctaaagtctcttaataattgtaataatttgcttataaattcttctgggttgtctacatattcaattatacaaattgacaattgtgtttcttctttttcaatatgctttatatatttcttgtcttattttgtctaataattcaaccactatgttgaattaaagtggtgttttggatttaaaagggaaagctaccataaattgccattaaatatgatgtttgctttagggtttttttgtgttgttgttgtatagatacggtattagtttcctagggatgctataacaaagcactacaaactgtgtggcttaaaacaacagaaatgtatacacttatagttctggaggctggaagtccaaaatcaaggtgtcgataaagctatgctctctctgaagactttagtagaggattcttcctagactagatttgcttaatggttaggtaaatggtcactttttgtaaatattctgtgtgtgcttgaaaaaaatgtgttttctgcagtttttaggcactgtgtatgtacatatatgtacagatgttccttgacttacgatggagttatatcccaataaattgatcataagttgaaaatatcgtaaggtgaaaatgcagttaatgctggcaaaatggcaggcatctacaacttatgatggtttaacttaatggtattttgattttataatgatgtaaaggcaatatacatttagtagaaaccataaccctgtcataagttgtaaggagctcccagacttacgatgtggttacatcctgataaacccgtggtaaagtcaaaaaatcataagacggagaccacctatatacacacatgtataaatttagattaagtttgttcattttatttgaatcttctgtatcaaaactcatattttgtgtacttactctatcacttactgagatgaggtgctggaatatccctttatggtttgaattgatctatttcttcatttaattttatcatttttgctttatatattttaggccatactacttatacatacaaaattagtactgtaatatatttgtttgttgaagttttattgttatgcagtgatcttctttatatctagtattattttctgccttaaagtcatttttgtctgatattaatatatccacactttggttaatattttccagatagatcttctctaatccctttactttgaacttttaatacatttatattttaggtgtgccacttctaaaaaacatgtagttacatatttttaatccagtctgaccatttttgttttttaactagggcatttcgtgtttatacatttaatacaatattggtatatctgagtttaaatctgtaacttactttatgctttctatttgtcatttctttttttttttttttttttttttgagacagagtctcactttatgcccaggctggagtgcagtagtacaatctctgctcactgcaaactccgcctcccatgttcaagtgattctcatgcctcagcctcccaagtagctgggatcacagatgtgtgccaccacatccagctaatttttatatttttagtagagatggggtttcaccatgctggccaggctggtctcaaactcctgttctcaggggatctgcctgcctgagcctcccaaagtgttgggattacaggcatgagccaccgtgcccggcttctatttgtcatttctatcctgtttctttttctctcctcacttgccttcttcgggatcaatgtttctaaataatagactttacttgttacagcagttttaggtttacagaaaaattgagtaggaaatatagagagttttcatataccccctcacggttcttcacatactgtttcccctgtcattaacatctcgcattagtgtgctatatatgttacagttaataagccaatattgatatgttatttttaactaaagtccgtagtttacattaggatttagtctttgtgttgtacatcatatgtggtttgatgaatgtataaaaaagtgtctaccattataataccatacagaatagttcaaccccctgtggttcaactattcatcccttcctccctctcactgaactagtgtcaaccactgatctttttactgtctccatagttttgccttttcagaatgtcacataattggaatcgtgcagtatgtagccttttcaaataggtttctttcacttagcaatatgcatttaagattccttcatgtccttttatgggttggtagttaattttttttagtgctgaataatatttcactatctggatatattagtttatacactcacctatggaagaacatcttagttgcttccaaattttggcagttatgaataaagctactataaatatctttatgtagatttttgtgtagacataagttttgacacatttgaataaataccaaaggtgcaactgctggattgtatggcaagagtatgtttagttttgtaggaaactgccaaactgtcttccaagttggctataccatttttcattcccaccagtgatgaatgagagttcctgttgcaccacatccttgccagcattatatgtcgttaaagtgttttgaattttagttattctaatagatgcatagtgatatctcattgctgttttaatttgcaaaaccctaatgacataagatgttaagcatcttttcatatacttatttgccatctgcatattttatttagtgaagtgtttcttcaggtcttttgcccattttatacttgggttgtttattttcttattgttgaatttgaagaattcttcatacatgttgaataccagtccttcattacatatgtgtttggcaaatattttttcccaatatgtggcttttatcattattctcttaatgctgtctttcacagagcagtttttaattttaatgaagtttaacttaccagttttttcttttatagatatggttttggtgttgtgtctaaaaagtcattgccaaagttcacctaaaatttctcctatgttatcttctaaaagttttatagtttgggtttttatatttaggttataatccattttcagttaatttttgtgagaggtttatggtctgtgtctagctctacttttttacatgtggatgtctagttgttccagcaccagttgttaaaaatactattttcattttttttttcattgcagtcttccccttctactagtgtgaaaattatttactgcttctaatcttttagtggctatcctagaaagtatagaatcctttcttaactgtcttccatgtttgtaatcgctctgtgctgcattttggctattttattctttcagcccactaattttctcttcacctgtttctaatctgctattaaacctgtctattatgttttaatttgggtaattgggtttttcatttcaaaaagcttctttgtttcagatccccaaggtcacattttatggtctctgtttcctactaacttcactgatatgcaaagtatttaataactggtatggcacaggtaataatgagacagaatggataccatctagaaacaaccactataactgtattaatttgtaccactgtgtatcaacccacatacatatattttgaacatacattgtatttctttagactttgaaaacataggtgttttataaccagtttttcataattctagtatctgcatcttgagggtctgcttctgctatctcgtttctgctgtttatggtaccttgtttccgagtgtgctttgttatttttgtaacgtgtacaactcatggttcttgaaaaattatttatggaaatatttcgaaggctgacataaggtgctttcccccagagaagatttacatttgcttctgtagatgcttgggagctatctaaactaaattctcagctttaggtcttttagcttcctgtataatgtagtttgggtcagtgaatacatgagtctcctagtattacacctcatggattgtttccctccaccccattgtgctgccttctattcagtactaaggtaactttatttgcagttttccagggatgtgggtaggagtgggtttacttttggcttgtccctagtctaggagtgtgatcccttggaacttgatgtcttttcccctgacctagtgatgtccctcaaaactgaagttaacatttgcttacatttgcaaatgcttaccagataaaagcgactttacttttctgtttacctctctgagacctcagttttccttagattttgccttggtaattcttttgctatttgtcagttgctcttttgttctttctggaaaaaaattaatatatcatccaatatttttggttgttttcagcaggagggttggtctgacatatctaacttactctatttccagaagtataactcactgttgcattagcattctagaagagcacttctgcaaatatttttcttagattcatatattttcattgtgagtatccctcagccattttgactaccttaatgatattagtaaaatatggtaagtccttccttgtagattttattaaaatgacccagtgtttttctttccaggccaaagaggcagtggcagaagctgaacgacatgaccctaggaacgttttcactcaattttatatattcaagattgcagtcatagagggcaactctgaaagaggtataaattttatttgtcacttatatttgactattaacacaaagaataaataatcctcttcaaccacagtgggaaaaaaacattgtttttaagacaatagaattgaatatatgttctgtctttcctatgtaaaggtgatacaacaatgcaaaaagaaaccgtggaaggttatataaaagtaaaagaacagtggttacctattgagggaataggaactgggcaaacgcgggacaagaattaggggaaagtcttatcactatgtacttttttatacttttatttaaaccaacctattcaaaaattaaatttaaaaagctgtgtgtgggtgagattatactaaaaacccatatcagttaagaattgtcttcaaaaaatgaaagttggggtaccttttgattgttttcacttatttgggaggtgattggtgagagatttggccttgagatggagtttctctccacagagtagacagtcttggaatttcacacatgaccctcatcccattaatgttgaggcctttccattaagttaagcatagtttcctagctggtgtgtctgcatgggcacatatatgttgaattggttatagatatgcctttgctcagatattaatgccttcagccctcaggtagctgaattaatcctgaaggagtctgagctccagactggttgccatttgtttggcagaagttaagaaacttaaattaatggatccaaacaaaatgtatacgaatccaattaagcaactgtttttggacacctactacgtacaaaggactctgttattcactccttaagaaaaaagatcatttattttacattaaaaaagaaatgttccagaatagtaaagtatacctgtataataattaaggaatagtaaattagaggttaatattgctgtcatgttcatcatcaaagttttcattagagacttttaggcatttgttttacttgatatactgtgtttaagggtaaaataacttgaagcttttttgccagtaaaaatggcaaaaatattagtaattttcctgttaaatcttttgttttaacattattttttaaaaattattttactttttaaatacaacatcagatcaacccttttatttcttctccagttgtctgtgaccattttttaagtcacgtatattgaagatacatataataaatttactcttgctagtgtatggtcctatgaggtttatatatgttaaaaattctgagttttgaagtgcatacagtcatataactaccaccacaatgtagaaaaaaaatacctcagggccctttactgttactccttctcaccactttcagccctggaaatcagtaatctcttctatctctatagttttgtcttttccagaatgtcatataaatgaaatcatatagtatgaatctttttgagcttctttcacttaacttaatgcatttgaaactcacccatattgtgtttatccacagtttgttcttttttattgctatgtggcattccatagtatggaaataccacagtatggaaaaatgcattcaccagttgaaggatatttgaatggttttcagggttttttttcacctctgagacaagttcaaagttttcagttttgacaattgtgaataaaggtgctgtaaaacatctctttacatattttctgtgataataatattgtttttttgagatggggtcttgctctgtcacccaggctggagtgcagtggcatgatctcagctcactgcaatctccacctcccaggttcaagcgattctcctgcctcagcctcctgaatagctgggactacaggtgtgcaccaccatgcccagttaattcgatgataatattttacttctgtagggtaaatatctaggagtgggactgtggacttatatggtaaatacatgtttaactttattagaaactgcaaaactgttttctaaagcgactatacaatttcacctgtgaaccagctatgtttaagagttctagctgatctacatcctcatcagcacttgaaattgtccacttaaaaaaatttagccattctgggagattattaaaaagtcaagaaacaacagatgctggtgaggctgtagagaaataggaatgcttttacactgttggtgggaatgtaaattagttcaatcatagcggaagacagcatggtgattcttcaaggatctagaaccggaaatactatttgacccagcaatcccattactgggtatatactcaaaggaatataaaccattctattataaagatacatgcacacgtgtgttcattgcagcactattcacaatagcaaagacatggaaccaacccaaatgcccatcaatggcagactggataaagaaaatgtggtacatatacaccgtggaatactatgcagccataaaaaggaataagatcatgtcttttgcaggcacatggatgaagctggaagccatcaacctcagcaaactaatgcaggaaccgaaaaccaaacaccacatgttctcactcataagagggagatgaacaatgagaacacatggacacaggaaggggaacaacacacactggggcctgttgggggcggggaggggagggagaacatcaggacaaatagctaatgcatgtgaggcttaaaacctaggtgatgggttgataggtgcatcaaaccaccatgacacacgtatgcctacgtaataaaactgcactttctgcacatgtatcctagaacttaaagttaaaacaataaaaaagaacaaaaatttagctattctgatagtgggtagtagtgttttactgtggcattagcatttccctaatgtttaatattttattaaaccatgtatgtttttgggttgtttgtacaaatctttttcccagtttaagatagggtactttgttttattattactgatttttgacagttctttatatattctggatacaagttgtcttttttaaaaacttatttttttaattggcaaataaaaattatatatatattgatcatgaacaacatggtgggttttatttatttatttattttattattatactttaagtttcagggtacatgtgcacaacatgcaggtttgttacatatgtatacatgtgccatgttggtgtgctgcacccattaactcgtcatttacattaggtatatctcctaatgctatccctccccagtcccccatcccacaacaggccctggggtgtgatgttccccttcctgtgtccaagtgttctcattgttcaattcccacctatgagtgagaatatgcggtgtttggttttttgtccttactatagtttgctgagaatgatggtttccagcttcatccatgtccctacaaaggacatgaattcatcattttttatggctgcataatattccatggtgtatatgtgccacattttcttaatccagtctatcattgatggacatttgggttggttccaagtctttgctatcgtgaatagtgctgcaataaacatacgtgtgcatgtgtctttatagcagcatgatttatacttctttgagtatatacccagtaatgggatggctgggtcaaatggtgtttctagttctagatccctgaggaatcgccacactgacttccacaatggttgaactagtttacagtcccaccaacagtgtaaaagtgttcctgtttctccacatcctctccagcaacaacatggtgttttaaagatatgtatacattgtggaatggctaaatcaagctaattaacatatacattacctcacatcctttttttattttttatttttttgaagcaaggtcttactctgtcacccaagtggaagtgcagtggaatgatcacggctcattgcagccttgacctcccaggctcaagagatcctccacctcatcttttttattattttttgtatagatggagtctcactatgttgcccaggctggcctcaaactcctgggctcaagcaatcctcctgcttcagcctcccaaagtgctaggattacaggcatgagccatcacacccaaccctacctcacatacttagcattttttttgtggtgagaacacttaaactctcagtgatttttaagaatagaatacattgttataatctatagtcaccatgttgtacaatagatctcttgaacttgttccttctgctcaacggaaattctgtattctttcaccatctccctaatctccccgactccttagtccctggtaaccaccattctactttgcttctatgaacattctattctgcttctatgaggtcaacttctttagatttcacatatgagatcatgtggtatttatttttgtgtgcctggcttatttcacttaatataatgtcttcgaggttcatacctttttttcataaatgacaggatttcctccttttattgaggctgaatagtattccattgtctatatatacaccagattttctttatccacttatccaccgataaacagttaagttgattccataccatggctattgtgaataatgctgcaatgaatatgggagtgcagatatctctttgacatattgatttcacttcttttttatattctactacgtagtgggactgctggatcatatggtagttctactttaatttttttgaggaacctccatactgctttccatgatggctatactaatttacattcccacctacaatatgcaagagttccctattctccgcatccttgtcagcacttgctctcctttgtcttttttataatagccattctagcagatgtggggtgatgttatcatcgtggttttaatttgcgtttctctgatgagtagtgatgttagacattttttcatatacttgtggaccacttgctcatctccttttgagaagtgtcttgtcaggtcatttgcccattttaaaatcaggttatttgtttccttcctattgaattgtttgaatttcttatatattttggatgttaaccccttctcaaatgcctggtttgtaaatatattctcccattccatacattgtgtcttcactctgttgatggtttcttttgctgtgtggaagctttttagtttgatgtaatcccatgtgtctatttttgtgtttagcaatgtcgtggaacttttcctctatgttttcttttagtagttctacagtttcatgtcttacgtttaaatctttaatctattttgaatagcttttttatatattgtgagaaaagggtcaaattttattcttctgcatgtgggtatccagttttaccaacactattggttgaagaaactgtccttttctcattgtgtgttcttgacacctttattgaaaaccaattgactgtaaatgtgtggatttatttctgggctctctatttccttccattggcctatgtatctgtttttctgccaataccatgctgttttgattagtatagctttgtagtttattttgacttcacatagtatggtgacttcagctttcttatttttgctcaagattgcgatagctagtcagggtctttttgcttccgtggaaacgtcagtatttttttttttatttctgggaaaaaatgtcactggaattttaatagggattgcattgcatctgtagattgccttgggtagtatggacatttaacaatatttttccaatccgtgaacctgggatatctttccatttctttgtgttttcttcactttctttcatcagtgttttatagtttttagtgtacatgtctttcacttcaacattaaatttgctcctaaatatttttgtagctattgtaaatggaatcatgtttttaatattttttcaggtagtttgttgttagtatgtagaaatgctactactttgtgtatattgattttgtatcttgctacttaattgaattcacttattggttctaaattttttttcattgcctctgtaaggttttctatatataagatcatgttatttacaagcagacaatttaacttcttcctttccaacttagatatttctcatgcctaattactctgactaggacttccagtagtatgttgaatagaagtagtgagagtgggcatccatgtcttcttccttattttagaggaaacgctcctaactattcaccattgagtatggtgttatttgtccattggtcatatatggcctttattgtgtttttttttttaaatcatggaatgatgttgaattttgtgaaatgatttccattttttggaagaatttgagaaggattggtattagttctttaaacgtttggtaggagcagtgacaccatcagatcctgagcttttcttagatggaagattttttgttattcatttaatctccttattcattatttgttcacattttctatttcattatgattccatctcggttttatatgtctaggactttatctttcttctagattatccaatttcttggtacataattgttcatagtagtcgcatgattttttatatttctctggtaccagctgtactgtcttctctttctttttttattttatttatctttttttaattttttttattatactttaagttttagggtacatgtgcacattgtgcaggttagttacatatgtatacatgtgccatgctggtgtgctgcacccactaactcctcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagcctttgctattgtgaataatgccgcaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctattcatgtcctttgcccactttttgatggggttgtttttttttttcttgtaaatttgtttgagttcattgtagattctggatattagccctttgtcatatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctacgtcctgaatggtaatgcctaggatttcttctagggtttttatggttttaggtcgaatgtttaagtctttaatccatcgtgaattgatttttgtataaggtgtaaggaagggatccagtttcagctttctacatatggctagccagttttcccagcaccatttattaaatagggaatcctttccccattgcttgtttttctcaggtttgtcaaagatcagagagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatgctcttttatttccttgagcagcggtttgtagttctccttgaagaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattaccgtggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctgatctcataaaatgagttagggaggattccctctttttctattgattggaatagtttcagaaggaatggtaccggttcctccttgtacctctggtagaattcggctgtgaatccatctggtcctggattctttttggttggtaagctattgattattgccacaatatcagatcctgttattgatctattcagagattcaacttcttcctggtttagtcttggaagagtgtatgtgttgaggagtttatccatttcttctagattttctagtttatttgcatagaggtgtttttagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaatattttgaaggcttttttgtgtctctatttccttcagttctgctctgatcttagttatttcttgccttctgttagcttttgcatgtgtttgctcttgcttttctagttcttttaactgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgtcttcatttcgttatgtacccagcagtcattgaggagcaggttgttcagtttccatgtagttgagtggttttgagtgagattcttaatcctgagttctagtttgattgcactgtggactgagagatagtttgttataatttgtgttcttttacatttgctgaggagagctttacttccaagtatgtggtcagttttgcaataggtgtggtgtggtgctgaaaaaaacgtatattctgttgatttggggtggagagttctgtagacgtctattaggtcctcttggtgcagagctgagttcaattcctgggtatccttgttgactttctgtctcgttgatctgtctaatattgacagtggggtgttaaagcctcccattattaatgtgtgggaatctaagtctctttgtaggtcactcaggacttgctttatgaatctgggtgctcctgtattgggtgcatatatatttaggatagttagctgttcttgttgaattgatccctttaccattatgtaatggccttctttgtctcttttgatctttgttggtttaaagtctgtttgatcagagaataggattgcaacccctgcctttgtttgttttccatttgcttggtagatcttcctccatccttttattttgagcctatgtgtgtctctgcaagtgagatgggtctcctgaatacagcacactgatgggtcttgactctatccaatttgccagtctgtgtcttttaattggagcatttagtccatttacatttaaggttaatagtgttatgtgtgaatttgatcctgtcattatgatgttagctggttcttttgcccgttagttgatgcagtttcttcctagtctcgatggtctttacattttggcatgattttgcagcagctggtacccgttgttcctttccatgttcagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagggtttctgccgagagatccgctgttagtctgatgggcttccctttgagggtaacctgacgtttctctctggctgcacttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacatagatttggtcttttcacatagtcccatatttcttggaggctttgctcatttctttttattcttttttctctaaactttccttctcgcttcatttcattcatttcatcttccattgctgataccctttcttccagttgatcgcatcggctcctgaggcttctgcattcttcaggtagttctcgagccttggttttcagctccatcagctcctttaagcacttctctgtattggttattctagttatacattcttctaaatttttttcaaagttttcaacttctttgcctttggtttgaatgtcctcccgtagctcagattaatttgatcgtctgaagtcttcttctctcagctcgtcaaagtccttctccgtccagctttgttctgttgctggtgaggggctgcattcctttggaggaggagaggcgctctgatttttagagtttccagtttttctgttctgttttttccccatctttgtggttttatctacttttggtctttgatgatggtgatgtacagatgggtttttagtgtggatgtcctttctgtttgttagttttccttctaacagacaggaccctcagctgcaggtctgctggagtaccctgcagtgtgaggtgtcagtctgcccctgctggagggtgcctcccagttaggctgcttgggggtcaggggtcagggagccacttgaggaggcagtctgcccgttctcagatctccagctgcgtactgggagaacccctgctctcttcaaagctgtcagacagggacagttaagtctgcagaggttactgctgtctttttgtttgtctgtgccctgcccccagaggtggagcctacagaggcacgcaggcctccttgagctgtggtgggctccactcagttcgagcttcccggctgctttgtttacctaagcaagcctgggcaatggtgggcgcccctcccccagcctcactgccgccttgcagtttgatctcagactgctgtgctagcaatcagcgagactccgtggggtaggaccctccgagccaggtgcgggatataatctcgtggtgcgctgttttttaagcccgtgagaaaagcgcagtattcaggtgggagtgacccgattttccaggtgccgtccgtcacccctttctttgattaggaaagggaactccctgaccccttgcgcttccccccgccgagtgaggcaatgcctcgccctgcttcggctagcgcacggtgggcgcacccactgacctgcgcccactgtctggcactccctagtcagatgaaccgggtacctcagatggaaatgcagaaatcacccgtcttctgcgtggttcatgctgggagctgtagactggagctgttcctattcggccatcttggctcctccaatgtcttctctttcatttcttgttttatttatttgagccttatctttttttcttagtctaaataaaagtttgtcaattttgttcatcttttttttttttttttttgagacagttgctctgtctcccaggctggaatgcagtggcgccatcttggctcactgcaacctccacctcccgggttcaagcagttcttctgcttcagcctcctaagtagctgggactacaggcacatgccaccatgcccagataattttttgcatttttagtagagatggagtttcactacattggccaggctggtctcaaaattctgacctcaagtgatctgcccacctcagcctcccaaagtgctgggattacaggtgtgagccaccatacctggtgattttgtttatcttttcaaaaaaactaactgttagtttctagtaagacaagtctgggtggcaatgaactccctcagcttttgtttgtctggtaaagtctttatctctccttcatttctgaaggatagctttactgggtaaagtattaattggcagggttttttctcttcggcactttgaatatatcttcccactctttcgtggcctatatttctgctgtgaagagcactgctagctttattggaactcctttatatgtgatatgctgcttttctattgttactttcaggatcctctcttttatgttgatttttgacagtttgattataatatgtcttggtgttgtcttgtttggattgtatcttattggagactgatgaccctcctgtacctgtatatttatctttccccaggttcggaaagttttctgttgctattgattgaaatgtgttttccagaccttcatatctcttttctccttattgaactcctataattcagatatttgcccttttgttgttgtcccataagtccctaagcttttttttttattgaggaagatctttttttaatgttattttttttttatttccagcttgtaagttcagggggacatgtgcaggatgtgcaagtttgttacataggtaaacgtgtgccatggtggtttgctgcataaatcatcccatcacctaggtgttaagtccagcatccactaactgttcttccttatgatatccctcctcccagcccccaccctccagcaagccccagtatgtgttgctaacccccatgtgtccatgtgttctcatcattcagcttccacttataagtgagaacatgcagtatttggttttctgttcctgcattagtttgctgaggataatggcttccagctccatctatgtccctgcaaaggacgtggtcttgttcctttgtatggctgcatagtattccatggtgtatatgtaccacattttctttattcagtctatcattgatgggcatacgttgattatatgtctttgctattgtgaatagtgctacaatgaacatacgtgtgcattatttttataacagaatgatttatattcctttgggtatatacccagtaatgggattgccaggtcatatagtatttctgcctgtaggtcttcgagaaatcaccatactgtcttccacaatggttgaactactaatttacattcccaccaacagtgtaaaagtgtaaaagcattcctttttctccacacacaaccttgccagcatctgttgttttttgactttttaataatagtcattctgactggcatgagatggtatctcattgtggttttgatttgcatttccctaatgatcagtgatgttgagctatttttcatacatttgttggccatgtgtatgtcttcttttgagaagtgtctgttcatgtcctttgcccactttttagtgggttttctttttttttaatttgcttaggttccttgtagatgctgggtattaggcctttgtcagatggatagattgtaaaaattttctcccattctataatttatttgttcattctgatgatggtttcttctgctgtgcagcagctctttagtctgggaaggcactttattggcctatcaaggaactatgggtaggctgttttgcatggttcacatgtgtgctgactcctggagtcctttggcagcctggccttgttcctggattagcagctgggtgggcctggatgcctaggtccatggggttggatctggagcctatatccactgaggtggacttcttgattgggtctgaaggattgggcttggagcctgtatccaatggggctggcctgaagtttaggcccccattggctgaccaaacactaaagtggtgagtctgaatctgcaagagccagccaggtgggaatgggccttgtgcctgggtcccctgggataggcctggagcctgagtctgtaggggttggcctggcactggggtgggcctcaagcctgaggactagggcaggcctcagtcctaggtcagtgggtgctggcctggaaccttggtttgtaggggtggttttagagcctcagtccatgggggctagcctggcacctgggtctactggggtggtactagacccttggcctactgcagcaggcctggaccctgggtctactggagcttggggccactgagacagtcctagagcctggagctggcctggagttggggcagatgtggagcctcgggccacaaggactgccttgaagcctgggattgttggtactaaattgctatttggagacacactggctggcctagtgtgtggggctgtggggacctgcctggggcctgggtctgtgggggccagcctgggggatggatgtgtgtatgctagcctggaggctaggtctgtgaggtctgacctgggtcctggagctgcaggagctgtcctggaacctggctgcataggggaagtgctgaggctttgatccatgggggccagcccatccctagggtctaaattggcttggacccttggtctgctggagcagacttggaccgtggctccactggagtgtggagtgacataagcaggtgtgaaggctgtgttcatgagtgctagcctcgtacctatggccaggggtacagatctggtattggggcaggcctgtagcctggggctgtgtgggctgacctagctctgaggtggtctgaaaacctggggtatgcctggatcctggggctgcaggggctggcctggcactgagtaggcctggatcctatatctacaaggagcagcctagaggctgggtccatgggtgctgacctgatgactagggctgtggggctggcctagtgctgaggcagacctgaagcctggggctacgggggatccagcttcatactggcagcaatctggtgcctggaactactgatgtcagcctcgtcctaaggatagagactgcatctaaagcctgagtctgttaggactgctatggcactgggacaggcccaaagcctggggctaatgggtctggtccagcactggggccagtctggagcctgaatccgctggggttggcctggtgatgtggcagtcctagagatcaagtccttcgggcaggtctggagcctgggtctgcaggatatgacctggagtctggggccatgggggcctgcccagtgatgagttttactgccgccagcccattgttgtggtctgaggtaaattccagtactcactttcctcttcttcccctaagtggaggatatctgtcttcatgctctatggcctggggttgggggaggggtgacatgggtattaaaaagctgttgttcctacactcttcaatgcatcttttctatttctgtgccacagccaggtgctgcaatctctcacctagttttcctagctcttgtggaggtatttccatgtgtggatagttgttcaaattgatgttcttgtggggaatgagcgctggaaagtcctattccaccatcttgttgatgttcagtggacacaagctctttatcagacatgtattttgcaaattttttctttttattaacaccgtctttcatgaacagaagttttaaatttcgacatagtcctatttatttttcttcttttatggattgtgcttttggcattgtagttgagaaatctttgcctactgcaaggtgacagaaaaggtctcatgttttcttcaagaaattttacagttttaggtttacatttatgtctatgaacaatttttagttaatttttgtatttggttcaaggtatggattgaaaatttttttttttttttgcacatgactatccaattgttccagcatcatttgtttaacaaactattctttctctgttgaattgcctttgtgcctttatcagaaattagttgtcatatatgtgtggatctctttctggactctattccattccattcttctattcatccatccttacgctattcccatactgtctttatcagtgtagctatgtaataaatttgaagtcaactttaacaaatccatccttacactattcccatgctgtctttattagtgtagctatgtaataaatttgaaccccaactttgttctctttctaattgttttggctattccaaggcctttgtatatccatatgaattttagaatcattattttaagttttgcataaatgaattttgattcgtattacattgaatctatagatcagcttggggataactgacatcttaacaacgttgctgagtcttccaaaccacgaacaacttacatacctccatttatttaggtctttaatttctctcagcaatgttttctacttttcattgtacctgtcttctgcatcttttgtcagatttatccctaagtacactatattttatgctattttaaatggcattttaaaaaaatttggtttccgattgcttattgttgatatgtagaaatacaaatgatttcttgtatattgatcttatatcccacaactttggtaaactcacttattagttgcagtacagtaccttccctgtagattccatcagattttattttatttttgttttgttttgtttgtttgtttatgagacctgttctgtttcgagacctgttctgtcacctaggctggagtgcggtggcatgatctcggctcactgcaacctccacctcctgggttcaaacgattctcgtgcctcagcctcccaagaaactgggattacaggcatgcaccaccacgcctggctaatttttgtatttttagtagaaatggggtttcaccacgttggccaggctggtctcgaactcctggcctcaaggaatcctcccaccttggcctcccaaagtgctgggattacaggcatgagctactgcaccagccccatcagattttctaaatagacaatcatgttgcctgtgggtaaagataatttcacttctttttcaatctgggtgcaatttatttttttcttgctttgttgctcttgttagattctccagtaaaatttgagtaaaactgatgagagtggacatccttatctttttcctgattttagggggaaagcattcagtcttccaccagtaagtatgttagctgtaggtttttcacagatatcctttatcaggttgagggagttccatttggtggtgggaggggtaaggaatggatgttgaatttggttgtatggttttctgcatctgttgaaatggtcaatttttaaaaaattgttaatatagtcagttacattaattgattttcaaatgttaaaccaatgctgtatttctggaacaagccccacttgatcatgatgtatactcctttttatataatttgatttgctaatggtttgtttagaatatgtgtatctatgttcatgaatgaaattggtttgtagttttatattcctgtaatgtttttggttttgctatcagagtaatactgacttcatagggtgaattgggaagtatattctccttttcagttttctggaagagtttgtgttgaaatgatattatttcttcctcaaatgtttttggtagatttcaccagtgaagccatctgggactggagttttctttatgcaaaggtttttaattataaattaaatgtctttaatagatatagggctattcaagttatctattatttattgatttagctttggtggtttgtgtctttcaaaaatttgtttcatctaagttgttgaaattatgggcctaaagttgttcataatatcccccatattatccttttaacacctgtaacctttcttatttctgatatttgtaatttatgtcttctctatttttcttcctggtcagtgtaactaaaggatcaatcagtgtagaaggtcaattttattgatcttctcaaagaacccagcttttggttttactaatttttctctatcagttttgtttttgtttttgtttttgatagagtctcaaaaaaacgaacacagctcactacagccttggcctcccaggctcagtttatcctcctgcctcatcctcccgagtagctgggaccacaggtgcatgccactacacctagctcattttaaaacttttttgtagagatagggtctcaccatgttgcccaggctggtctcaaactcctgggctcaaacgatcctcctaccttggcctctattgtttttatctgatttctatttaatttatttacgttctgatctttatcatatccattcttctgctttctttgagttccatttgctctacttcttcttatttctaaaggtgaacactgaggtcattgatttaagacctttattctggtctatctggacagttaatgctacaaattatcatctaattactgtttagtgacgatacacaaattttgatatgtcatgttttcattttttttttttttcaggttttcctttagcatttttattagacccaaatgaaaacaaaggctaatttagaagccaagcattgattttcccatttgttaatattatgtcttacaatgagttttaacactgaaactcatctaatattaaacagaaacggttgagttacttgttgattttcaatggctgtttttccccctgcattcctccatgcatttatttgtccttgtatcaacaattacttgagctttaccatatgcaaaggggaaggctttacttctctttggaaacatagccttccctgttgcatacagtatttccacaacacacagtcttctgattcggaggaagtgacatgatggtctatatttcaacagttcttttacagtgaactaacaactttatagatgacaccatgacgttaggctttgaaacttatgcgagggtgaggattaaggaaaacagagatcttttcgagatatttataatactctcaaaggagggaccatttggatatcatattagtttcctgttgctgctgttgtaaaggctgccaataaattaccacaaagttaatagcttacaacaacacaatccattatcttacagttcaggaggccgcagtcccaaatcagttcactgggctaaaatcagcgtggaatcagggttggcagaggatgttttcattttaatttggttccaaatactttccaatttaactttggattcctttttaaacttgtggattatttagatgtgttacttattttccaaatatttgcagattttccagagaacattcttttgttgatttttaatttcatttcattgtagtcaaagatcatactttgtatgactttaatccttttaaatatattgagacttgttctagggcctagaatattgtttttcttggtaaatatttcatgtgcacttgagaggaatatacattttgctggtgttgggttgaatgtgttataaatgttagccacatcaagttgatttagtgttaagtgtactgaatccttgctgattttctattctatcagttattgagagaggatattgaaatctttaactataattgtggatttgttcatttcttcttgcagttctaccagcttttgcttcttatattttgaaattttattgggtgcataagcattcagagttatgtcctcatgataaactgattattgtcttgaaataaccttttattgccaataatattctttgctctgaaattcactttatctgatattaatatagccactccagctttcttttgattaccttcactttagtgtatattatcccatcctcttctttcaatcaattttgcttttatatttaaagtgtatttcttgtaggtggcatatatttaaaagatgtgttttgttttgttttcagtcttactatctctgccttttaattggtcatttggtcatttatatttaacatagatattgatacacatagatttaaatttagcatcttattaattatcttctgtttgtcccatttgctctttttccttttttctgctttattttggattaattgaatttttatgattacatttatctccctttttgcttattagtttgaacaaatatttatttgttgcttgaagtctatagtacacatatttaacttgtcatattccacctttaagaatataatggaatataacacacagctactcaattttttattttattctgtattatatttcaaattatggatgtaccaaagtgtgttttgcccattaattatgatggaatttaggctgatttcatattttactctttttttttttttttttctgagacagagtttcgctctgtcacccaggctagagtgcagtggcccgatctcggctcactgcaagctccgcctcccgggttaacgccattctcctgcctcagcctcccgagtagctgggactacagacgcccgcaactgcacctggctaattttttgtatttttagtagagacggggtttcaccgtgttagccaggatggtctcgatctcctgacctcgcgatccaccctcctcggcctcccaaagtgctgggattacaggcgtgagccaccgcgcctggcccatattttactcttataaacaatgctggatgaacatccttatgtgtatttgtttacttttgcaaatatatccgtaagataaattcacagaagtgcatgtgcagttgctcagttgggcatttttctggtgttcaaatcctccttgaaagcttagcaactcacattactttatgaatactaacattttaaaaatgttcttaaaataagttccaaattcattgtggcataattaaccatagatatgtaatttctttgattagagtatatcatttttgaatttttttcttgtttttcagctttgcaggcaataattactttagagaatatattaacagatgaagagtcagaagataatgatctagttgcagagagaggttcacctaccatgcttctaagtttagctgcccagtttgctctagaggtaattcatatgtattcatctactagatttttatcccttttcctttttgaaagacaattaatagaatcattatcagttagacacagaagagacctttactgtttgttttgcctcatattttcatgccaaacttggttgcagaactgctttatttcttctcatttcactataatgcagactaaagtaaatgaaacagtgaggtaacagagttgtgctcaaaacaacataaaaataaacgtagcaaaacattaattttttaaaagaaactccaaattcaaaatgccataccatgtcaataaatagctatctatatagaaacttatctttctcatcaatttgaacaaaatggtttaaatttctggagatcctttgagttcataaccacaaaatagtattagtttagaagtaataaataattgtacccctgtttgttactacagaattctggttttattaatatattgaattaggaaaagcatagtagcatctgtggagctcttagactaggtttgaatactggctctgccatttaatctgtgcttaacttcttcaaatcttaatttcatcctttgcaaaataaagataatgcctacctccaggattgttatgaaaatcgattaagatggctgaaaatgtgctttataaactattaagtttatcttctttttaaaactactttaaataggaaaaccatcttcctgatcagaactacagttccatatttcttccagtagctctctttggctttctacatcaaatgtacatttataaaccttcctttaaaaagataattgcttttgggtttcctctctttcatcttcttccccattctgcacaaatacattccatatctgcatctgccaaatacttttcttccttcaggagttctattacccttctcactaacatcaaaatacatatcattcaaactgtatttagcaactactttgggcaagatattgggctagatgctagaaatatgttccttcaggacctcacaagtcaatttgaacagacaagccatgcattaggaaagtaagtctacagaatatagagttctatgtaagtatatagaataaagaccaaatagctaatatatatgttaaaaattaccaaaattcagagtaggaagagagcactgagaaccagaatcgatttgggaagtctctacagcggaaggaaaccttaagttgggctttggaaagagtagcatttacataagtaagaatgtttttttaaaggaagagatggtataaacaagacatggagaaaggaatgtgattggcttgagagacacagtgtttggttaaagtgatggagggcttatgtttccaccattccagatgttttgcctgatgtaatagtggctttttttttttttttgacaaagtctcactctgtcacccaggctggagtgcagtggcgtaatctcagctcactgtaacctctgcctctcaggttcaagtgattcttgtgcctcagcctcccatgtagctgggattacaggtgtgcgccagccacacctgactaatttttgtatttttagtagaggcggggtttcaccatgttggccaagctggtctggagctcttggccttaagtgatctgtctacctcagcctcccaaagtgctgggattacaggcatgagccactgcaccagccatgacttttattattatgttgatgctataggggaggagtatgagataaagtagaagaaatagctgtgacaagattatatatacattttattctctaaacaataagaaaatattgatggtaatttatgtaaaagtagtgctttaggaaaataatttgggttgtgcatggggaaatgaatggggagaaattatatgtaggacagaatgggagactgtgataataatccagttttaaaataatgagagtctagacaagggtagtgagagtggggtattaagcaggcaaaacattgctttcttttcttttaaaataagctaccttatctttaaatccctttacaaaattcattcccccacctcccaagagaaaatgtggatattctaggttctgaaaactgaagcagtcaggaagagaacttccacagattcctactacctctactcacacaccaggaatcacaccacatagtctgccttctcaactgccaccatagattagctatcatgttccttcctaaagccagtctctaaacttacacacttgtttctatcacctcttgcctttttctcactcactttgtcaacattttattctcttactggtttattcccatcagcatatgaacatgctcatttatcccatatcaaacaaacaaaaagtaagaaaacctcttgaccttccttctctcaccaactactccccaatttctcttcttccctttgtagttaaactcctctaaagatttgcctatatttactgtctccaattctctcttgagcttactccaatcaggcttttgccccaccactctaacaaaactgcttttgtcaaggtcaccaatgacctctttatcgtaaattgcagtggttaattctcagtcctcattgtatttgacctatcagcaacattcaatgcagttgatcactctttcctccttgaaacacagttggcttccaggacaccacattatccttatttttatcctacctcatgagtcactctttctttctcctttgctagttcctcttttctcttcaaccattctcagtgtcaaattatgagctcaggagaggaggtattagggagttgagaagaagggataaggtattaactattcattcagaaaagtaagaaagtgaatgactacggaagtgcaatatgcttgccagtagcactaaggccatttcatgaagttttaaaataaaacaagtagttgtatgtatttttttctggccacattcagctgatgagtggatgtaagcaccaaaatcagtagaaagttggacttaatcagagttgaggttttgccagatgaatacaataaagcaaaagaagggcaggaaaatcaaggaacaagggagtggttataattagtctccatggaatttaaactgggtatgcggtagaacatcaaggggatgagggacagtgaaaaactggtaacatcagtgggttgggggtcttactgcagttgaaggattgctggagtcagggtaatagaggtatcaagttggaaaggtaagaggcggtagacagaaagtagaatgtgtgaaagtaagagctggggtggagaactagggggagggagggagacacctagggcacaaaacttaaggaggaacttattctctgggtggtacaagtaaaggcttggtacttgtacaacactgagagcctccttaaatttttcaccctaggtgcttcactcacctcacctgtcccaccctactcctagccctgactgagagtgtgaaatgattgcaattgttagtaatgacagagtctagtgaatgactgtgggagtaaatggctaaggtaattgttagagtaaaatttcagaaaccaggaaactagaatattgggaggatcctctacctatatattgaaaatgcggaaaatatgccgcgcgcagtggctcacgcttgtaatcccagcactttgggaggcccaggcgggtggatcacctgaggtcaggagttcgagaccagcctggccaacatggtgaaaccccatctctaaaaaaactacaaaaattagccaggcgtagtggcgggtgcctgtaatcccagctactcaggaggctgaggcaggagaatcgcttgaacccaggaagcagaggttgcttcagcctgggtgacaagagcaagaatccatcttaaaaaaaaaaaaaagaaaaagaaaaagaaaatgccaaaaattaagacaggagcagtttttggaaaatataactgagcaataagtaagtcaccaacaaatgagaagaaatgacctgggagctagtaggccacagcaacaatgaagggtagtgggtgatatagtctggttataggaaattcaaagttgaggattttagggaatagaatgggagaataattttaaaatggcaatgaagagcaagaaagacacctactccatctccaggcctatgggtaagctagtgagagcaaaaacagctaccacttaagagggcttcagtggaagcagcatccttggcagaaacctagatttccattagagcaagaatatggaggaaacttttagggaagaggttgctggtagaggagattttgctgaaagtggactgaatttcagagagcatagtggaagggttggaggagtcggggagagatagaaaaagaggacagaagaggggatatatggagacttttgggaatagagtgctggaaatgagggtgacctgacaatctggggttcttttgtttactgctaataagtgggggataaagagcacaataagattagtcctagtggactaagggtagtattggcaaggctttgagtgtttgtgaatagggaggattcggtttccggggctaatgcaaatgtgtcctgtttttgtcagtgagttgcatcttcattctaccatcttgcagtagcgtttttgagaatacaaaatgaacatgtttagatatttgtcttatctttaatgaacaggaatatagataatattttgcagtatcactttgagatgtaatttaacgtattatatttgttctttttagaatggacaacaaattgtggcagaaaaagctttggaatatttagctcaacattcagaagaccaggaacaagttcttacagctgtaaagtaagtaacctacatcctgtggaagagaaagtatttcctctgcttatcttgctcttagtcaataaactgccaaaatagtgctattgagatcaaggaaacttacataaaatagcgaagcagaggagggtgaggttgggacttgataaatacttaatggtatgactgagaaaatgccacagtgagaaataagaaaccagcaggattctagagtggttctcctgttggtcaattacacttgaggccacatttccaaagggaaatggagtcacataaataaaagagtcagaggagtcttgagatacttgcatcccttcagtaaggtaaatatttaaaaatcattcaggagagatagtattttttaaagctttttaggttttaaaactttaccaactaccttattttgtcagtttgtcattatgctgccagatcccttcaaagaatagtgatcccagtttgagacccaaaggccagttctagttcctctacagaaagagaaagataaagactgatttaccatacctgatgttctagcaggtgtttttgagcaatggtataaactgtggaaccatttaagaatttgttataagcaacgcttttgttttaaaactcttttattaaattcctctttcaaaattataaaattggtatgttttcattgcaactgttaaaacaataaaatatatataaattaaataagattaatctcccctttaccctctcttttctcacttctccctcccagagtaatcaaggttagtaacttggtatgtattcattcacacatgtttcttcctaacctaagaatcactttccatattactttgtcatacaggtgtttgcttcgttttcttcttccaaaaattgctgaaatgccggaatctgaagataagtgagttatttcaacaaaaatgatgtattccccattagacaaattatagtaacttacaatataaatcatatattcagagatacttagtgtagtgggtaagatcaatacaggttttggggccagtcttcctgggttcatatcctggctctgctgcttaccagatgtgtaaccttcagcaagtttcttaatgtctctgggcttcagtttccccaactgtaaagtgggaagaataataatacctacaccattgggttgctgtgatgactcaatgagttaaaacatctaaaaggcaaaagacttatgtgatctgcagagaaacgagagtataagttaatacatgtgaaacatttagaagtgtcaggaacttaataagccctcaataatgttatctatgatagaattatgatattgcatctgttccccctttcttaacagatgactcaaatatagacatatctcttactttcccacagaacatataacctggatggcttgttggttatgattctgtatcaggtctgctgagagtattcaaatatatttctgtgcacaatatctttggaataagatattaaaacttaacaattcgttgaagactttggtcaccaatttttcgttcacaaatctcactacctcctgattatttgaaagaaaactctactcggggtgttgattagggataactttcagagaaatatcacccatctctgcattctctgcttagacaagaactctgtaatagttccctctacttcacttttgcagctggaggcaatgtattttttcaaataaattcttttggatatatctttgactgaggtaacataggacagatgacttataactgtcattttcataatgcaaattttacccaattgcatattataagttttgccttttctttataggcttcataaatccattagaagggaattcaaacaaaccaaacaaaagatgaagcaattggaattttgaataatgaccaaatatttgctgatactaagaaattattaacttttagacatgataattgtagtgtggttggttttttaaaagattgcttatctcttacagacacatcttgaaatatgtatggatgaaataatgtgatgtctggaatttgcttcaaaataatatgggagaggaagaagtgggtggaggtatcaaggagataagattgatgatgagttaataattattgaagctgtgtgataggtacatgaggattcattatgcttgtctgttaacatttggacatctttgaagttttcaccaataagaagcttttttaaaaaaggactaaaccatgataactactagattgtaagagtacctttagggctaggactatatttgtatttatctttgtatcactgaaacctagggcagtatctgacacataattgccattcgatttatttaaatgactgaatattagttatttataatatctccagcactggacttaaagatgcttcatatttctcataattgtggcatacagtcaaaccacacacattaaaaccaattgggaaatggggtaagggagggaatcctgtttgaattaatgagaaattacaaacactttttaaaatataccttcattgttttcaagtaaatgcagtgacagagaacatcctctagcaatgttttcaggtagaggttagaacctgatttaacaaatagattagactaacttgtaaaaaatattttaagtgcctaattcaatgagagggctcaagagaattgaattgtaggttcagctatttcaataacttttggtttactgtaggcaatggcaacttctttaacttctctaagctttattttcctcatctgtaaaattttaaaaactggactggataatttttataggccttttctgttccaaaattcctgtggttataaatgagcagtatctacctaagtactaacaactcatatgctaaatcttttaaaagcagtttttctcttaaatagattatacattcctttgcatgtcttcattcttatttgtactgtatatttttattaatggacccttcctagattatttgatatgaagtcaccgaattaagcagtgaagaaatcaactttagcttggctgaaattcaaattaataaatttactgtaagaagttactttatataaaccagacttctaagatttatccctgaaaaatctgctgcttttcctgaccacagtctttatatgttaaacctctactgataaggccagtcttatagtatgttctacccttcttcctgtaaacttccttagttgagtttgccaatactttcgtattcattcctttgtttgctttaagtttttatttcattttattttttaagtttaatattttatttttatttatatatatatatatatatatatatattttttttttttttttttttttttttttttttgagaccgagtttcactctttcgcccaggctggagtgcagtggtgtgatctcggctcactgcaaactccaccttctggtttcaagtgattcttctgcctcagcctcctgagtagctgggactacaggcatccgccaccacacccggctaatttttgtatgtttagtagagacggggtttcactatgttggccaggctagtctcaaactcctgacctcgtgatcctcccacctcagcctcccaaagttctgggattacaggtgtgagccaccgtgcccgaccctaatattttatttttttagttaaattttaggttcacagaaaagctaacaggaaggcacagagattcccatacatcccctctccccaccacatgcatagcctcctccattccccgccagagtgctacagttattacaattgatgaagctaaattgacatatcataatcatttgaagtccataatttatattagggttcactcttgatgttgtacattctatgggtttggacaaaggtataatggcatgtatgtatcattacaatatcatacagagtattttcactgccctaaaaattctctgtgctccacctattcattcctccttcatcaaccccttactgtctccatagttttgtcttttccagaatgtcatacagttggaatcatacaatatgtagccttttcacattcgcttctttcacttagtaatatgcatttaaggttcctccatgtatttttgtgtcttgatagcactgaatgatattgtattgtatgaacgtatcacattttatttatccattcacctactgaagggcatcttgatttcttccaagttttggcaattgtgaataaagtttctgtaaacattcatgtgcaggtaactttttagctcctttggtaaatattaataccgaggagcatgattgctgggtcatatggtaagactatgtatgtttggtttgtgagaaaccggtagactgtcttccaaagtggctgtacccttttgcattccttcctgccagcaatgaataagagtccctgttgctgtgtgccctcaccagcatttggtgttgtcagtgtttgagattttgaccattctgataggtatgcagtggtaactcattgttttattttgtatttttctgatgatgtatgatttggagcgtctttttatgtgtgtatttgtcatcgtatatcttctttggtaaggtttctgctaaggtctttggcccattcttttctcccaaggattttaggacccttgccagcaacctcagaccaaatacacttctaattataccacagtataataccacagtataaagatccctggcgtttgaccacagatcccaaatataacaaaaggatcataacggttaaaagacactggcacatggccgggcattgtggctcacaactgtaatcccagcactttgggaggccgaggcgggcggatcacaaggtcaggagattgagaccatcctggctgacacagtgaaaccccatctctactaaaaatacaaaaaattagctgggcgtggtggcaggtgcccagctactcgggaggctgtagtcccagctactcgggaggctgaggcaggagaatggcatgaacccgggaggcagagcttgcagtgagccgagattgtgccactgcactctgggcaacagagtgagactccgtctcaaaaaaaaaaaaaaagatactggcacattactggagtcccattcagtcattaataatttgtccagtccatcattatatcatgaaattgtctcccaggtcccagggcaaggctactgaggtttccaggcttctgtttggtcagattccaaaagcaggagtggtctccacaatatatggcttcaccttttcaggcatctggtataattgaactaagagacaatatcatcttttgctttgagactcttttgaggtactgatgtaatattggatttcccttactacataactcatttgttcatttcttactctcatctactattcctccttttttctatttataaccaaacttttccacatttgaaagaacattaggtgctggtccagattacaggcaacactactaatctagcaaatgcctccccctcagtccactcccatttatataaggtagggttatatagatacagaactagtggactatcttgaccattaagcaatacaactgcatttactcttaaccccaattttgctagatagggtaaagacacaccctgcccccaagaggcccttaggaattctgacataaagatttaaaaatatagttaggtttcttgcttaggaatctgccctgtttccaacacttgtagttgcagccatggtcttgctcatgtttcatcaggtaggaaacataaagttgaggtgatatgaggaggaaagaaagaaagaaaaaaatattgtcatcatgccagtgtcctacacccttgggaagaattgcagtcatactagcatccttccccaactcctcttcctcagactcagcagaaaaacagaggagtctatctagtggggacacttccttagccccaccccccatattgagtgtgagcttgtgaaggcatgtaagccagtccttcatccctatgtctgcccccattttagacaaccaatgtttcaattgcttgttccggcttccctttctaactattattccaaggaggatatatctctgcccgttgttggacattatgggttgtaaagtgtgtttcttggtctgagaaaatgtgactcagcagcccaaattggtgcagtatattctgttccagttcttttattacactctgagcatttgcatctaccactgcgtaagcaaaggccaatccagagttagtgtctattcctgtcgaaactcataccctggggctatcagcatcagtctgacttgctagctgtgttcaaggccttccccgtgaggaatctgccacatagccatcttaagtctctgtctcttttgttggaaaacagaacagttattggcattttgtgcttcagagggtacaagaggaatatgtccaggttcaacttcagaggttacaagaggaatatgtctaggttcaactcatttctttttgctgagtccccagatgcccactaatttcgtggacccagggggccgcctcaagggagcacacagagatatccacttgttgattctcatcaccttccaaacctggaaggggattcttctgatggatatcaacatgtcctacattaatgcacctctcagatttccatagtgattttccatagagtcatacaccatacaaacatcctgttaatggaccagttttccatttcccttctgtaagactacatggccaggtcattggccactgccaatgagtcagtcaaaacccaaacacaggggcttttaccactgttcaattcttccttcactgctaggaaaacagcatgcagttctgcctgctaagatgatttgtttttaccttctttgatctgatggtagccttccaaacagaatattgtttgttcaccttggaactgccatgcataaattaagcagctctttgtcaatcagttgagaactgtttatagggcactgtcccaatgacaatagaatccagcagctcctcatgcatttccaaagtcagtcctaggggaaatgagactctgctcatgagtacctcctccttgcattcacaggtagcatgatcatgtatgtataaaccacttccattttattatggagtttttctgggcactgccctcccaattagagtgtttttccaatatcacccaaggcttcatcatgggtatttcagctttcaggattattttcctccaccatccttcccatccttccaagtctccaatgtctattttatccctttctgtgtccatgtatacacattatttagctcccacttatacttgagatgtggcatttgactttctgcttctgagttatttcacttaagataatggcctccagttctatccatgcttctgcaaaagacatggtttcattccttttatggctgagtagtatctcattatatatatataatgtatatatatgtattgtatatgtgtatatatgtattatatatgtgtatatacatatatgtgtatatgtattatatataatatataatgatatatatgtatatataatgatatatatatataaaaccttcacttattcttcttttgatgcttttcctatctttatgtagatctgagtttctgacctatatcattttccttctctctaaataacttcttttaacatttcttacaaggaaatctactggcaacaaattccttcaactttctttgtctgagaggttttctttcttttaatttaattgttaattttttctgggtacatagtagatgtatatatttatgggctacatgtgatattttgatacaagcatacaatgtgtaataatcacttcagggtacatggggtatccatcacctcaaacatttattgattatacacttttagttgtttttaaatgtataattaaattactttttactatagtcacctagttgtgctagaaaatactagctcttatacattcttcctaactatttctttgtacccattaaccatcctcacttccttctaccccccgcaacccttcccagcctctggtaaccatcgttctactctctatctccatgagttaaattgttttaatttttggctcccacaaataagtgagaacatgtgaagtttgtctttctgtgcctggcttatttcatttaacataatgacctccagttccatcccagttgttgaaaatgacaggatctcaattattttctatggccgaatagtcctccattgtgtatatgtaccacatttcctttatccattcatctgttgacggacacttgggttgcttctgaatcttggctattgtgaatagtgctgcaacaaacatgggagtgcacatatctctttgatgtactgactatctcttccttctttccttctgtcctgtcttccttttagtgaaggtgatttttctctggtggtatgatttaacttctttgtttttttgtgtgtgtatctgttttatgttttttatttgaggttatcatgaggcttgcaaataatatcttttaacccattattttaatctgatgacttaacactgcttgcataaacaaattaactactaacaagcaaaagaaaaataatacaaattctacagcttaacttcttcccctcactttttaactttttgttgtttctatttatatcttatactgtctatgtcttgaaaagttgttatatttattatttttggttggttcatcttttacttttagtttttctatttaagggtagtttatacactgtacttacagtgctataatattgtgtttttttctgtgtatttatatattactagtgagttttgtaccttcagatgcttttttcttgctcattaacatcctttcatttctgattaaagtactccctttaacatttcttttaggacaggtctggtgttgacgaaatccctcagcttttgtttgtctgggaaagcctttatttctcctacatgtttaaaggatatttttgccagataatactattctagggtaaaagttttttccttcaacactttgaatacgtcatgccattgtctcccagttgtaaggtttccatggaaaagtttgctgccaagcatattgcaacgccattgtatgttgtttcttttctgttgcttttaggattctttctttatcctgaacctttgagagtttgataattaaatgtcttgaggtagtcttctttgggttaaatctacttggtgttctgtaactttcttgtacttggatattgatatctttctctagatttctctagttttctattattatccctttaagaaactttctacccatgtcactttctctgcctcttcttcaaggccattaactcttacatttgctcttttaaaactgtcttctagatcttgtagctgtgcatcatttttaaattcttttttcttttttcctctcaccgtgtgttttcaaatagtgtgtctttgagctaactagttatttcttctgcctgatcagttctactatttagaaactctgatatattcttcaattgcatttttcaactccagaatttctgcttgattcttaattattttaatttctttgttaaatttatgtgatagagttctgaatttcttctctgttattttgaatttgaatttcctcaaaacagctattttgaattctctttctgaatggtcacatacctctgtttctccagaactggtccctggtgtcttatttagttcatttggtgacatcatgttttcctgggtggtcttgatgcttctgggtgttcatcagtatctgggcactgaataattagtattattgtagtctttgcattctgggcttatttgtacctgtccttcttgggagggctttcgtgatatttaaaagtacttgggtgctgtgatctaagctgtatctgcattaggggacaccacaagcccagtaatgctatagttcttggagactcatagaggtactaccttggtggtcttgaataaggtccggaagaattctctagattaccaagcagaaactcttgttctcttcccttactttcccccaaacaaacggagtctctctctctctctcgctctttctctgtctctctctctcactctctcctgaactgtctggcattgggggtatgttgatacaagcacccctatggccattaccactagaactgcactgggtcagacttgaagccaacacagccctggttctcacccaaggcccactgtaagcactacctgactaccacctgtgttgttggttcaaggccttagggctctgcaatcagcaagtggtgaaaccagctagtcctgtgtcctcttcagggcagcaagttcccccaggccccaggtgagtccagagaagctgtccaggagccagggacggcagtcaaaaaccttagaagtgtagctcagatgttctcttctactgtggctgagctggctgtcaaaccatgagacacagtccttcccactcttccctcccacttccacaggcccatggggagtactgccagcctaccgctgatgttcacttaaagcctgaggacttttcagtcaccttgtggtaaatgctgccaggccttatttcacctttcagggcagtgggctcccctctggcccaaggcaggtccagaaataccactcaagagccaaggcctagaattggggatcctgagatcccgcttgatgctctaccctactgtggctgagctggtacctaaggcataagacaaagtcctctttacttttccctctgcttttctcaagcagaaggagtctctcaccatagctgccatagctgggaatgtggtggatctcacctgaagccagcacatctcagagtttcacccaaggcctacagtgtactacttgggatcactgctgattattcatggcccaagggctcttcagtcaacaggtgatggatccttccgggactgggtccttcccttcaaggcaatgggttctcttctggcccagggtgtgcatcaaaatgtcatccaggagctagagcctggaatgggggtctcatgcctctgcccagtgccctatcctactgtggatgatctgatatccaagatgcaagacaaagtcttccctctcttccctctcttctcttcaagcggaaggaagaggtctcctttggagccacaagctatgctacccagggttggggaggggtggaacaagcacccccttagctaccccagctggtggctcagtaagttgcgtgcccccaagtccattggttctgagcccagctcagcactaagacttgcagtccttgtggcctagactgtctttcaagtttatttagagccccagagcactttagcccatgatgacgaggcttgctggaattcagattccaacgactgggatgggagattccccacttgctacagctggtccaaatgttccctctgttagcgggagttggctgtgtttagcccagttttccttcctgctgtgacagggcagcactgagttcagtgcaaagtctgataatctctgcactctctctctctttctcaagtgcgcagatttctctgcaccaggcagctgctgggggatagggaaggggtggcattggtgattaaagactgtctttcctaccctcttcagttcctctttcaacaatatgaagttggaaccagatactgtgagtgctcacctgatttttggttcttatgagagtcattttttgtatgtagacagtggttaaatttggtgttcctacggtgggggaggatgatgggtgggccttctgttccataatcttgctccacccctgtgtctgagagtctttattttccttcacttttgaagtataatttcacaaggtacaaaattctgggttagtgggattttctctcaacatttaaataatttgcttcagtctcttcttttttgtgtggtttctgagcagaagtagaatgtaattcttatctttgttcctctttaggtaaggtattttttcctcaggctttttttcagaattttgtctgtatattttatttcctgtagtttgaaaataaaatgcctagatgtctttttttgtcatttgtcctgtttgatgttctgagcttcctgaatctgtgatttgatatatatgacattaatttggggaacttctcagtcatattatttgaagtattttttctgttgcattacctattcttctccttctggtattcccattacacatatgttacaccttttgtagttgtctcacagtccttggatattctgttctatttttttcagtctttgttctctttgcttttcagtttgggaggtttctgtttatataccctcaagggcagagattttttttttcctcagctttgttcaatctactaataagcccatcaaaggttttctcatttctgttacagtgtttttgatcactagcattcctttttggttcttaggatttccatctctctgattactttgctgatctgcccttgcatgctgtccactttatccattagagcccttagaataattatcataatcgtgatcaattatcatagttgtcttaaattcccagtctgataattccaacgttcctgctatgtctagttctagtgcttgctctgtgtcttcaaattgtattttctgccttttagtatgccttctaattttttcttaaaagctgggcatgatgtaccaggtaaaaggaactattagtttcctaataaataggcctttagtaatgtggtggtgaattgtggggagaggggaagcattattattattattattattattgagatggtgtctcgttctgtcacccaggctggaatgcagtggcatgatcatggctcactatagccttgacccccacccaggcccaagtgatcctcacacctcagtctccagagtagctggaactgcaggcatgtgcaaccacagctggctgatttttaaatttctgtagaaatgtggtctcactgtgttgcccagactagtctcaaactcctggattcaagcaatcctcccgccttggcatcaaaaatgctgggattacaggcatgagccactgcacctggctgggaagcattgtttagtcctatgattggtcttttagcaagcctatacctctggactgtgaacttcacaagtgcttctcaggtttttttctcccccattaagtgggacaggatggctagagtggactgaatttgagtatttcccttctccgagatcagttaggctctgatataccccagaaggtcaggctgtggttaagcagtttctcttgagggcaagacttgttaagaacagggtgctctggcatgttttaaagtgttttgtttcctctgccccctgcaagatgcataaagagattttgctccaatattcactgagtagctaaccaagctcctggaggcaaaactcacaaaactgtggaggcctccttatgactgggtcctcctgagtcttttaattcagacttgtccacactgagcctccagtggtttgtcagttacgcttcaggttttcctactccagcattggttcccatggtagtttccacttttgaatctctgctctagtaagctatgactccctatcttcgcccttctctccaatttttgtggcagtggttttccctttttcctctcgtctcttataggtccaagaagagttactaatttttcagtgtgttcagcgttttacttgttaggagaaactggcaacttccaagctccttacatgcataactagaaaccggaagttctcttttaaattttatatgcttaaagaagcttgacagaggggtcaggaaacctgggtctactcttttcttcatctgtaaaatgatgtgtctgtacaagataagttattttttaagctgcattccttagaaccgtggaaattttgtggcactgcatcagggacttccaggaaggtgaaactccaagcctccacccactcctcgttcaaccacagcagctcaacttttatcttttatcttttcttgtatattagacttttatacaactttatttgaaataagggttctagttccccccttcaaaaaagcttataaatcacagagatcaccagctgctctcaagtgttatgaccctacaatataaaaccttgtcattgaaatcctttgctgagagtttatgaagaagtagaagagagaaaaaatatgagggcactgggaatgagtaactgtatcctacagtggggaagaagattgttgaaatggtagattggagtcctgagcaaaaaacttcacaattttgcattttcttagttcaattctcaggcacaaatagtgtccctttttagttatgttttatagtaaagatttggagcagttggaaaatatccttttctttatttttaggaagaaagaaatggatcgacttttgacttgcctgaatagaggtaaatatctccctggttatattcagtccttcatcttgcctctattctctgttgaattctccaagtacactaagcacagcaactttaaccttatgtttgagttaagcttcatgctccttattaatctttgccacaggaatctattttggtttcttcattcacaagcagagaaaagtgtgtcatcattagcattcatctccaaatgtgatttcagttctgttttaattcctatttgttttaaggacatttccttccctccctccctcccgtccctccctccctccctccctctcttccttccttccttccttctttctctccttcccccttccctccctcctttcctttccttctctcccttcctcccttctctccctccctgtccctctacctttcttttctagtagccacttgatcctaacctaagaattgaacaggtgaaaaaagatcaagacaaataaaaatactctgaaccctgctgtttttttcataccctctgaatcaaattcaggttgcatattctcttattttgaagctgtccacccaagtctgtgccatctcccttatctactaataatttttccctgtccactttattcaagctaatctcctagttgtatcacattttttttctaactacatgcttttttacatggcatcccttttaacagatctcccatttttactgtccatgtacctctttccttatgtccaaaacacaccaaaaagttcatatcttagaaattctatcctgctcagtgcagtagttcaattttatacctcaaatacctgtcagcagggtgttaaacatagcaaagtggtttagaaaccagaccacttcttttcaaaagagaaaaactttgctggttggcattcttatttctcagaaagagaatgccttctgatagtgatagcacattctggttctgtcctgagcttgctggctcagtaaatattatgccagcatattgatacccttctaattttcaatctccagttcagtcttttaaacgattgtttctattttttatttcctcacatgtaaatcatatctttctacctcaggtggtgaatgattgcactaattaaaattataaatctctccaaagacatgtttgttccccagagtttgagttaacaacttcttggaacttggtaatgctttctgtcattttaattacttttggtatgcacccctacacacatacacaaaaaagaactttctaaattcaaactcctgtgagactgttcttaaagcaggattaaacaattttgctagagtataaaataagaccatcagtatcaaattttcctgtttgatgcagcctttgtgaaactttctcagccttttggtgaagaagccttaagtttggagtcaagagctaatgaagctcagtggtttcgaaaaacaggtaagaggaaattctgtggctctgggaaacattgtggggtggtggaattagacagatgtgatttcaaattctggatctttcatttgtagctgtgggtacagagataacttgcttaatctgttttattacttataaaatggaaatagttatatatacttcatgcagttattaagggttttaaatgaaacagcatatatacttttttcatagtagatactcaatggacattagttgtgtcccttttctatagaaatgggtctaagatgaaactaatgaactgtaactacaggtcctcaaggttgtgctcctaaacttggtttagaatacttaatttttttttttttttttttgagatggagtctcgctctgtcgcccaggctggagtgcagtggcttgatctcagctcactgccagctccgcctcccgggttcacaccattctcctgcctcagcctccctagtagctgggactacaggcacccgccaccacgcccggctaattttttgtatttttagtagagatggggtttcaccgtgttagccaggatggtctcgatctcctgacctcgtgatccacctgcctcggcctcccaaagtgctaggattacaggcgtaagccaccgtgcctggcctagaatacttaatttatttctgagtgtgattgaccaaaaatgaactatatacaacaatatggatgaatctcacaaacataatgttgagcaaaagaagctagatattgaagaatacatattgtgttgttcattttatttataattttttaaatgggcaaaactaatatatggtgttataagtcaggataatggttaccctggaaaaggagttggacttgaaagttgtaggagcttcagggtttctggtaatgttcaagatctttcttaatgtgggtgccagacgcatggatatgtccactttgtgaaaattcatcaagctgtacaattatgagttgtgtaatatactttataatggctctatttcaataaaaatgattttaaaacttgcggaggcagttactacagtgataagtaagcatgagcaattaagcagcagtgccacaaagtggactgattctacatgaacctctccctgtgttatgaggtttaatagggctttaatcctgggagaaagggaatgaatactgcaatctgacttctaagaaactgatgcaaataatgaaaaataacaaacatttaaaatatagacaagtttggtgactttaatcttttgaaggtttgaaaaggaatgtttttactttactgcattttaatttggattttccaaggggaagatgatgctgactgatgcctgatgagggcttctactgctctttggaagatatgaatctctccagtaatttttctcaactcttgattacagtgtaccttgttcttaggtgaattttaacttactttcaccactgcgagttagtgagctctatccatgttgatcttcatttttagatagattagtgtcaattaagaattttttttttttttgagacggagttttgctgccagactggagtgcagtggtggcatcatagctcactgtaacctcaaattcctggtgtcagtcttctgggactatagttgtgtgccaccacacctggctagttttgttttgttttggtttgttttttaatttttttgtatagacggagtctctctctgttgcccaggctggtcctgaactcctggcctccagcaatcctcctgccttggtctcccaaagttctgggattataggaatgagccaccaagcctggcctcagctaagaattcttattgcatgtccccaattttaaaaaattcagcagtacctcccttggtcattggtctagtgttgaagattggaattgacgagggtctctaaatttacctggaaaatttttctttaaaacctaaagttaattgtttaaaccttgagaaaccccttactagtatgttaatatcaaaggtgtaagtatcagaaattgtaatggtacagactaaatggtagattttcataatttcatattattatgttatttcatgttaatttccagcttggaacttggctgtgcaatgtgacaaagatccagtgatgatgagagagttttttatactttcttataaggtaagtttcttttaataagtatctcatgtatggaccacaacaaggctataaccactatggctatagtaaagggctaaatatagactaggattgtctcttgatctaggaacttttaatatatatgtaagcaggaatgacctaagaagaatttgttccttttagggtataacataagaatgtggggcatatctttctataccaaaatatcagaaacattcatcagggagcctaaagttctaccatttaagacttatttctttgcctttgaagggatctcagcctcccaaagtcctatattaaaatgtaaatatctttaggaggggaatactctaagtagttgttaattaccaacacattatgaagagttatgggaataagtctacaagaacatagaataagtatctggggatagcaggggctgaaaaaagagataagaagcttaggcctcctttataactttcctatagcaggtcctgagtgtagcgatttgtgagtttgttatttaattataagcatttttaaatagtcgttggcctccaaggtagaggttaaatgccagaaagaggaccaagtattgacaggaagataaaaggagaaggactaaagaatatccttcatacacattcaggaatacacagtatgatatgttgagatcaattaaatgttaagagttttagagctagaaagaactataaagactatctagcacaactccttcatctcacataagagtaatcagagacctaaagagattggttgtcttaaaatgctattaatttaataacaatgatgattatgatcactgaatgtttggggagattaagaaatagtctttgcaagtttaggcataactgccattttaattaagtgaaataaattggttttagttttggcatttgtgatgggacttgtaggattggcgtgtaagaatccaaatggcctagagttttattgtagtagctgggagtttttcctaaaactatacaatgttaatgatgaggtcatgactaatgcctgtcaagatttgacaatgcctctttcaaccatgacaatatatgaactaattttggctctattcaatacaaaggtggaaatcttatttgccaggggaaaaatcacttacaaattacaacataaaccaagaagtaaatcactagatagaaatacaagggcgaatgatactacttgtcactggaaaagataggaatactgtgaagaaatgaagctttttatctctaggaaggtactaaaaacaatggaaagtaatataaaattaaaagcataaatcagtattatagtttatatcatttctatggtgacatgtgcttttccagctgaattttctcattcaaacaggaagttgctgattttcattctgattgtttgtgttcacctggcagaattctcactattcattgatgttctggttacttcttatcagatgtcccagttttgtccttctgatcaagtaattctgattgcacggaaaacatgtttacttatggcagttgcagttgatctagagcaagggagaaaagcttcaacagcttttgaacaggtaatgtgcaaccttcaaagaaaagacaagagttcagtgtgctatttgatatgtttgccttccctgatgcagttctttttgattctctttagagaatccttttctccactccagcatcgtcttgatttcaaaagtttgtaatggctaattccttcctaagcaaaggttacttttggtgtggcctcttcttttaagaagattagatatctcttcttttaaaattccccttcctatggaccactctttccaaaaatgtttttaaatatcttttatcttcattgtctgcctgtgattatatacgcgtttggactccacttttgtttcttaccacatcttctaaggaagaactcatctgtttccatagctttgatagccatctgaaattattacttatctggtttttcttctctcaattgcatttgctttctttttcccacatccttaaatatctcattaacttaatttctacaagacagaattccttacctttgcctgaattcccctatcagattcttaaatgttaccccttttaggagctatcaatatcaccgtctcccatacaccagattattggtttgcttttagctgtttacctttcttctttcaatctaagaaaattgtctccaaatcagaccaatagcatttttgtatgatttttaagatctagatctctctgcttggtttctcgtacctggacaaagaaaacttcctaatctcccatacttgtcaccttccctcctctccaagtaatataaaccctttgctgtttattctcttcctcctgttaatctcttatttcatattgttctttggatctgaaacaaactctcaccagagctatgccaactatttcgcttcttttcccttccattgttgagttcaactcaaaaaacatttgagcaccagacacttttctaggtactggggatacagagataaagaagccaaagtccttgcctctgaggagtaaagggggccctcttttaagagtctttttattttaaaagaagatgagaaaagactctaccttccccagagcaaaataaacaaacaaaaattctacttaacaggcaaaggtaaatgtaatttaattctcaatagggacttttgctttactaaaaaataataataacatcttatttttatatagtgcttttaaatttctaaaagtttttcctttttggttggtaatcctgagtttgtttaattttttatcttagtgaatagagatcaaattgatgtgggggaaatttcacaaactcttaagtacaatcattattttgtttgtttctaactaccgttcttttttattctgtgttctttctcatgtacacctctgtgttttctcagaactctctaaactagtaacctttctataatcttctttgcttttgaaaggatgtctatatacataattgaagatgcacttctgccttttatcatctaagtgtggtccctatgaatcggacagtggtactctgtctctctaaagaatacttgttcatgtccttcgcccactttttgatggggttgtttgtttttttcttgtaaatttgttggagttccttgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccactgcttttggtgttttagacatgaagtccttgcccatgcctatgtcctgaatggtaatgcctaggtttcctttagggtttttatggttttaggtcgaatgtttaagtctttaatccatcttgaattgatttttgtataaggtgtaaggaagggatccagtttcagctttctacatatggctagccagttttcccagcaccgtttattaaatagggaatcctttccccattgcttgtttttctcaggtttgtcaaagatcagagagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcctttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttctctcatgatttggctctctgtttgtctgttattggtgtataagaatgcttctgatttttgtacattgattttgtatcctgagactttgctgaagttgcttatcagcttaaggagattttgggctgagacaatggggttttctagatatacaatcatgtcatctgcaaacagggacaatttgacttcctcttttcctaattggataccctttatttccttctcctgcctaattgccgtggccagaacttccaacactatgttgaataggagtggtgagagagggcatccctgtcttgtgccagttttcaaagggaatgcttccagtgtttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattatattgaggatttttgcatcaatgttcatcaaggatattggtctaaaattctcttttttggttgtgtctctgcccggctttggtatcagaatgatgctggcctccagccgccccatccgggagggaggtgggggggtcagccccccgcccggccagccgccctatccaggaggtgaggggcgcttctgcccggccgcccctactgggaagtgaggagcccctctgcccggccaggaccccatctgggaggtgtgcccagcggctcattggggatgggccatgatgacaatggcggttttgtggaatagaaaggcgggaagggtggggaaaaaattgagaaatcggatggttgccgggtctgtgtggatagaagtggacatgggagacttttcattttgttctgtactaagagaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcagaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaaagaatgatgctggcctcataaaatgagttagggaggattccctctttttctattgattggaatagtttcagaaggtatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacctagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcaaagctgagttcaattcctgggtatccttattgacattctgtctcattgatctgtctaatgttgatggtgggaagttaaagtctcccattattaatgtgtgggagtctaagtctctttgtaggtcactcaggacttgctttatgaatctgggtgctcctgtattgggtgcatatatatccaatacgaagacatttatgcagccaaaaaacacacgaaaaaatgttcatcatcactggccatcagagaaatgcaaatcaaaaccacaatgacataccatctcacaccagttagaatggcaatcgttaaaaagtcaggaaacaacaggtgctggagaggatgtggagaaataggaacacttttacactgttggttggactgtaaactagttcaaccattgtggaagtcagtgtggcaattcctcagggatctagaactagaaataccatttgacccagcaatcccattactgggtatatacccaaaggactataaatcatgctgctataaatacacatgcacacgtatgtttattgaggcattattcacaatagcaaaggctaggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacagaaaaccaaacaccgcatattctcactcataggtgggtattgaacaatgagatcacatggacacaggaaggggaacatcacactctggggactgttgtggggtggggggagggggagggatagcattgagaggtatacctaatgctagatgacgagttagtgggtgcagcgcaccagcatggcacatgtatacatatgtaactaacctgcacaatgtgcacatgtaccctaaaacttaaagtataataataaaaaaaaaagaatacttgttgatttctgttgtatacatctgctccctgttctctaaaccctcataagtgggaatatttccaaataagtagctgatgaaggaatatagatggactgcatagttttatcaacattgcctctacccttctgagtatgagttaggagaaattgagggataggtaaaaaacatattctaattgtaatttgtcaaggaaccacaccttcttcctagagcaggagtgggtaaactactgccagctggccaaatcaggcccctggggggttgtagttgaaaataaagaaaataaagaaaaatatttctttattttatttatttatttctttattttctttatttcttttcttttatttgtatatggctaggaaagcctaaaatatttactgtctggccttttgtacaaaaagtgtcctgatccctatccttgattatattttaacagacttattgaggcataattcacataccttataattcacccacttaggtatacaatttattggtttttagaatattcttagaattgtgcaactgttgatacaatctaattttagaacatttttatcaccctaaaaagaaaccccttacccacttagcaatcacttctcattgcctgccaccagcactaagcaaccatgtactttctgtctatataggcttgcctattccagatatttcgtataaatgtcatcatcatcatattttacacgaaagtcaaatgttttttgatgtgtagtcttttctgactggctccttgtataaatgcctgaataacattttcaaggttctttgtgttgtagcatgtatcagtgtttcatttctttttatggctgaattatattccattgtataaatatatcacatttttaaaatccattcatccattgatggacatttgggttgtttccaattttcagctcttgtgaataatgccgtgatgaacaatttatgtacaaatttttgcatggaaatctgttttcatttctttcaatatgaaatatacctaggattggtattgctgggtcatacagtaactctatgtttcatcatttgaggaatgctggagtttttcaaagcacctgcaccattttacattccaaccaggactgaatgaggattccaatttctccacctccttgccaccacttgttattatatctttttaattatagccgtcctagtgaatataaattgatacctcattgtggttttgatgtgcatttccattatgactaatgatgttgagaatcttttcgtgtgtttattggccatttgtatatcttctttggaaaatatctattgaaatctttttgcatttatctatttatttagagatggagtcttgttctgtcacccaagctggagtgcagtggcacgatctcagctcactgcaatctctgcctcccaggttcaagtgattctcctgcctcagcctcccaagtagctgggactacagccacacaccactgtgcccagctaatttttgtatttttgtagagacagggttttgccatgttggccaggttggtctcaaactccttatctcaactgatccccccacctcggccttccaaagtgcttcatgctcattttaaattagcctatttgtctttttaccactgagttgtaataattctttatatattctttatactatactcttatcaaatacatgatttgcaattattttctcctgttctgtggtttgtcttttccatttcttgctagtgccctttgaaatacatttttaattttgatgatatccattttatttattttgttatcatatctaagaccattttctaatccaaagtcatgaaggtttacctcaatgttttcttgtaaggttttttatattttcagctcttacatgtagatctgtgatccattttgagttaatttttgtgtatggtgtgagataggggtccaactttattgttttgcatttgaatatccatttgtcctagtactatttgttgaagactgttttttccccttgaattatcttcgtgccattgttgaaaatcacttgaccacaaatgagaaggtttattctcaattctattccattgacatctatgtctatcctcagggcaataccacattgccttgataattatagctttatgtagtacattttgaaatagggaggtgttagtcccccctcattgttcttctttttaaagattgttctggctattctaggtccctggaatttccattaggaccaacttgttgatttctgcaaaaaagccagctgtgattttgataggggttgcattgaaactgtaaatcagtttagggagaatattaaagcctctgattcatgaacatggaatatctttccatttatttaggtttttcacttctttcaacaatgttttgtggttttcagattataaatttttcactactttttgtagtctcttcagattttgtatttcctcttgagtcagttttagtagtttatctttctagaaatttatccattacatctaagttatagaatttgttggtttacagttgttcatagtattcccttatagtcctctttatttttgtaaggtcagtagtgatacctcctcttttactcctaattttagttatttgtgtcttctctctttttgttcttggtcagtatagacaaaagtatatcaatttgttgttcttttcgagaacaacttttggtttcattttttctattgcatttctagtctctatttcattaattcccactcaaatcttccttctgcttgcttacagttcaatttgctttgtttttacagcttcttaaggtaaaacttggagttactgatttgagatatttcttttttttaatatcaacttttgcagctataaatttcccttcaagaactgcattaaactgcatcccatacattttggtatgttgtatttttttcattcatctcaaaatattttctaatcttaattatgttttcctgtttgacccatttattatttaggaatctgttgtttaattttcacatatttgtgaatttcccaaattgttttctcttgctgattttaaattttattccactgtggtcagagtacatactttgtgacttcaattattttaaatttatttgaagtttgtgttatggcctagcatgtcagctatcctagagaaagtgccatgcatatgtgcttgagaagaatgtacattctacttgggttagtgaaatgttttatggctattaggtctagtaggttgatagtgttgttcaagtgttctatatccttgatggttttctgcctacttattctattcattacttaaagtgggctattgaagtctccaactaataaaagttgaagtatctatttctttcttcaattctacccagttttgctttatatttttggggctctgttgttaggtcatatatgtttataattgctatacatttccaatggattggcccttttaacattataaaattttcctctttgttcctagtaattttttttttgttttagagtctatttttgtcttattttagtagtgtcaccctaacattcttatggtcaatgtttccataacataactttttccatcctttcacaatcaacctatttatttgtctctgaacctaatatgtgtctcttgtagacagaatgtagttgggtcatctttgtttcaatatgataatctttgtcttttattgggttgtttaatgcactcacatttaatgttactatttttatggttgaatttacttatgccactttactttttggtttctatatatctcatgtattttttattcctgattttctcctttactcttttcttttgcattaagtgaatgttttctaatataacatttttgttcttttaatgatttttacacaatatttgagttattttcttagtggtcactctggggcttacaatatagatcttaatttatcagaatctacatcagattataaacccaatttcagtgagatatagaaatgctattcctattaactctgttctctcctctttttttatgctattttgttatacacattacatctatatatgctccaaacacaacaatacatcttatagtatcactttatagaattttaagtattttaaagaaactcagagaagaagccgggtgtggtagctcacacctgtaaacctagcactttgggaggccgaggtgggcagatcacttgaggtcaggagttcaaaatcagcctggccaacatggtgaaaccccatctctactaaaaatacacacaaaattagctgggcatggtggcaggtgcctataatcccagctactcaggaggctaaggcaggagaatcacttgaatccggcaggcagaggttgcagtgagccaagatcgcgccattgcactccagcccgggcaacaagagcgaaactctgtctcaaaaataaagaaacttagagaagaaagtatatattatggtttcttatattaagcatcttacttaccttttatgcttttcctcattttttcctgtagattagagttactatatggtctctggattagtctgttctctcacacactatgaagaaatacctgagactgggtaattcataaaggaaagcggtttaattgactcatagttccacatggatggggaggcctcaggaaacttagaatcatgatggaaggcacctcttcacagggtagcaggaaagagaatgaaagccgagtgaagtgggaagccacttacagaaccatcagatcttgtgagaatttactatcacgagaatagcatgggggaaactgcccccatgattcaattacctcccactgggtccctcgcaccacacatggggattatgggaactacaattcaaggtgagatttgtgtggggacacagccaaaccatatcagtctcattttcttactccaaaacaactttcttcccacctgcctcttgtgctgttattgtcaaatatatttcatttctatatatcagaggcccaacaatacaaatatatattcacatatatgtgtatatatattgtttttttaaaacaagagaagaagaaatatacatttatattaatactatcttttataattatataattaatgctaccagtgctctttgttttttcatctggattcaaattactgcctggcattacttgcttttcagcctgaaagattgtctcttagcaacgaattctctcagctcttatttatccagggacatctttatttcaccttctctgaataatagttttgctaggtattagattattagtagacttttatttttctttgatcactttggatatgttgtcccactgccttctggcctttattgtttttaatgagaaatcagctattaatcttaatcacccgtacatgtggcgagtcatgtttctctttgctagtttcaaatttttctttgtcttttaccattttgtaatgtatcttggttggatatctttgtgtttcttgatcccacctagagttttttgggcttcttgagtgtgtagattattgtttttcatcaaaattagggaattttcagccatttgtttaaaatattttttctctttttcgctccttttcttttggtaatcccattatgggtatattggtgtgcctaatggtgtcccatgttttactgaggcttggtttattttttttctttttcattctgctctcatattttgtaatctctgctaatctatcttcatgtttgctgattgcttcctctgctaagtcaaacctaatgttgataccctctagtgagttttaaaatttcatttattgtagttttcaactccagaatttccatctgatttttataatttttatccttttattgagattcatttttgatgaacatttttatcataccttctttctttaagtgtggtttcatttagtatttgaatatatttaaaatagctgctttgaattctgtgtctattaagtttaacatctgggctttttcaaaatcagttcctgttacctgcttttttcctatgtagaagtcacactttcctgtctctttgcatatcttgtaattttctgttgaaaactggacgttttagataatatgttgtagtatctttgggtactgatctccccatggggtttgtggatgttaatgtttgcttctttatttgtttagtgaattagctatagggaaatagtgaagtctattttccccatggtacatagactctgatgtcactctttggaaggcacagtctttgcctgtgcaaagactgcttatacctccctctggtaaaggatgacagtgattttaggagagttctttattactcttttcctgatctgacctcttaagcttctagatgaccttcttctattggtagcacatccagctgttagtcttgactaattgctaggtgattactgtgtgtgtgcgtgtgcgtgtgtgtgtgtgtgtgtgtgtgtgtgtgtgtgtgtgtgttaaaatgctcttgtgcataaattgccccacagcctgttccaattaaaagaagacccctttgaaggaatagaaatcttcttagctgtctcttcacatacttctctctataaacttctagttggtctattattttcttcttaatatcattgagctatcaatctcctcttaattgctcactaccaaaatctccatgattttttacagtgtccttagacttgaacttccccacgctctgttccaattaaagtcatttcctttagggagtgctatagatctgcctctcctactgggcagaaactgaaccactgttttggagctaggggcagggacagtggcccacttctgtcagagtgacaatccaattgtatgagtggaagactggacaagagttgtagtccctgatagtcttggcttgctgctcccagcatggacactctatcctataagcagctgagatgagagctgagatgagagagctgagatgagatgagattgagacccaggatcctgagcttgcaatgcctgggatagagcttttgccttacaaatagaggctgggtagagaaagagagttctaggcctctgagctatgcttgtttataatagagcttctacaatagagatctggggggatgagaagtgccagcattctggcccttcagagaatccctagcccagaaactggaggtagagagagtcctatcttcttggccacacccacctaaagtagtgcttacatcacactgagctggcggatggtgagtgaatcatagcttaaatgtcacaggctcttactgttcttactaagacttagtagatttcctggaataaatgtttcttcattttctgtataccctcagggcaatttcctgagcctttacatgattatgttttctaattttcactagttatgatgattgttttgctgaggagaggatccatggagctcctcacacaaccattctagaagtgtttctcttctgttctagattgttaaagaaattgataatgctcaagattttctatttaatcctcatttttctgaaacagtaaggaaatgtgcaaatagaggctaatatttctatataaactccaaaatgttcagtttaaactatcatttttctattaatttatttttacctgtttttaatgaaaatgatatgagattatattaatttgcttaaagttcttttttgttgggactaattaacttgttgcactgttgccaaacagaccatgttcctgagtcgtgcacttgaggagatccagacatgcaatgacatccataatttcctgaaacaaacaggtacagtaggaactggaagtttggtaacacagtttgaaaggagcttagaatcgaataaacaagtcttttgtcaccagaaatttgtgccactgcagtacttgataaccagtcaaatgttttttttttctgttgttttgtttgttttttcgagtcagggtctcactgtgtcacccaggctggagcgcggtgatgtgatcttggctcactgcaacctctgccttctgggttcaagcaattttcccacctcagcctcctgagtagctgggaatacaggcatgcactacaacgcctggctaaacttttctattttttggtagatatagggtttcaccatgttggccaggctggtctcgaactcctgacctcaagtgatttgcccacctcggcctcccaaagtactgggattacaggtgtgagccaccactcccagcccagatgattctttaagagctgattttttccccactctatatcagtattgactctgtaacacactacttagattaagaatattttttactttgctttatatgaaagtatagcattaaatattttattattgtttaacataatattatcaatcttagatcactagatttaatgtctaatttaatcaagctttaactttgactaaatgtaggctagtcttcacaatcaagataacagatactgctaatattttgttataaaattatctaaataggctgcatgcagtggctcacgcctgtaatcccagcactttgggaggccgaggcggacagatcacctgagattaggagtttgaggccagcctgaccaacacggagaaagcccgtctctaccaaaaatacaaagttagccaggcatggtggcacatgcctgtaatcccagctactcaggaggctgaggcatccttgaatctcttgaacccaggaggcaggggttgcagtgagccaagatcacgccattgcactccagcctgggcaacaagagcgaaactctgtctcaaaataaataaataaatacataaatacacaaataaataaataaataaaataatctaaacagtagtaagcctttggaagttatataatatcttgattctatttcctgattaaatatggtattggcttttaggtttagactgaagtttttacaatgtgtttttctgtccctgtttcagaatttgttaaaatcaatggatattcaattgaattacatgctttttcagactttatggagatagtcatatttttctcttttgaactattaatatattgagttataataatagattttataaaattaagtcatcatttcattcctggaataaaccctatttggtcatagtatgttattattttaatatattgatgaattctgttttccaacatttagaaattattggtctgtcactttgtttttgcttatgtgttatgtctttggcagtttgagtatcaaattataggaattataaggaagaacataaacatatgaaatttaatttacttctcgtagtctatgacagtcacttaaatgaataaaaacaacaaaaagtaaagatagagaaaacccaaataaaatacttattatagaagatttaatgggagtaaaactctgtagcctgaaaatatactgtgtatcctgagaacagaaaacatatcatcttttcgtgtgccttttgaagttttacaaaattgatgtcaaggaagacctgaataaattctaagacatgtaaataaaacagacaacatcgtctgatcacaatgcaaaaactagagattaacattggaatcattcttttgaaataccctaccacctggacattttttaaaaacccaaactacagtatacctaggctctaatggtaatgaaaataactcatagtagaatttaaagtgctaaagcagtgctcagagcaaattcattgcctccgtgacttttctttaagcaagtatgcagtggctcacgcctgtaatcccagtactttgggaggccgaggtgggtggatcacatgaggccaggaattcgagaccaccctgccaacatgacgaaaccccatctctactgaaaatacaaaaaccagccaaatatggtggcatgtgcccgtaatcccagctacttgggagcctgagacacgagaatcgcttgaaccccgcaggcggagtttgcagtaagcctagattgtccactgcactccagcctgggcagcacagcaagacactgtttccaaaaaaataaaaaataaaaaagtatgtcagaatgctaactgtccaccaaaaaaaatgaatttcttcttttttaggaatacaactaggctatagatagagtagatagagagatatagtgagatagagataaatgcctctctatatatacatatatatagtctaagtatatttttatacacacagctagactatatacatatatatatgtatctatatagtttatatatagacttcaggcaatcttcagagtttttttaactgtctatacattatagagatttaatggctgtagttaattaaggtgactaatatcagaatgaaggaaagtaaaattccctattggaaaacagtacattatttcatgaaagttttgtggtaaaatatatataacataaaatatgctattttgaccatttttaagtgtacagttgtacaaccattaccactatctatttttaaattttttcatcatcccaaacagaaactctgtatccattaaagaataatttccccattccccctttctccagcccctggtaacctctcatatgcttactgcctctatgaatttgcctattctagatatttctttctttttttttttttttgagttggggttttggtctgttgcttaggatggagtgcagtggcacaatcatagctcactgcagccttgaaccctgcgctcaagctatcctcccaccttgacctccttaagtgctgtgattacaggtgtgaaccaccatgcccaaccctagatatttcctttaagtgaatcatacaatatttgtctttttgtaactggcttatttcacttagcataatgtattcaagattcgtccatgtcatagcatgtgtcaaaattcccttccattttaaggctgaattctattccatcatatggtgtattagtccattttcatactgctgtaaagaactgcctgagactgggtaatttataaaggaaagaggtttaattgactcacagttcagcatggctggggaggccttaggaaacttagaatcatggcagaaggcgaaggggaagcaaggcaccttcttcacaaggtgatgggaaggagaagtgccgagtgaaggggaagagtcccttataaaaccatcagatctcatgagaactcactatcacgagaagggcaagagggaaattgcccttgtgattcaatcacctccacccaatctctcccttaatacatgggaattatggggattacaattcaagaagagatttgggtggagacacaaagcctaaccatatggttccaccccggaccctcccaaatctcatgtgcctttcacatttcaaaaccaatcatgccttcccaacagtcccccaaagtcttaattcattccagcattaactcataagtccatgttcaaagtctcatctgagacaaggcaagtcccttccacctgtaagcctataacagcaaaaccaagttagttacttcctagataaaatgggggtacagatattgggtaaatacacccattccaaatgggagaaattggccaaaacaaaggggctacaggccccaagcaaatctgaaatccagcagggcatcaaatcttaaagctccaaaatgatctcctttgactccatgtctcacatacaggtcatgctgatgcaagaggtgggttcccatcgtcttgggcagctctgcccctgtggctttgcagggtacagcctccctcttggttgctttcacgggctggcattgagtgtctgtggcttttctgggtgcacagtgcaagctgtcagtggatctaccattctggggtctggaggatggtggccctcttcttacagctccaccaggcagtgccccagtggggactctgtgtgggggctccaaccccacatttcccttcctcactaccctagcagaggttctccatgaggactccacccctgcagcaaacttctccacggacacccatttgtttccatacatcctctgaaatctaggtagaagttcccaaacctcaattcttgacttctgtgcacccacaggcacaacaccacatgaaagccaccaaggcttggggcttgcaccctttgaagcaatggcctgagctgtatgttggccccttttagccatggctaggatgtggctagaagtcacagttccaagagtacacaaagcagagaagccctgggcctggcccaggaaaccatttttccctcctaggcctccagacctgtgatgggaggagctgccttgaaggtctctgacgtgccctggagacattttccctattgtctttgtgattaacattgggctcctcattacttatgcaaatatctgcagccagcttgaatttctccccagaaaatgggtttctctcttcagttgcattgtcaggctgaaaattttccaaacttttatgctctgcttcccttttaaacataagttccaatttcagatcgtctctctcaagttcatagttccagaggtctctagggcagaggcaaaatgccaccagtctctttgctaaagcatagcaagagtgacctttgctccagttcccaagaagttcctcatctccatgtgagattatgtcagcctgggcttcactgttcatatcactataagcattttggccaaaaccattcaacaagtctctaggaagttccaaactttcccagatcttcctgtcttctaaaccctccaaagtgttccaacctcttacctgtcacccagttccaaagtcacttccacatttttgggtctctttatagcagtacctcactctactggcaccaatttactgtattagtccattctcgccattttacattcccaccaggaaatgtatcttaatttctccacctccttgccaacacttgttgttttccattttttattattatagctattctagtaggttaaatagtatctcatggttttgattagtatttctctgatgactaaagatgttgagcatcttttcatgtgcttattggttatttgtatttcatctttgagggagggaaaggacttgtctattcaagttctttgcccatatttaaaattgggttgttttttggtgttgcgttttaggatttctttatatattctgtatattaaacccttatcaggtatatgatttgcaaatattttctcctgcatgttttcttttcactttcttgataatgtcctttgatgtaaaaaagtttttaactttgatgaagtccaatttatctaccttttcttttgttgcttgtgctttcagtgtcatgtcaaagaatccattgccaaatccaaagtcatgaagatttattcctataaattcttctaagagttttatggttttagcttatatgtttgggtaattgatccattttgagttcatttttatattcaatggtgtagtaggcatccaacttcattcttttgcctgtggaaatccagttgccaccatgccatttgttgaagagactattattttttgtttgtttgtttgttttgagacggagttttgcttgttgcccaggctggagtgcaatggcacaaccttggctcactacaacctcctcctccctggttcaagtgattcttctgcctcagcctcccaagtagctgggattacaggcatgcaccaccatgcctggctaattttgtatttttagtagaggtagggtttcaccatgttggtcaggctggtctcgaactcctgacctcaggtgatccacccacctcggcctcccaaagtgctgggattacaggtgtaagccaccacacccggcctgaagagactattctttgtcccatataatggtcttgacacccttgttgaaaatcagtcagccatagatgtatgggtttatttcttaactctcagttctattctattggtctatatgtctatctgtatggtagtaccacactgttttattactgtagctttctaataagctttgaaacagagaagtgttggccctccaactttgttatttttcaagattcattttgaactattggggcaccttacaattccatataaatttgagaattgactttttcatttctgtaaaaagaggctggtggaattttgatagggatcgcttagcgtgatataagttttgaaatgttgacatcttaacaatattaagtcttccaatccataaatgtaggctgtcttttcatttatttaggtcttctttaatgtctttcatcagtgtgttatagtaatcattgtacagatcttccaccttcttggctaaattcattcttttgaatactattgtaaatgaattgttttcttaatttcctctttagattgttcattgctgatgtatagaaacacaattgatctttgcatgttcatcttgtacctgcaactttgccgaatttgtagctttcttgtggtttctttgggattttctatacgtagggtcatgtcatctgtgaacagtgagagttacacttctttctttttactttggatgccttttgtttctctttgttgcctaatttatctggctaaaacttcccgtacaatgttgaatagcaaacttcctgtacaatgttgaatagcggtagtgagagagggcatccttgtcttgttcctgatcttagggctaagcttccacctttgagtataatgttaactgtggaattttttttaatgccctttatcagattgaggctattcccttccattcctagtttatcttgaaaatattttggatttcatcacatgatttttctgcatcaatgaatatgaccttttttccttttttctattgatgtggtatattacattaattgatttacttatgttgaacttgcgttcttgggataaatcacacctaatcagattgtataatcctttaatatgctgtaagatttggtttgctagtattttcatggggtttttttaattgatatccataaagaatattggtttgtaattttcttttcttgtgatgtctacatttggctttagtatcagggtaatgctggcttcatagaagaagttaggaagtattccctcctcttccattatttggaagagtttgagagaactgctgtttattcttctttaaatgtttggaagaattcaccagtgaagccatctggtcctagacttctgtttattgggaggttttaaattacttatttaatctctttacttgttataggtctgttgagattttctatttcttctaaagtcaatttagtaatttgtgtgcttttagtaatttgtcatttttttttttttttttgagacggagtctcgctctgtcgcccaggccagactgcggactgcagtggcgtaatctcggctcactgcaagttccgcttcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaggaatttgtcattttatctaagttatctaattttttgatgtacagtagttcatagtaatctctatttgtgattcaatttttggaaggtaaaatcaagagttgttagaggcaaattgggccttgattaaaataggatctggtagttctgtttttagttctttgagaaatcttcacactgttgtccatggaagctctactgatttacattcccaccagcagtgtaaagcatttccttttctctgcatccttgccaacatcgttattttttgacattttaataatggacatcctgactggtgtaagatgatatgtcattgtggttttaatttgcatttttctgatgacttttcaatccagcaatgccattactaggtatctacccaaaggaaaagaaattatatattaaaaagataccagcacccatatatttattgcagcactattcacagttgcaatgatatggagtcaacctacgtatccatcaatggaagattggacaaagaaaatgtggaatgaagatacacacaattaaatagtactcagccataaaaatagaatgaaatcaggtcatttgcagtaacgtggatgaaactggaggccattatcttaagtgaaacaactcagaaccagaacgtcaaatactgcatgttctcactcataagtgggagctaaataaagtatgcacatggacatagagtgtggaataatggacactggagactaggaagggtgagatggtgggagggggttaaaggatgagaaattacttaataggtacaatgtacattatttgggtgatggttacagtaaatacccagacttcactactacttaatatatccatgtaacaaaactgaacttctgtcctttaaatttatataaattaaaaataaaaataaataaataggatcatgagtgcccaataaacaatacttggttacctatttaaacaaagtgacaatcaaacatttaaaaataaacatagggctttggaaggccgaggtgggtggatcacctgaagtcaggagttcaagaccagcctggccaacatggtgaaaccccgtatctactaaaaatacaaaaattagctcggtgtggtggtgcacgcctgtaatcccagctactcgggaggctgaggtaggagaattgcttgaacctgggaggtggagattgcagtgagccaagattgtgccactgcactccagcctgggagacagagtgagattccatcacataaataaataaataaataaataaataaataaataaataaatgtacataggaggtaacacaattctaacataggaggtaacacaattctaaagaactttagctctttgacaagtgaggaacctttgttctttgttagtttgccactaaataatcaaaaataaagaaaaagacaacataaagctcagagaattattcttgtaaaacacagagtctgctatctaggcagattacacagaagatgaagaataacttttgcattgtggtgaaggcattaatcaataaattaaggaagcaagcccatcaaaatttagataaggttgctacaattttaacacattgcatagctttatttcagacctaggtttaaaccagggcaaaaaaatttaactttcccagtttgtccttcattatgctctttgatgttctggaacaaactgaccatctttcagagcatctgctaggtcaaaactatttttattataatactaagatgtgtagtttttcaggggcagtatgatgtgtgatattgtaatagattgaatgcagaagcagatagtagagtctaattatttctattaagttgggcattagggaactttgcaaaaatgtgaagcaatcttcttatttttaaaataaaattatttttattaaaattgacatcaacatgcaacagattcatctcaaatcaattcaatcaataaatatatttaattttttctgttttaatttataatatggtaagtattgatagttacaacatacatgcggaaaacctctttggaagtccttagtaatatttcagagtacgaagaggtcctgagaacagaaagtttgagaactactgtcttagaaacaaactacttttccctttaaaacagaagcatatacccatttgtcactattgctcataatataatctcaaccacttgttttaattttaacttttaaccaaaataatatctatttcaaagagaaaatttgaggggtgcaattgagaactatctctcacaaacattatagcagattaacagagctcacgaacacatgtagcactttcaatgtacacacccatcccttttaaagaggaaaatgaacacaaccattaacatgacccaaagatattgcctctttatagcatataaaaataagaagcaacagtatataggaccaggcgcggtggcttatgcctgtaatcccaacactttgggaggccgaggtgggtggatcacgaggtcaggggatcaagactagcctgaccaacatggtgaaaccccatctctactaaaaatacaaaaaattagccgggtgtggtggtacatgcctatagtcccagctacttgggaggctgtgctaggagaattacttgaacccagcaggcggaggttgcagtgagccgagatcacgccactgcactccagcctgggtgacagagcgagactccatcttaaaaaaaaaaaaaaaaaaaaaagcaacagtatataaacttaaaactgcttagtgaggccaaggtagggagattgcttgagctcaggagttcaagaccagcctgggcaacataggaagaccctgtctctataaataattttttaaagaattaaccaggaatagtggcacatgcttatactcccagctactcgggaggctgtggcaggaggattgcctgagcctggaaggctgtggctgcagtgagccatgattgtgccaccgcactccagcctgggtgacagagtgagaccctgtctcaaaaaaacaaaacaaaacaaaaacaaaaacaaaaaactgtgcttagtaatcaataagcagtctatattaattaaaatttatgtaggtatccaatgattatccattaatgaactcaatttaatatcaaaccagtgtttaagttaattagattatcttaaatctaacataccacagaatgtaattactgctgaaataaaagtttgtcagaacagggattcaatttcagttgaacacaaatttacatctttcataatcttaaatattacatataagtaacattatcttatttgattagtaaatctgtatacatttaggaaaaacagaccgaagtaaaataaaatgtatgcttgttttatacattacataaataaatcaccaaaaatgacataactcttttaaataaaaattatttttaatgttttatttttaatttttgtaggtacattataagtgtatccatttattgttacatgagatattttgatacaggcatgccatgcgtgataatcacattagggtacatgaagtagccatcacatcaaacatttatcctttgtgttacaaacaatccaattatactcttttagttattttagaatgtacaattaatactgactgtggtcaccctgttaggctagcaaacactaggtctattcattctttctatattttttacccattacccatcctcacattctcccctactatctttcccagcttctggtaaccatcattctactctctatttgcatgagttcagttggcttaatttttagcttccacaaataagtgagaacatgcaaggtttgtctttctatgcctggcttatttcacttaacataatgacctccagtcccattcatattgttgcaaatgactagatctcattctttttaatggctgaatagtgctccattgtgtatatgtaccacattttctctatccattcatctgctgatgggcagttaggttgcttccaaatcttggctattgtgaatagtgctgcaatacatatgggagtgcagatatctcttcaatatgctgatttcctttcttttgagtgtatacctaggagtgggattggtgactcttctccacagtggttgtactaatttatgttcccaccagcagtgtacaagggttcccttttttccatgtcatcgccagcatttgtttttgcctatcttttggatataagccattttaactgggatgagataatatctcactgtagttttggtttgcatttctctgatgatcaatgatgcggagcaacttttcagttgcctgtttgccattcatgtgtcttcttttgagaaatgtctattcagatcctttgctcattttaaaaattagattactagattttttcctatagagttgtttgagctctgtatatatatctgcttattaatctcttgtcagaggggtagtttgcaaatactttttcccattctgtggattgtctcttcagtttcttttttgtttttttttttttttgttttttttgtttttttgtttttgagacggagtcttgctctgtcgcccaggctggagtgcagtggtgcgatctcggcttactgtaagctccgcctcctgggttcacccaccattctcctgcctcagcctcccgagtagctgggactacaggcgcccgccaccacacccagctaatttttttttttttgtatttttagtagagatggggtttcaccgtgttagccaggatggtctcgatctcctgacctcgtgatccacccacctccgcctcccaaagtgctgggattacaggtgtgagccaccgcgcccggcccagtttcttgatttaaacaagaattattaaacaaatctcatttgccaaagatataccttaattctggattctcaaaatgtttgagctagcagaattttttgtgaaaatatttttagtttagcacattttagtattaaaagttcaacttctggctgggcgcagtaaccagcactttgggaggccaaggcgggtggatcacctgaggtcaggagttcgagaccagtctggccaacatggcgaaaccctgtctctactaaaaatacgaaaaattagctgggtgtggtggtgggcgcctgtaatcccagctacttggaaggctgaggcaggagaattgctcgaacccgggaggcagaggttgcagtgagccaagatcgtgcaattgcactccagtctggacaacaagagcaaaactctgtctcaaaaaaaaaaaaaaaaaaaaaaagaagttcaacttctttttttcttggagttaaaaaaatatgtatgtaagttcttatttatgtctataaaccaattagaacagagctcctttaatttaggaaactttatgatataacttattaatactccccagagataggaaaatattttacactcacacaatgtgaggtcaaagcctttttcagttgtagacacatagacatagataaagcgatcttatgaattctgatctacaatttcagctataagttaagagtaaacacagaaatatgccagtccagatattacagtgttcaccttccctgcgggtgtgaaattactgattaatttaagttcaaaatgaacaaatagaacaacaaaaaagacaaattctctgttatttcccacccatcagtgactagataagtgactagataatccgttagtccaattacaaagaccaccaaatggtcaaaccatataatcacattcccagtcattgctgctaccaaggaagaatataacttactgactatacacaaaccagaaactaaaacaaaacataaactcaatagaaaagaaaaaagaaagaagcagagattcaacaaatttctgctgccactttggattcaacctggaagccaagaaaagattaatgtaaacaatctaggagttacatttctccagtaacacaatttacctggccctgtcaagtgtatccattgggcatctcagtcagtacttttaagatataaccttggctgggtgtggtggctcacacctgtaatcccagcactttgggaggccaaggcaggcagatcacctgaggtcaggagttcgagaccagcttggccaacttggtgaaaccccatctctactaaaaatacaaaaattagcttggcgtggtggtgggtacctgtaatcccagctacttggtaggctgaagcaggagaatcacttgaacccaggaggcggaggttgcggtgagcagagatcctgccactgcactccaacctggtgacagagtgagactgtctcaaaaaaaaaaaaagatataatcatgactctcttaggaatattaaatgaacacatcaaggattttatttaattcattaactgatgaggaaaccgagaagatgttacaaccaatttcaatttgcatttcattttggttgcttggtttttcctgttttctgtctcttactgtttattcagcggtatcttttttccctttgctgcttccacttccttttgctgcttccagttttacttttattcctgtggtggctttatttttttaccttctttgtctctgaaatagctcatattccatttccttttgttgtgtaccaactcttccctgagttctagcatttctgttttatattcttgttttatagagatgactacttaattaatattactgaatttatgctgatatgtttagtcacaattttaatctgcatatggcaacatttctctggtaagaattctccatctgccattttttttttctgtttcttccatcccattttcatgtagtatctttgtgtataaactgtgctggagttgtttgttttgttttgctttgcttgataacatctttaattgcaatgaggtctctttagaccttctacttgcagatgatacatgtggagaggagctcaggacctgatcaaggataatagaaatttttacttaagttctaaggttgttgtgtatgtgagttcttgtaggctctacatcttctcagccagtggatataggcagctatgggcttctcataacaaagactctttcctccccactgcttcactgacctgttgctcactctttattctctgcttctcaaaaccaaactaaggccagacgagttccctttaccagcctctaaactcttttcttgttattgtagataaaggatttgcacttcagggtgtgctcctccccttggagtgttgtacttttgctgactttttctgattctatttttatttttaaaacatatgtgtgtatgtgtacacaaataccctagactataagctccacaaggacagatactgtgtctgattttgcttacctttgtattgtgcgcctagcacataataggtcttcagaatatgcacacatatatatattcttataaaatgtgtgtatatgtatatatatttatgaatgcatatttcatctataaagccttggaaggatacacaccaaacttaacacttgatagctcttggaacaagtattagtgtgtttaagggactttcactttttattttgttttttgtttctgcatttgaatttttcaatgaatacatagtactttaataattaaaatgaaagatacatttagaaaaattattctgacttgttaaaggtttgtttcttgagattttgtatttccaatgaactaatgcttaaaataatgagcccagtatgtcagtaatgtaaataaatcattaagctaccaactgcaaatagataaattgagggaaagtacaaagccagtgaatcataaattcttgagggaaaattggaaaacgccatccttttaaaaatctactccaaatcagagttaattaagagctgtataaacagtgattaaaattttagtgctatgggaattggcttttacaaaaggattaaccctgacatgccattatattagtgacctaaggaaagcagctcaccacatttattctgcaaagtatttattaaattcctaaggactactatgtattgtggaaataaggaaatgtattactgtctctgtccctaacaaatttacagcaaagaaaggtcagaaacataatcaattatacatatataaggcaaaatgaaataactatactaatagggatacagaatatatgggaccacagaggaagaaatgatctattccaaaaggtgatatttgaacttactcttcaagaataaatagaattttaatggtaggaatcaagtgaacagaagccaggagtaatacaggagaacattgttagtttggggattatctcttattcaggggttatatagtgggagatgagtccatgtcttagtctgtttctgctgctgtaacaaaacacctcatgcagaccgggtaacttacaaaagagaaaaatttttttttctcacatttctggaggctgggaagtctacggtcaaggatccagaaggttcagttttctggtgagggctgctttctgattgcaagatgataccttgttgctgcatcctccagaggggagaaacactgtgtcttcacagggaggaaagtggaagggcaagaaaagttagtgctgtgtggaagcctcttttttaagggccataagggctatctgtaaccctgttcatgagggaggagccctctgggtctaataagctattaaaggttccacctcttatcctatcacattggccattaagtttcaacatctgaattttggaggggacacattcaaaccacagtaggctgaaagtagtgtgatttgtgatgtgcccattctcaataacaaattaggccactagtatcacctagttccaagctatctcatgtctcacttggaccactgcaatagcttcccaagtgtcctctctgctgcacttcttgccctcctaataaattcaatagccacacagcagccagagtattttaacataagtcagttcatgtcagtctccttgcacttcccatttaaatggatttaaaataaaatcccaagtccttaccataatctacaaggccatagataatccggtccttagataccttcctcgccacctctcctgccactctgcctcatagctccatgtactctagccctactatgtctcgataacaccttgtacttccctgcttctgggcctttgtatttgccctttcctttgcattggacactcttgtcctagatattcatatgccttgctccccaacttgctcaagttttaccccctcagagaccacaccctttcaaaaatagcaactttcaatactatttaaccccttaacctgtgtgttgactacttgacatattctatgttgcttattgtttgtctccctaaatagaatccaagttccatgcaggcagaaaagttgtctgtcttgttcattctttatccatacctcctaaagttttgcctggcatataatagggctcaataaatatttattaaatgaaattctgctataacaccagaaattatatcattagagagtcatttattttagtcttagagtgttttgatcttagagaaccctctgcaaagatccttgggagagctcacaatttagtcattatcagcgtatactctgggagaggaacatttagaaaaaagtacttaatggagattgaacttgggatttagagcagagaagggcaggtttccaggggtgaaaaaggaaatttaaggggaagttgggtttgtaccaaagatgactttgcttatagtgagaagatactcaaacctttcttacttgaggaagctcacagcttctgaatctctctttctggctgtgaaaagaaatttcctcttttgggtctcccttgaagattatcatttttggatgttgctaagagcatccttggagtcagagtctctatatatagcaaatcatcaaatgttagggctagaagtaatcttggtgatttggtttcttaaaactatttattttataacatgagttaaacatttatcacaaaaacaggaagatagagaaaaggctttagtttttgtaggtcattgcaaggaagaatttcgcttatctccagtgctataattttgactttggtataaagtattcatcaagtgtcatcatcgaaagtattagtggttatgacaaacaaggcaaacctcctgagaactttagaacaaagcccagcatggatgttctgccagcataaatgcagttcagctggcagagcagaggattatctatgtttttatgtattatatattacatatttatatattagggtctcctcaacccataactggaaaggtcattctaatttatccaaatacagtagataaaagctgccatttaacaaggtgtatgctagaaatagaaatattttttgtcttttccattgtacacaccaaaactaggattgaatgcttattcctttgcaggcagtctttgcttggttccttcattggcttaatacagcaatcagtcatgcattacttttgtctcagagattagttctcatgggtaagaaattctcagagatgaaagttttgagatcagccaaaagaaaaggcaattggagctgatcctcaggcacattaaacagaatggcaaaacttgagtagattttctagtgtacattttgagccagaacttaggccacagaaataggagaacctgagtttaggatttttcctggaaggaaattagacaattagctggagatacccaagtatctctgataaaaatggatcctaaaagtcttcacttttggcagcattccatttaaatcatgcctcatagtcagcataagcttaccctaatgatgcaatccaaagccttaatggcagtgagtagagactttgatacagggctatggagtcactgaagaaatatagtaggggttccaggttgaggagacaggtttgttatggttcccagatacttatggtgatatatactattccttctcccaagtgcctgatctaattaggaatgtcagtccaatctccctgttcccaatatatatcttattatggtttgcttttagaaaggacaaatgtgaatctggaaattttatttatttatttatttattatactttaagttttagggtacagatgcacaacgtgcaggttagttacatatgtatacatgtgccatgttggtgtgctgcacccatcaactcatcatttaacattaggtatatctcctaatgtcatccctcccccctccccccaccccacagcaggccctggtgtgtgatgttccccttcctgtgtccatgtgttctcattgttcaattcccatctatgagtgagaacatgcggtgcttggttttttgtccttgcgatagtttgctgagaatgatggtctccagcttcatccatgtccctacaaaggacatgaactcatcattttttatggctgcatagtattccatggtgtacatgtgccacatttacttaatccagtctatcattgttggacatttggcttggttccaagtctttgctattgtgaatagtgccgcaataaacatacgtgtgcatgtgtctttatagcagcatgatttaaaatcttttgggtatatactcagtaatgggatggctgggtcaaatggtatttctagttctagatccctgaggaatcgccacactgacttccacaatagttgaactagtttacagtcccaccaacagtgtaaaagtgttcctatttctccacgtcctctccagcacctgttgtttcctgacattttaataatcgccattctaactggtgtgagatggtatctcattgtggttttgatttgcatttctctgatggccagtgatggtgagcattttttcatgtgttttttggctgcataaatgtcttcttttgagaagtgtctgttcatatcctttgcccactttttgatggggttgtttttttttttcttgtaaatttgtttgagttctttgtagattctggatattagccctttgtcagatgagtagattgcaaaaattatctcccattctgtaggttgcctgttagatggtagtttcttttgctgtgcagaagatctttagtttaattagatcccatttgtcaattttggcttttgttttcattgcttttgctgttttagacattttcttgtacagttatcttagcacaatgtctcctgatcagaataagttgtgtactatacctcacctacacattcattacttattttcacaagacttcccaagctttaaacttcagtccaccactaactgattatatatatatatcacaatacatattcttttcaagtgtacttgtaacatataccaaaatagatcatatgctgggccaaaaagcaagtctcaacaagtttcaaaggattgaaatcatacaaggtatgttatccaaacaaagtacaattaaatgagaaagcaacaacagaaagatgattaggaaacccccactgttggaaatctaaaagaaacatttctaaataacccatcagtcaaagaaaaaatcaaaatgaaaacgatggaatagattgaacttaacaaaaatgaaatatgacatcaaaacttgttggatacaactaaaataaaggaaaagacatagctttaaatgcatatattagaaaagattaagggttgaaaattgatgatctaagcttccaacttgagtctagggaaagaacagcaaattaaagatagtagaaggaagaatgtaacaaagataagagcagaaaacaaagaaatgaaaaataacatataacacagaaaatcaggctgggcacagtggctcatgcctgtaatcccagcactttgggaggccaaggcgggcagatcacctgaggtcaggagtttgagaccagcctggccaacatggtgaagccccgtctctactaaaaatacaaaaattagccaggcatggtggcacatgcctgtaatcacagctactggggaggctgaggcatgagaatcgcctgagcttggaaggtagaggttgcagtgagccaagatcacgccactacaatccagcctgggcgacagagaaagactctgtctcaaaacaacaacaacaacaacaacaacacagaaaatcaacaaagctataggttgcttgtttggaaagattaatacaattgctaaaagtcttgcaagatggatcaagaaagaacacaaattaccaatatcagtaattcaaaagtgggcatcactacaaatccctcagacattaaaatcacaataaaaaggatattgtgaacaactttatgccaataaatttgacagtttggacaaaatggacaaattccttgaaaagtacagctaccaaaattactttcccgccccccattacttctcagctttttggctaagatcaagtacaaaattgtgcccccaaaaataatctgagtagtcctatttagactattttaaatagtcctaaacctactaaagaaatgcaaccttaaataccttctcacaaaggaaatggctttaccagtacattattccaaatatataagaaagaaataatagattttgggttggagccaagatggccaaataggaacagctctggtctacagctcccagcgtgagcgacgcagaagacgggtgatttctgcatttccatctgaggtaccgggttcatctcattagggagtgccagacagtgggcgcaggacagtgggtgcagcgcaccgtgagtgagctgaagcagggcgaggcattgcgtcacttgggaagtgcaaggtttcagggagttccctttcctagtcaaagaaaggggtgacagacggcacctggaaaatcgggtcactcccaccccaatactgcgcttttctgacgggcttaaaaaatggcgcaccaggagattatatcccgcacctggctcgtagggtcctatgcccacagagtctcactgattgatagcacagcagtctgagatcaaactgcaaggcggcagcgaggccgggggaggggtgcctgccattgcccaggcttgcttaggtaaacaaagcagcctggaagcttgaactgggtggagcccaccacagctcgaggaagcctgcctgcctctgtaggctccacctctgggggcagggcacagacaaacaaagacagcaataacctctgcagacttaaatgtccctgtctgacagctttgaagagagcagtggttctcccagcacacagctggagatctgagaatcagcagactgcctcctcaagtgggtccctgacaccgacccccgagcagcctaactgggaggcaccccccagtaggggcagactgacacctcacacagctgggtactcctctgagacaaaacttccagcggaacgatcagacagcagcatttgcggttcacgaaaatccgctgttctgcagccaccgctgctggtacccaggcaaacagggtctggagtggacctctagcaaactccaacagacctgcagctgagggtcctgtctgttagaaggaaagctaacaaacagaaaggacatccacactaaaaacccatctgtacatcaccatcatcaaagaccaaaagtagataaaaccacaaagatggggaaaaaacagagcagaaaaactggaaactctaaaaatcagagcgtctctcctcctccaaaggaacgcagctccttaccagcaacggaacaaagctggacggagaaggactttgacgaggtgagagaagaaggcttcagacaatcaaactactctgagctacaggaggaaattcaaaccaaaggcaaagaagttgaaaactttgaaaaaaatttagacgaatatataactagaataaccaatacagagaagtgcttaaaggagctgatggagctgaaagccaaggctcaagaactacgtgaagaatgcagaagcctcaggagccgatgcgatcaactggaagaaagggtgtcagtgatggaagatgaaatgaatgaaatgaagcaagaagggaagtttagagaagaaagaataaaaagaaatgaacaaagcctccaagaaatatgggactatgtgaaaagaccaaatctgcatctgattggtgtacctgaaggtgacggggagaatggaaccaagttggaaaacactctgtaggatattatccaggagaacttccccaatctaacaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcggcagaaactctaaaagccagaagagagtgggggccaatattcaacattcttaaagaaaagaattttcaatgcagaatttcatgtccagccaaactaagcttcataagtgaaggagaaataaaatactttacagacaagcaaatgctgagagattttgtcaccaccaggcctgccctaaaagagctcccgaaggaagcactaaacatggaaaggaacaactgggaccagccacggcaaaatcatgccaaaatgtaaagaccatcgagactaggaagaaactgcatcaactaacgagcaaaataaccagctaacatcataatgacaggatcaaattcacacataacaatattaactttaattgtaaatggactaaatgctccaattaaaagacacagactggcaaattggataaagagtcaagacccatcaatgtgctgtattcaggaaacccatctcacatgcagagacacacataggctcaaaataaaaggatggaggaagatctaccaagcaaatggaaaacaaacaaaggcaggggttgcgatcctattctctgatcaaacagactttaaaccaacaaagatcaaaagagacaaagaaggccattacataatggtaaagggatcaattcaacaagaagagctaactatcctaaatatatatgcacccaatacaggagcactctgattcataaagcaactcctgagtgacctacaaagagacttagactcccacacaataataatgggagactttaacacccctctgtaaatattagacagttcaacgagacagaaagttaacaaggatacccaggaattgaactcagctctgcaccaagtggacctaatagacatctacagaactcttcaccccaaatcaacagaatatacatttttttctgcaccacaccacacctattccaaaattgaccacatacttggaagtaaagctctcctcagcaaatgtaaaagaacaaacattataacaaactgtctctcagatcacagtgcaatcaaactagaactcaggattaagaaactcactcaaaactgctcaactacacggaaactgaacaacctgctcctgaatgactactgggtacataacaaaacgaaggcagaaataaagatgttctttgaaaccaacgagaacaaagacacaacataccagaatctctgggatgcattcaaaacagtatgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacgcaaaaaccccttcaaaaaattcatgaatccaggagctggttttctgaaagcatcaacaaaattgatagacctctagcaagactaataaggaagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatcactgaatagaccaataacaggctctgaaattgtggcaataatcaatagcttaccaaccaaaaagagcccaggaccagatggattcacagccgaattctaccagaggtacaaggaggaaccggtaccattccttctgaaactattccaatcagtagaaaaagagggaatcctccctaactcactttatgaggccagcatcattctgataccaaagccgggcagagacacaaccaaaaaagagaattttagaccaatatccttgaagaacattgatgcaaaaatcctcaataaaatactggcaatccgaatccagtagcacatcaaaaagcttatccaccatgatcaagtgggcttcatccctaggatgcaaggctggttcaatatatgcaaatcaataaatgtaatccagcatataaacagaaccaaagacaaaaaccacatgattatctcaatagatgcagaaaaggccattgacaaaattcaacaacccttcatgctaaaaattctcaataaattaggtattgatgggatgtatttcaaaataataagagctatctatgacaaacccacagccaatatcatactgaatgggcaaaaacggaagcattccctttgaaaactggcacaagagagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaagaatccaacttacaagggatgtgaaggacctcttcaaggagaactacaaaccactgctcaaggaaataaaagaggatacaaacaaatggaagaacattccatgctcatgggtaggaggaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatctccaagtcaatcctaagccaaaagaacaaagttggaggcatcaagctacctgacttcaaactatactacaaggctacagtaaccaaaacagcatggtactggtaccaaaacagagatatagatcaatggaacagaacagagccctcagaaataaagccgcatatctacaactatctgatctttgacaaacctgagaaaaacaagcaatggggaaaggattccctatttaataaatggtgctgggaaaactggctagccatatgtagaaagctgaaactggatcccttccttaccccttatacaaaaatcaattcacgatggattaaagacttaaacgttagacctaaaaccgtaaaaactctagaggaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaaaaaaccccatcaaaaagtgggtgaaggacatgaacagacacttctcaaaagaagacatttatgcagccaataaacacattgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagcaatcccattactgggtatatacccaaaggactataaatcatgctgctataaagacacatgcacacgtatgtttattgtggcactattcacaataggaaagacctggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacactgtatgttctccctaataggtgggaattgaacgatgagaatacatggacacaggaaggggaacatcacactctggggactgttgtggggtggggggaggggcgagggatagctttaggagatatacctaatgctaaatgacgagttaatgggtgcagcacaccatcatggcacatgtatacatatgtaactaacctgcacattgtgcacatgtaccctaaaacttaaagtattataataataaaataaaataaaaagaaagaaataatatcaatctcatacaaatatctcttatggaaaatagagaaaaaagtaatacatggattttatgaggccagcatactctgattccaaaaactaaaaagaaaaatacaagtcagtgtcagtgtcttttttgtttgtttgtttttgtttttgtttttttgagatgaagtctcactctgtcgcccaggctggagcgcagtggcacgatctcagcttactgcaatatttgcctcccaggttccagcgattctccagcctcagcctcccaagtagctgggactacaggcatgcaccaccacgcccagctaatttttgtatttttagtagagatggggtttcaccatgttggcaaggctggtcttgaactcctgacctcaggtgatccgcccgcctcggcctcccaaagtgctgggattacaggcgtggaccaccacacccggcatcaggccagtatcttaaatgatagatgcaaagatcctaaatacattttagaaaattgaatccagcaatatataaaaaggatactgcatcatgaccaatattgcttatcccaggaattcaacattcaaaaatgagtgcacattaacaaaataaaagaggaaaatataataatctcaatagatgcagaaaaagcatttgaaaaaaattccatacccattcatgacgagaacactcaacgaactaggaatagaaagtcacttcctcaatctgataaacattacttgaaaacaaactactccttattttgtatttaatggtaaaatatgaacactttctcactgatgtcagggaatgaaacatggatatacactatcaccacttccattcaatattatactggaataattccaggcctcctagtaacccatttcacatcttaggtctaattgatcactctctccatgctgcctcttaaagacaatatgttcttttttaacttcagttgtaaaccctttatatgctttaagacggtttccaaagcatttgttaagctctgtcttcttcagatcaactatttcagaaataggttctattttccaaccttctagtcatagccattcttctcctttacatgttttccagtagtggattgtgaatcagaacatgtgggattagggtcctggctctccattaatttgctgtttctatgggtaggaacagcatttagtttctcagccataatcttctcatctggaaagtggggttaataacccctgccctgtgtatgcattagaagggcatttcgcctatccgaagaactcagaataatggagcaatttctaaaccatgactttgaaaacactgcagagacccagccaatctaccatttccaggagcttacaacataattccaacaacaaatgtaacctgaaatagataaacaaactgtacatctctataatggaatactactcagaagtaaatgaatgttaaatgcatttgccaagtgaaaaaagacagatccaaaaggctatgattccatttatatgatatcctggaaaaggtaaaaccataggaaaagaaaacacatcagtgattgccagaggttggacattggagtaggagttccctataaaggggtaacatgagagaatctttagggtaatgaatgttctataaggagcagtgatagtggacacacaattctatgcatttttcacaaccaatagaactatatgccacaaagagtagattttaccggatacaattttaaaataaatcaatcaggatgtggagggaatcccagatggaattcagactgtgacaaatgaatctgactctattacgaatgaactacatagccacatggaagggggtgaggaagaaagaagccgatttaagtaactttgaaaaactctgttttgattagatgcaaggctaaagacaaaaagaactatgcacaatactgtattctagttggtaacttttttcacgtggatatggattagcaataatgaaaatactttacatatttagtcagttttgctgttacatggcatatgcatgcctaaaaattattacagtatccaaaattgtgtaataaagaccacagggcttacgggaaaaaatggggttggggtataacactaaaaaatttggtctgtgacatattaaaaaaaagataagagcctaataaaatgacagcatggttttatatatgttaaatgactaaaaatacatgaatactacaataaatatggctatttaccttaaaaaagacctggcatttgcttatggaagtgaatatcagaaggactgcagcttgtgagatactgtgaagtggtgggaggaggttgtctgaaatctgatggaaagttgtagcaacagatgtggatgagtgtggcccataacacattcagtgaactgaggtagtggatagaagtttgagttgtgcacatgtgtgtgttatgcatattcctatacagcttggttcagccagatgctgctttctgcattcacttactatttcacatagactaaattgcacataagcaagtacttaatttacataatttacattaattgttacctaatatatcaatcatgttggaacaaattcacattttcaaaacaaacattataacaactgtatgtatgtgtgtgtatatatagtatgtattatgtatatgcaaatagacatgcatataatatggttttctttatctgtgatttggaataaagttttaaaaataagtaaatttgggctgggcacggtggctcacacctgtaatctcagcactttgggaggccaaggcaggtggatcatgaagtcaggagttcgagaccagcctggccaatatggtgaaaccccgtctctactaaaaatacaaaaatcagctgggcatggtggcacgtgcctgtagtcccagctactcgggaggctgaggtagaagaattgcttgaacccaggaagtgagggttgcagtgagctgagatcacgccaccacactccagcctgggcgacagaacgagactctgtcaaaaaaaaaaaaaaaaaaagtaaattgatatggttgttggatacaggtttatatataaataattaattatatttctgtatactagcaagaaattattggaaagtgacctttaaaatacaatttttgatagcatcaaaatccatcaaatgcctagtaatctataatgaaagatgtataagacctctgcactgaaagccacaaaaccttgaaacatggctgaaagaaatttttaaaggtctaaataaatgcagatatatgccatgttcatgtgttagaaaactcaatattgttaggatatatcagttttcccaaattgatctatagattcaaagcaatcccaatcaaaatcccagctggggctgtgtgtggtggcttacagtactataatcctagcactttgaaaggccaaggtgggaggattggttgagcccaggagttcaagtatggcctaggcaacatggcgagaccctatgtttaccaaaaaaaaaaaaaaaaaaaaaaaaaaaaaaaaaaaccggtgtggtggcatgcacctgtggtcacagtggtcacagctacttgggaggctgaggcaagaagatcacttgagcccaggaatttgaggttacagtgagctatgattgcaccactacactctagcctgggtgacaaagtgagaccttgtctcaaaagataatgaaataaaataaatgaaaaatcataggagaatatcttcatgactttgtggagacaaaagtttaccaactataaaagaaaatattgataaagtggacttcattacaagtgagaactttggtctgtcaaaagataccgttgagaaaagaaaaagacaagccacagataggaagaagatatgccaatacataagcttgacaacttccagaatatataaagaattcttacaattcaacaagaaaagataaataacccaataaaaaaatggacaaaagaattgaatggctgggcacagtggctcgttcctgtaatcccagcactttgggaggctgaggtgggtggatcacctgaggttgggagttcgagaccagcctgaccaacatggagaaaccccatctctactaaaaatacaaaattaagcgggcgtggtggcacatacctgtaatcccagctactcagtaggctgaggcaggagaatcgcttgaacccgggaagcggaggtcacggtcagctgaaatcacgcctttgcactccagcctgggcaacaagagtgaaaatccatctcaaaaaaaaaaaagaattgaatggaaatttcacccaaaaaaaatgtataaatggtcaacaagcaaaggaaaagatgctcagcatcattactcatcaagaaaatgcacattgagaagccgctgcaccctcactgaaatgactaaaaaaaaaatcaagtgttaatgagggtgggaagcaactggagttctggcacacaactagtggaaatgtaattggtacaaccactttggaaaactgtttggcagtatctgctaaaaccaaacatgtttctatcccagcagtgaccgtcaaatctcacttttagatatatactcaggtgaaatgagtacatctcttcaccacagtatgtacaagaatgttcaagacagctctattcatagaactaaaaatttgaaacaacattactgttcatcagcagaatgatagattaaataaattgtggtatgttcatacaatggaatactacaaagcaataaaaagaatgaacgtctgatagcatacaaaaatatttatgaatatgacagacattatgagtaaaagaagttggtcccaaaagaatacacaatataaattcaatttttcaaacaattgtattgagatataactcacatgccatgcagttcacccatcaaagtgtacaattcaatacactttagtatattcacagatatgtgcaaccaccactgacaatcaattttggaacattttattacctcaaaaggaaagcaacgtaccctttagtttcccttgcatttctcccacaagccctgaacaaccactaatctactttctgtttctatagctttgcatattctgaacacttcatttaaataaaattatataatacatggacttttgtgactgccttatttcacttagcatatttttgaagttcattcatgttgtggcatgtcagtacttcattactttttatggtcaaataatattccattgcctgggcataccatgttttattcatccattcatcagttgatggacatttggatcatttctatcttttagctattatgaataatgctgctgtaaactcttgtgcacaagtttttgtgtggacctattttcacttttttgtgtgtgtatacctaggagtggaattgctgggtcatatggtaaccctatgtttaatcatttgaggaactgccagagtgtttttcaaagcagctgcatcattttacatttccaccagcaatgtatgaggcttccagtttctccacctccttctcaacacttgtattacctgccttttttattctagccatcctagtgaatgtatagtgatatcttattatggttttgatttcctgatgactaattttcctgatgaccaatggtgttgagcatcttttcagatggttattggccattgtatatcttctttggagagtatctattcacaccctttcccaatttttcattaggctgccttttattattgaatagcaagagttatttatgtattctagatacatgtctttgatcagatatatgccttgattttgccccactctgtcaattgtcttttctctttcttgatcatgtcctttgaaatacaaaattcgttaactttgaggaggtccagtttatctatttttctttcattgcttatgcttttgatatcatatctaagaatccattgccaaatcaaaagttatgaaggtttacccctctgttttcttccatgagttttatagtttagctcttatctttaaatatttgatctatttcgagttaattcttgtatatgctatgaggtgagggtctaacttcattctttatcatgtggctatccagttgtcccagaactatttgattaaaagactatcctttccctcattggatggtctttgccccttttggaaaatcagttgaccacagacacattgttttatttctgggttgtcaattctgttccatatatatatatatatccttatgtcagtaccatgctgtcttgattaccattgctttctattttctttttcttttcctttcttttttgttgagactgagtcttgctctgttgcccaggctggagtgcaatggtgccatctcggcttactgcaacctctgcctccttggttcaagcaattctcctctcagcctcccaagtagctgggactacaggtggccaccaccacatctggctaatttttgtatttttagtagagacagggtttcaccgagttagccaggctggtctcgaactcctgacctcaagtgatctgcccacctcagcctcccaaagtgctgggactataggcatgagccactgcgcccagcctccattgctttctagtaagctttgaaatcaggaagtgttagtcctacaactttattcttggttttcaagattgttttggttattctgggtcccttgaatttccatacgagtttcaagatcaactgtcagtttctgaaaaaaataactgagctgggatgctgatagggattgtgttgaatctatagataattttggggagtgttatcatcttaatgataaatcatcaaatccatgaacatgggatatgtttccattttgttacatcttgtttatttcaatgatgttttatagtttttgtttataagttacataacaaaatggaaactaagttacataacttatacactaaaaactataaacgtacacactaattctttctttttctttttttttttttgagacagagtctcactctgttactcagactggagtgcagtggtgcgatgtcagctcactacaacctctgcctcccgggttcaagtgattctcatgcctcagcctcctgagtagctggaattacacacatgcgcccccacacccggctaatttttttttttttttatagagatgggattctgccatgttggccagactggtctcaaactcctggcctcaagtgatccacctgccttggcctcccaaagtgctggaattacagttgtgagccactgtgcctggtccttgttctttatttctaagtattttcttctttttgatgctgttataaagggaattgtttcaattttattttcagcttactcattgctgctatataaaaatagaattggccaggtatggtggctcactttgggaggccaagactggagtatcacttgagctcaggagtttgagaccagcctgggcaacatagtgagaccttgtctctaataaataaataaataaatacttgattgttgtatattgatcttgatgaacttgctgattagttataatggcattttactggattccctaggaattttattcacaagattatatcatcttgtgaataagattgatgtttttattccttttgatgctattgtaaatggatttattttgcagagcttcaaaacacttgaagcaaaaactgctagaactaaaatgaggaatagacaaatccataactacttggaaacttgaatattcctttcttagtaatcaatagaataggtcaacaaatactcaataaagatgtagaagacatgagcaacactatcagccaacttgacctaattgacatttagaacactctacccaacaacagcagaatacagttttttcaaattcacaaggaacattcatcattgtaagccatattctgaaccacgaaacaaacttcaaaaaatttaaaagtattgaaatcataaaattattgaaatatccaagtattttctctgaccacaagagaattatatatctataatacaaagttatctgtaaaaccttccaatatttggaaattaaacaacatactttaaaataatccagtaggctaaagaggaagtgacaggggaaattaggaattttttttaattgaatgaagatgaagacacaacatataaaaatgtgtaggctacaactagagcagtatctagacaaaagtgtatagcattaaatgctcctattagaaaaaaaaagaaaggtctcaagtaatctaagtctccaccttaagaaactagaaaaaatgagcaaattaaacccaatcaagcaaaagaaaagtaataaaaataagagcacagatcaataaaatttaagacagaaaacagtagataaagtcaatgaaaccaaaagtttttttttcttttgaaaagaccaatacaaatgataaacctctagccaggcagatcaagcacaaattaacaatatcaggcataaatgtggagacctcactagagatcctacagacattttaaaaggtaataagggaatattatgaacacttttatgtccatgaatttagaattttaggtgaaatgtacaaatttcttgaaagtcacaaactaccaaagctccctcaagaagaaatatatactcctatgcctattaattaaattcatagtttaaaatcttccaacaaagaaaactgcattgaagaattctacctaacatttaaagaagatgtaataccaactctatacaaactcatcctgaaaggagggcccaattcccagttcatcttatgagactattatcctgataccagtagtagacaaagacaatataagaaactgcagaccaagattcctcatgaaaatagatgcaaaacataaacgcagaaaagcaaagatagttgctaccttggttggatggtattgactggaaaggagcacaaaggaaccttctgtattgttggaagtgtttgttatcacaatctaggtagttattacacgggtttaaacacatgtaaaaactcatcaagctgtttaaggttagagcacttctttcagtttgttgtatatatgtcatacctcaaaacatttttcaatgttcaatctaccaagaaggatgaatgaaaagtgtctcacatagtttagtgtatgacacctgacatgaaattctttctatgctgatgcccaagaaattctgtcgactaatgaaacagtttggaaactctcctctattctgcttaaaataaagtcactgttggtttatacagcactgtatcttctggttaactcggccattagagtgagcaccagcccagttgaaagttcacaagaagcaagtaaacactggatttgatttagaatcaataatagcagcagggttttctcaggctgtttagaagcatcgtggcaattgtttgagaaaatataggtagttctagtgaatgcgctacagaatgttggaagtagcggttagcttagagattttaaaatgttagaatcaaataaaaaacaaaaataaaatttagaatctgtctacagcagtgaagatgaccttcaaattgtaagtaaaattaatatttcttagaaggaaaacctctccagttagtgaaattacaaccaaagagaataatataatataatcacaaagaatgttgcatttttgcctctttcttagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaagtaagagctatatttatgcttttgtaaggctggtgcccatttagatcgtatgactttttttcttctctttactcttctttcttacctccaggtaggaaataattttttctcatagcactttgtttctccttctctaatgccattcttagactattttgtattatgatcatttgtgcatttatcttcttcactctatgagattataatctctttagggtcataaacaataattacttaatttgtacttacaaaccctagcgaagttcattgctcctaataggtgctcaaattttttctgtgtggaatttaattatgtaactacacaacagggggagctcaaactttagaaagtttttctgggctagctagaaataactgagtgcttcaacaatcaaaagtgatgcaatcttagctgtttgttgaaatgtacagagaaatactggtaatattttttaacacaattgccactctcaaatttcaggccaaactttacgtgggtttgggggcatagagcctttttgggagtacactgcaggaaacagcctaattatcttccctttttatctctcaccctcttcaggagcatgtgtgtggttaataaaaatattaggtagctccaagtgcacaagagtcacatttgcctttccttggtcttgccaagacagaattcctagagccatggagcagatgatatatactttatggacatgtgacagcaaccactgctccttgtataatggaactccaattctaaaaatctgttaaatgcatctggaagtcttagggttagttacctctgatactcccttgtcaagtgtttcctatttttagtatcagataaaaataggacattttagtacaaacctgtttcaattagtgcccttttactgatctgctttctgtttccttcttagtgtgcccttccttgactgtcattcataagattattgcttcacctgtatgactgtgtgcaaggtcatacaaacagtaggttttctgttgatgtttgctgaaaaaaggatgttacctggtaatcccaccatgctactctgcccagaaagtagaagctatttccaaaagcgactgtagatttatcatttataaaattcattgttgtttatttttgttcatctgtttcagcccagtttcattagagaaagcaagtggtagcctgggatgaaaactgtgatgggtgacattatcatgttcacaacctttttccttttcttactctagtaatagcaatggaaaagcctgcacactatcctttgattgctctcaaggccttgaaaaaggctttattgctctacaaaaaggaagaaccaattgatatatcacaatacaggttagtaaatacaatccagcctttttgctagccaaaagaactatagtcaatgcctcaaaagtaaccaatcgttcttaattgactcaactttaaagatgatatggggatgatctgggggcattcttgtgaacagctccatactgagagttgtattacagaccaataattatttagcaaagtcaaggagcttggttttcccaaaggagaaaaaaaaggggaaaagttgcttctttgtgtgaatctgtgtatataataaaactgctaagtacctttctttctttgtttcatcactaaataatattccaaatgtacagaaaagcacaggggttaatataacaaacaccaacgtatccaccacccagatttatttgttttatttttagagatggggtctcgtgatgttgcccaggctggattcaaactcctgggctcaaatgattctccacctcagcttcatgagtagctgggattacaggcacgcagcacccagatttaacaaatgttaacatcttgctatgtttgcctcattatttttctaagcactttaagcaccgataagtgctgtataaaatattatctattggagacttttttgttttctgtgtccagacatggggaaaaatagatgttgtgtgactttttttgtctggaaaacatcattacagtcttcctgtgttaaggcacgaaagacagttcttgtggaatcattccactttaaaccccagttcccttgcccatttgaggaagtaccgagatgctttaaaatgcctgtaaattgaaccagctcataaaatataatagacagccacaactccttcgtgcaggaaactaaaaaaagaatgaaagacaaccataggcatgaaaaaagaaaggattggtcaacctgttttacagcttcaaaaatctgtcttctgaggttggaggccagataaaaccgagggaagaacagaagtgttttgaagctgttagtctgggatgagatccaggttttacttatcttagccatgaagccaatgatttctttccttatgggatgagttttctctttttgattttcagcaaatgtatgcacaacttggttaacctctcagtgccagatggggcgtcgaatgtagagctctgtcccctggaagaagtttggggctattttgaagatgctctgagccacattagccgcactgtaagtcaaatagtgatattaaactttcagttaattttaaagaactgaactgtcttgtgtactataaattatatacaataatgctttctgatatgagttttaggataaattcatattacaattttgtagttacacactacagaattttcctgggtttctgaaatataaatagttgaaagtagacattttctaacacaagtgtattatggattaggtccaagtagcagtaccaccaggcattttgaattattttatattttcaaatcatggtgggatgattactttctctgtgatgatatgaaccttttgaaaaaagttattgctattcccatcctttctcagaagcatcctttctcagaagagtagaaggaacattgaagacctgtattctagtccctcctctgctgatttctttttcttttctgtgcaggtttattcagttgttttaaaattaggtttcttgaggtataattcacatatcataaaattcacccatggcttgtgcacaattcagtaaatttatagagttgtgcaactatcactacaatccagtgttttttagttttaaaaatgttttatttttaatttttgtgggtacatagcggtgtacatgtacccatacttatggggtacatgagattttttggtacaggcatataatgcataataatcatatcaggataaatggggtatccatcacctcaagcatttatcctttgtgttacaagcaattcaattatacttttagttttttaaaatgtacaattaaattattgttgattataatcaccctgttgtgctattaagtacagatcttattcattctattttttgtacctattaaccatttccacatttcccccacccctcctctggtaaccatcactctactctttctctccccagcagttcaattattttaatttttagctttcacaaataagtgagaacatgtgaagtttgttttttgtgtgtgtgctgggcttatttcactcaacatactgacctccagttccatccatgttgttgcaagtgactggatcttattttttttatggctgaatagtactccattgtgtataggtaccacattttctttatccattcatctgttgatggacacttaggttgcttgcaaatcttagctattgtaaacagtgctgcaacaaacataggagtgcagatacctctttgatatactgatttcctttcttttgggtatatatccagtagtgggattgctggatcatacggtaactcaatttttcgtattttgaggaacctccgaactgttctccatagtggttgtactaatttactttcccaccaacagtgtgcaagggttcccttttctccacatcctcaccagcacttcctattattgcctgtcatttggatataagccattttaactggggtgagatgatatctcactgtagttttgatttgcagttctctgatgatcagtgatagtaagtaccttttcatatgcctgtttgccatttgtttgtcttcttttgagaaatgtctattcagatattttccttattttaaaactcgattattagattttttttcctatagagttgtttgagctctgtatatattctggttattaatcccttatcagaggggtagtatgtaaatattttctctcattctgcaggttgtctcttcactttgttgattgtttcctttgctgtgcagaagctttttagcttgatgtgatcccatttgtccatttttgatttggttgcccatacttgtaggatattgctcaaggaatctttgcctactccaatatcctggagagctttcccaatattttcttgtagtagtttcatagtttgaggtgttcgatttaagtctttaatccattttgatttgatctttgtataaggcaagacatagggatctcaactttcctccttctgcatatggatatccagttttcccagcaccatttattgaagagactcttctttccccaaagtatgttcttggcacctttgtcaaaaatgagttcactgtagatgtatggatttatttctgggtttgctattctgttccactatgttgagctgcctggggctggaggaggggtgatacaagcacccttgtggccactgccactgggactgtgctggtcagacctgaagccagcacagcactgggtctcacccaaggcccactgtaaccactacctggctaccacctatgtttgctcaatgccttagggctctacagtcagcaggtgatgaagccagccaggctgtccttcccttcagggcagcaacttccccctggccccagagatgacatgcaggagccagggcctggagtcagaaaccctagaaatctacctagtgctctattctactgcagcttagctggtatccaaaccacaagacaaagtccttcccactctttcctctttccacacgcagaagagtctctccccgtggccaccaccatcaggtggtgtggggagttctgctgggctactgccagtgttcacttaaggcccaagggctctgcaatcagcttgtggtgaatgctgccaggcctgggactcatacttcagagaagtgggctcctctctggcccaggacaggtacagaaatgccatccaagagccaaggcctggaaccggggaccctaggagcccacttggtgctctaacccactgtggctgagttgatatctaagctgcaatacaaaatcctctttactcttccctctgcttttctcaagcagaaggagtctctcctcatagccaccacagctgggaatgtactgggtcacaactgaagccagcatgtctcagagtctcacctaaggcccacagtatgtactacctggctactgctgctgatcactgagggccaaagtgctatttagtcagcaggtgatgaatcctgccgagactgggtccttcccttcaaggcagtgggtaccttttagcccgaggtgtgtctcaaaatgttatctgggaactaggtcctggaatgggaccttcatgactatgccaagtgccctgtcctactgtggctgagctggtatccaagatgcaagacaaagtcccccttaagcttccctctcctctcctctagtggaaggaaggggtctgttttggagctgcaaactgcactgcctggggttgagggaggggtcgtgcaatcactcccttggctgccctggctggtgtctcactaggtcgcatgtcccccagatgcactggctccaagcccagcacagcacaaagatttgcccaggagttgcagtccttgtggcctagactgcctctcaaatttatttagaaccccagagcactttagctctcagtggcaaggcttgttggaactcaagttccaactactgggatggacaattgctctctagctagggctggtctaaatactccctccatgagcatcagttgagttctgcccagtgttactttctgctgtgacagggcagcactgagttccaagcaagatcccacaatcactgtgctctcccttccacaagcacacagattcgccatgccatgcagccactgttggggcataggagaggggtggcattggcagttcaagattgtccttcctacactcttcagtggctctttcggtgatacgaagttaaaaccaggtgctgtgatcactcacctgattttttattattattttttaaattttattattattatactttaagttttagggtacatgtgcacaatgtgcaggtttgttacatatgtatacatgtgccatgttggtgtgctgcacccattaactcatcatttagcattaggtatatctcctaatgctatccctccccactccccccaccccacaacaggccccggtgtgtgatgttccccttcctatgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatgtgtgccaattttcttaatccagtctatcattgctggacatttgggttggttccaagtctttgctattgtgaacagcgctgcaataaacatacgtgtgcatgtgtctttatagcagcatgatttatagccctttgggtatatacccagtaatgggattgctgggtcaaatggtatttctagttccagatccctgaggaattgccacactgacttccacaatggttgaactagtttacagtcccaccaacagtgtaaaagtgttcctgtttctccacatcttctccagcacctgttgtttcctgactttttaatgatcgccattctaactggtgtgagatggtatcttattgtggttttgatttgcatttctctgatggccagtgatgatgagcattttttcatgtgtattttggctgcataaatgtcttcttttgagaagtgtctgttcatatcctttgcccactttttaatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcaggagctctttagtttaattagatcccatttgtctgattttttattcttaatttttgtgtagatagttattaaatttggtgttcctgcagagaggatgattggtggaggcttctaatcagccatcttgctccgtccttcctcccacaatccagttttagaacatttccattaccctagaaattttccccttgcccatttgcagacaattcttgctcccaccttcagctccaggcaaccacagatccgctttctgtctctgtagattttctctttctggacacatcatataaatgaaattatataatacgtggcctcttgtgtctggcttatttcattgagcataacgtttttgaggttcgtccatgttgtagcattatcagtattccattcctttttttttttttttttttttttttgctgaataatattctagggaatggatataacacactttgtttatctgttcatcagttcatagatatttgagttgtttccactttttggctatcatgaataatgctactataaatattcatgtgcaagtgtttttgtgagcatatgtgtttaattctcttgaatatatacctaggaatggaattgttgggtcatcaggtaaatctatgtttaacttttggaggagctgcagtctgtttgccaaagtggccataccattttacattttcactagcggtgtatgaggattccagcttctctacattctcaacacttgctattgttcatcttttcttttttttgttatagccattgtggttttgatttatatttccttgatggctaatggtgatgatcattttttcatgtacttattgactgttcgtgtattgtgtttggataaatgtctattcaattattttcccatttttaaaatggaattttttattgagttataagagttctttatatattctggatacaagtcctttaccagatatgtgatttgtaagtattttctcctagtctctggcttgttttttcattttcttaagggtatcatttgaagagccaaagtttttaattttgatgaagtccaatctatcaattttttcttttgtgggtagtgttttggtcatgctgagaaatctttgcccaacccacgtttacaaagattttttcctacgtgtttctgtagaagttttatacttttatctctgacatgtagctctatgattcattttaaattttgttatagtgtgaggtagggtctaaatgatgttttgtttgtttgctgttgcatattaatatcactcctctgctgtttgacttcagttttcacatttgtaaagtgggaataatacctgatctgactctcccacactggggttgtaaggatcaatgaaaataatgtatgttttgtaaactttaacagcttgtacacatgtaaggcagtattgttattataagagagctataaaacattaagaacactacatgccttgcttaaagttacacagaaagtcattatttgagtccatgttaatatctgaggatcctgactgctcttgactcaactacttcttaatatataaatatagtcatgtgccacataatgacatttcataatatataatggtggtcctgtaagattataatggagctgaaaaattcctgtcacctagtgacatcatagccatcgtaaggcaacacattactcacatgtttgtggtgatgccagtgttaagaaaacttactgaactgccagtcatataaaagtacagcacatacaattagatacagtccataattcttgttaatgatataacaaattactatgttactgtttcatgtatttactatacttttatcattattttaaagtatattccttttatttataaaagaaagttaaaactgtaaggcagcttcaggcaagtccttcaggagatattccagaaaatggcattatcatcctaggaaatgacagctccatgtatgttttgcccaagaagcctttccagcaggacaagatgtggaggtgggagacagtgatattgatgatcctggccctgggtaggcctaggttaaaatatgtgtttgtgtcttagtttttatcaaaaagttttaaaagttttttaaaaaattaaaaataggaaaacacttatacaataaggagataaagaaaatatttttgtacaactgtataatgtgtttgtgttttaagctaaatgttattacaaaagagtcaaaaagttggggttttttgttttgtttttgtttttttgagacagagtcttgctctgtcacccaggctggagtgccatggcgcaatctcggctcactgcaacatctgcctcccgggttcaagcagttttcctgcttcagcctcccaaatagctgagactataggtgcatgccaccacacccggctaatttttgtatttttactggagacgaggtttcaccacattggccaggctggcctcaagctcctgacctcaagtgattgtcccacttcagcctcccaaagtgctgggattacaggagtgagccagcatgactggccaaaaaaaaaattttttttttaattaaaaaggttttttttgggtttttttgtttgtttttttgggttttttttttttttttttttttgagatggagtctcgctgtcactgacgctggagtgcgaaggcacaatctcggctcactgcaacctctgcctcccaggctcaagtgattctcctgcctcagcctcccaagtagctgggattacaggcgtgtgccaccacatctggctaattttgtatttttaggagagacagggtttcaccatgttggtcaggctggtctcaaactcctgacctcaagtgatccatccgcctcgacctcccgaagtgctgggattacagtttataaaggaaaaaagttgcagtaagacaaggtcaatttatatttatatattttttgagacaaagtctctgtcacccaggctggagtgcagtggcatgatctcagctcactacagctttgacctcccaggtacaatcaatcctcccacctcagcctcctgagtagctgggaccacacgtgcgcaccaccacacccagctaatttgtttgtatttttagtagagacagggtttcaccatgttgcccaggctggtctcaaactcaggttcaagtaatttgctcaagtaatctgcccaccttggtctcccaaagtgctgagaatacaggtgtgagccaccacacctggccaaagttaatttattattaagaaagaaaaataccctttaataaactgagtgcagcttaggtatacagtgtttataaagtctgcagtaatgtacaagaatgtcctacaccttcatgttcactcaccactcactcactgactcacccagagcaacttgtagtcctgcaagctctattcatggttagtgccctatacaggagtaccattttttatctttcataccacatttttcctctaccatttctatgtttagatacacaaatacttacctctgggttacagttgcctacagtagtcagtagagtcacatgctgtatgggtttgtagcctaggagcaatgggctttaccatatcgcctaggtgtgtaggaggctataccatataagtttgtgtaaggacactctatgatattcacacaatgacgaaatcacctaatgatacatttctcagcttgtgtccccattgtgaagtgagacatgactatctgcaaatcacaacagatggtggaacattatagcagggtgacaatctgatacaaactagcattgacttaccaaagcctagaattctcctggagatgtgtaattatggcctgtgtgaatttaagtttaaaaataaaaacttcaacattggacatttggattatttattttactgtcttctcggatgaataggaaattctatttctaagccatgagcctcatctggacctttcaggtgtgtttgccatagtgaccaatacaaactgaaattagattgtactataactccaagttgatcaatttccatagtctctctataaggccaaaatttctctgtgcattttgtttttgccactttcattctgtccaatatattgcagttccaattctctggctcttgggttacctgttagagagcttaatgtttttctacttttctcatgagtttcccatccatttattgctcatcccctgaaacatgactggatagttagctttttaatgcagtgattaatttattttttaattttttaatttttatttatttattttttatttatttatttttttgagacggagtctcgctgtgtcgcccaggctggagtgcagtggcgcgatctcggctcactgcaagctccacctcccaggttcacgccattctcctgcctcagcctcttgagtagctgggactacaggcacccgccaccacacccggctaatttttttgcatttttagtagagacggggtttcaccgtattagccaggatggtcttgatctcctgaccttgtgatccgcccacctcggcctcccaaagtgctgggattacaggcgtgagccaccgcgcccagcctgcagtgattaatttaataaccctcttggctctttatattatatatgttgctttatcctatttgattgaatgtgccgtgcatctcctttgtttcaaatgcttgggacaaaattctgcctttgtttgactgacttttttaatgaccagtcactcattcattattcactgagcagataacctttatcaagtgcctccacacactggcaaaatggctatcatacaaatataaaacctcatgcctcacaatattatgctttagactgagcagagtactcttacgtccactctctcgtacaacctccaacagcaattatagaagtagacaatgctgctattgttatccctaatttatcaatgagggaattttaagattcaaaaagtcaagtaaccaatttacctaaggtcattcatgactaatgagtgagagtcaggactagaatgcaggtcttctgagctcctgtcttagtcaattcgggctgctataacaaaaataccatagagtgggtggatcataaataacagaaatttatttctcacagtttgggaggatagaaagtccaaaatcaagacactggcagattcagtgtccagtgagggtctgcttccccatagacggtcctttctgactgtaagctcacatggcagaaggggtaaaggatctctctagggtctcttttataagggcactaatcctattcatgagagcactcctcttatgaccttatcacctcccaacagccccacctcctaatatcatcaccttggaggttaggattttaacatactaattttgaagggacacaaacattcagtccgttgcacatcaactacagggctgtttccactggaggtgcgtggcttctttaccagtttttgctaggaaattttagtttaaaggagaagctcaagttgatatttagaagctagtggtaatgaaaaagcagggagatgactcccaggcttaagcagacaaacctatcaacctatgtaggttcatattctagataatttttaagaagaagtcgattgttcaagtttttttaaatcaaaattttattttgaaataattgtagatttacacgcatttgtaagaaataacacagagagatctcgtgtactctttttattgtttgtttgtttttgagacagagtctcgctctgtcacccaggctggagtgcagtggcgccatctcggcttactgcaacctccgcctcccaggttcaagcgattctcatgcctcagcctcccaagtagctgggactacaggcaaatgccaccatgcctggctaaatttttttgtattttcggtagagatgggttttcaccatgtaggacaggctggtctcgaacttctggcctcaagtgatctgctcgccttggcctcccaaagtgctcatgtactctttacccagtttcccccaacgataacaaaactatagtacaacatcacaatcaagatgttggcattatcacaatcaagacatagagcattgcatttctgtcaccacaagtattcctcatgtttcctttgtatagccctcacactcttctctcccactctcagctcctccttaaaccctgacaaccgcaaatctattaccaatttctataattttgtcatttcaagcatgtcatataaatgtgatcaaacagtatatagcttttgagatttggaatcatacagtacataactttttgagattggctttttttgagacagggtcttgctctgtcacccaggctagagtgcagtgaagctgatcatagctcagcctcagccccccaggcttaagcgatcctcccacctcaactccccgagtagctgggaccacaggcatgcaccaccaagcccagctaattttttaatttttttgtagagatggtctcaaactcctggactaagcgatcctccctccttggcctcccaaagtgctgggattataggcatgagccaccacacctggccaagattggttcttttcacttagcataattctctagagattcatcaagtcattgtttgttacaaaaggacaaatattgtatccttctatttatatgaagtacccagagtggtcaaattcatagagatggacacctgcaggggaggctccccaggaagagctgactgggtgtttaatggcctcttcttgcaggctcaagattgaccttagcttggagtcactgggcttgagcttctatttcccagtcagggttgttcactcagttttacatgagaaaatactcagtgtttgaagaatccagcaaaattactcaaactcagtgtttatggaagggaataaaatagtaaggcatttacattttatatctccataaacaagcaaaagtgtctatctctttcagacaacaaacatgtcatttaattatctccataataaaaaaaattatttaataaacaattgaaaaaaaaagaaagtaaagtggtagtcaccaaggactggggttattacataatgggtacagatctttagctttgcaagatgaaactggttctggagatggatggtagtgatgatagcacaacaatgtgaatgtacttaacgccactaaactgttcacttaaaatgattaagatggttaaattttgtgctatatgtattttaccccattttttaagtcatagaaaagaatctttgtcaggtatcgtaacatttctgtcatctcagtgttggcatcaattcattgtcttttttcgttatttgagatcttcctgattattggtataatgagtaaatttgttaaacctggacaatttcatattttgttctgagactctggatctcatttaaaccttctgttttaacttggtttctctgacctgctttagcaagggagtgggcccagccttgttacttccaggtagaagtagaaacaagcctaagtttctaacttgacctccatcattgatactcaaggtagaggactcctttttactactggtcccttggctagagacagcagacttttcttggggcttttttctttctttttctttttgggtctatgtctgttggcatctctagcaccaagtttggggtatatgaagcaaaaagaaaacccagagaacttatcactgtgtcaatccttggctccaaggtcttccctttctctacacctttcagaggtttcttatgtttgttttatgtataatgttcaagagttagttttatttagcaggaagaatagggataagtacatttattccatctcatggaagtggaaatttcttggttcatttttaagaatatacaaagacttaaataatggtgggggggaaacctacacttaaagagaagggacaaacctaatcctcacagctgatgtcagagtcacagagtcacaaaggcgttttgtaaccaagaagcccagaagaacacagactctttccttttacaagggaagctaaggtgattcaaactactgagctacattctctaagagtttgcttcccaaagcgtgatcagcatcccctaggagcttgttagaagcatggaatcttaggccccagacctactgaatcagtctgcgttttaactatacttccggccgggcacggtggctcatgcctgtaatcctagcactttgggaggccgaggcggatggattacttgaggtcagagttcaaaaccagcctggccatcatggtgaaaccctgtctctactaaaattacaaaagttagccgggcgtggtggtaggcgcctgtaatcccagctacttgggaggctgaggccgaagaattgcttgaacctaggaggcggagattgcaatgagccaagatcacaccactgcactccagcttgggcaacagagtgagactccatcttaaaaaaaaaaaaaatatatatatatatatatatttccaagtgtcttgtatgcacattaaagtttgagaaggtcatttatcagtatcttttgtctcttgtttggccttctacttgttcaatttcatctcagttcctacttctgccaatcttatataagttcatagattaggcaattgggatctaaaggaaatataaggtaaagcttcattcaatgactgagaaaatttagaactggaaactaatgatctttgcagttacctaatttaagctcattattttgcaaattgaggcattgaaaggttaaatatctgacacaaggtcataccactatataatggcaaagctaaaaattgcagccgtgttatttcttcataggacaatggtccttgggttttctttcatctattttttaataaaatttttttaattgagaggaggtcttactatgttgcccaggctggtctcaaattcctgggctcaagcaatcctcctgccatgtcctctcaaagtgctgggattacaggtgtgagcccctgcacccagccttctttcatctaaatcttcctccttccaagcctcacgtctccctgagactggaattgaggttcatacaaagccatctttgagtcagactttgatattgtgtctctcctacagctttgtagtttcctaattggtctctggctctttcttctcttctccattttttcctgttcatccctatcaaatatatctccgtaaaacacaacttttgctctatcactccctttccctcaaatcttttaacaactctgtatttcccaaatccttacctagacccttaaggctatctatccataacctcattcaacccccaaaacaagacagagtttttcccaggcaatagtcaatattctctttatcatcaaccttcacctccttctctcccttcttcttagaacaaagcagaatcttccctgaagaaaacgtgtccctcactacgaatttttatggaggtctcatcttttccaactccctttttctcagcagaagggactaaattacctggatctttgctccatggtggcactttgtactatttatataccaccttcctacggcttctcttcacttaaaacctatatctcttcatcaccaatgttgtcatgtcctggacccaccttttccttccttggtaacttcattgttatttattatcctaagtgactttggcatccatgttagcaattcttgtacctcacagtttccgtttttcactttttagccactgtctacctcccatataagccacccactgtggcactgctccatcttcaagattggtaactaacgcaacacttttctattgagtctaatctcccttacttccccatatctattctctgttctcacttgaacttcaaatcactcgtcttttcccactctattatagtccagtctaactaccttttttttctttttctctttcttttcctttctttctttctcttttctttatttctttatttgcttccttccttcttccctcccttctttcctccccttccttctctctttctctcttcttttgattattcctgctgtttcatttttttccaaacctggtaccttgccaccatcagttcttctgctcctgatcttgagcagcagaagcactaaagaaagttacagaaccatctagatctggcccagtacagattcattctgttaagctttcagtgggttctcattgctgctcagaaattcttttattcttgtcaactttttggcaaactcaagtaaagtggctgcttcaaaccttttctaatctcgtaaaaacttagacctacctcattccccattagatgatctcatcatatcatttcagttgagaagatcaagggcatcacatatgagatccctcattggcccatgtctcaaccataacattctaccactgtacctacctactcacctttcctcttttttcaaaagaaattttctcaaccttgcactgtcagttcaatccccttctacttcctgaggcattttactgcctgtccatcatttttactctctgcctacagatggttccattctgctttcaagaatgcataagtctcaaacaaatggaaatatataccatgttcttggacaggaaagccctaacagtataaagtcagtttccctaaattcaatgcaataaattcagtcaaaattaaaatctcaataggatttttaatgaaacttgatgattctaaaattcttccctaaaagaaaatgaaccaaaacattttttgtaaaagaacaaggaaggacttgccttatcaaatacttttaaaactataaaatgatattaattttaaaagtatggcattagtgcaaaaatctacaaagagattaatagaacaggactgagcccagaaggagatccacatatctatgagaattttgtatgcaatggaaaaggtatatcacatcactgagggaacaattggtaaaatggtattgggacaatttaaaaagcaaagttacgtccttatttttaaactgaggggcgttatagcatagtggttaagagaacagactttggagccacataaccagttcaaataaattctggctacaccatttattagctgtatgactttggtcttattaattaattatgtatacctctgtatcctcatctgtaaaataaatataataataatctcagcactttgggaggcaaaggcaggagtatcgcttgaggccagaagttcaagaccagcctggccaacatagcgagatcttgtctctatgaaaaataaataaataaataaaagctaaaaaaagtgcctaccttacagtattattagtattaaataacttaatatatataaagtacttatagcagcacatagtaagtactatataagtgatagtattatttttttgccttataccatgcacaaaaataaagtccaaaaggaagaaataaagaaaatccagatagattaaagagctaaacataaaatcaaagctataaaagcattaggaaaaaacagaggaaagcatttttttaaatcatggaatggagaggacccactcagaagctgtataagaaacaaatagttttggttacatgaattaataaatagcacaagataccacaaaacattttaggcctggtggagtggctcatgcatgtaatcccagcactttgggaggccgaggtgggaggttcacttgaagccagaagtttgggaccagcctgggcaataaagtgacactctgtctctatgaaaaaaaaaaaaacccataagttttgtgggtttttttttgaaatggagtttcactccgtcacccaggctggagtgcaatggcatgatgatggttcactgtagccttgacctcctgggctcaagagatcctcccacctcagcctcccaagtagctgagactacaggcacatgccactacacccagctaattttttgtatgtttggtagagatgcggtttcaccatgtctcctaggctggtctcaaccttctgagctcaagcaactcaccctccttggccttccaaagtgctgggattataggcatgagccaccacacccaggcagatatgtattttatactttgggttataatacaatattactttattttattgttcatattgttctagctttgaaaaagtctggcagcttcccagaaggttaaacatagttaccctgtgacccagaaattccactggtaggtgtatacccaagagaaatgaaaacatgtgtccaaagactcatagcaaatgttcatagcaaagttattcatatagcccaaaatggaaacagcctgaatgtctgttagccaatgaatgggtaaacaaaatgtggtatttccattcaatggaatactatttgtccattgaaaggaatgaagtactaacacgtgctataacatggataaaccttgaaaacatggtaagtgaaagatgtcagtcacaagggcccacatactgcctggccccatttatcttaaatgtccagaaaaggccaatctataagagacagaaatgagagtagtggttgcccagggcttagtggggtaggggggcaggttgagaggaaatggaaggatattggctgggggcagggggaatatggagccaatgggcatgggctttccttttggaggaatgaaaatattccataattgattgtgatgatggtggcagaactctgtgaatactgtgaatatactaaaaaccaccgtattgtacactttagataaactatggtattttatttaattgtatcttaataaagctgatgcacatactatttactttgggaatctatggagagcctaaaaggacaggcatttgtgctccagaatacctacgattcagttagagatctacgtggctgccatatgtattaagatgttgaggacagagaaaactggtttaaaatatgtggccccaaaaaccatcagagcaaacacctcagtttgctgacattgatttgtattacacgtaggcaagtccatgtggctttcaggtcagtagctgtgtggatgcatttctttattgaggattaatgattttcataagcaatgctgggcatgagggcaactaatgcaaattaaaataaaactcgagtgttccctaactcattggatgacaccatcattcttctggttgcccaagccagacatctaggagtcatcctcagcacctccctcactcccacttctaatctatcaccaagtactatcaatcaatttgacctcccaaatatctctcaaattcatctacttcctcctatctttcaccatcagtaacctagttcaagttacacaccttttatcttagctagtttagtgatctcaggaaccttttaactggcctcacatctactcttgctttcttccttcctttctttgcccagcaaccaaggtgatcttttacttttttttttttttttttttttttttgagatggagtctcgctctgtcaccaggctggagtgcagtggtgcaatctcggctcactgcaacctctgcctcccaggttcaagcgattcccctgcctcagcctccccagtagctgggactacaggcacccgccaccacgcccagctaatttttgtatttttagtagagatgaggtttcaccatgttggccaggatggtctcgatctcttgacctcgtgatccgcccacctcggcctcccaaagtcctgggattacaggtgtgatccaccatgcccagccaatcttttacatttttgagtatgcatgaccttttgaaatcctctttagtagtttcccattgctcttaaaataaagaccaaaatcttgaatgtggtatacaagatcctactaacctatctgtcctcatcttgagccactctttccctcacattctgcactgtcagccacactttacaagaccacaaattaccaccgtctaggcaaatatgatggtctcttttccctggccttcgttattgaccactgcctccttattgaaattctgttttcctttgtcctttattttctcgccactcctctgcgttcttttccctcttaccacccaactatgaacatttccaatattctctactctttgctactctgtattctgtactctgtcctttaagtgaattaatacactttaactattacctgagttccaatccatatctgcaacagcctgcttatctccagagttacctcaagccaacttgtttaaaatagaacttattgttgtcccttatccccagaaacatgtccttcaattttttctttcagtgatgccagcattctttcagccattcaaactacataccttagagccattttcacttgacctgtcattccccatatcaaatcagttaccaaattctattgattcttcctttaaatgattcttacatccgtccatctaaattgtcactattttagttctgaccctcatcacttcattcttagatcacacaactccttttattttattttattttatttttatttatttatttttttgagacagaatctcgccctgtcgcccaggctggagtgcagtggtgcgatcttggctcacttcaagctccgcctcccaggttcacgccattctcctgcctcagccttccgagtagctgggactacaggtgcctgccaccacgcccggctaatgttttgtatttttagtagagacaggatttcaccatgttagccaagatgttcttgatctcctgacctcgtgatctgcctgcctcggcctcccaaagtgctgggattacaggcacaagccaccacgccgggcctttattttattttttgagacggagtttggagtttcactcttgttgcccaggctggagtgcaatggcacaatcttggctcaccacaacctccgcctcctgggttcaagcgattctcctgcctcagcctcccgagtagctgggattacaggcatgtgccatcacacccagctattttgtatttttagtagagacggggtttctccatgttggtcaggctggtctcgaactcccgacctcaggtgatctgcccgccttggcctcccaaagtgctgggattacaggtgtgagccactgcgccaggccataactccctttaaacacgtctccctgtctgtgttttcccacacggaggtctgttctaaacaccactggcatttctatcttattaaaactacactttcatcatatcactctccttctcaaaaagtttcagtgccttcccgttgccagcaggataaatttcaaaatctgaagcctgtaatgcaaaaacccttaacactccagcccacaagatgttagcaaacgttccacataccctggattagacaaagttccatggtttctttactgtaaaacttccctaaactttcagtgaactagtgtgcattataatgctccaaaagggtgatatatagaatgcggcatttccaaaatgtatttgactaaagaactctattttcatagaccatctgttaacatttctcatgacactagtgttctgaggaagaacattgaggaaaggcttaggaagctccatcctacatttccagtcttatttcccgttaactcctctacataaatcgtctgcttaggccaaagaactcttggtcttcctaagacatgcttgttctcaagtacaatccaagtcttcatttattctgttctacccacatggaatgcccttctctttctctgaatatctatatttttctttttaattgagatttagttcatatatcataaaactcacattaaggtatacagttcagtgagttatagtatattcaaaagattgtgcaaccatcaccattatctaattctagaacattttcatcatccccaaaagaaactctatacccattagcagtccttccccatacctcccttccccagcccctggcaaccacaaatctcctttctgtctctatggctttgcctattctgcacatttcatataatctctgtatatgtagatcctactcatctaccctaagatcatgtttgtttgtttgtttaagtcatttttttcattcacaacattaaaatcacaacactcataccctgtatcagacactgtgccaagcaaaggcaaatgtcattttaccttcaaggggctccctgcctagtgggggagacaggcagtacagtgttcaaagtactattatggtgctgtgaacaaagtagcagaggggcaaagaggtttgagcaagaaattgtggagagccagggaaatcctcactgaggaggtggcatctgactggatattgattcatttgttcattcattcattcagcaaacatctgttgtgcctcttatgtgccaggcacagtgctggactctgaagatacaaaaatgcacaggaaaaattccctgtacctcaaggaactcaatagtctggaggagataaatacatagcatttcaaaacaatataacataagttatattagaggaatggaaagctcactgtgggaacagacaactaactgttcttgtgaatttgaagaaaaagtataagtctatgaagtggacaaggatgaggagtagtgtttcaagcagagactagaccgcctctgactggaatatcctagtgctcatttctttaactgaatgagagcacctaatgtttgtgtctcttaatcacataccttgtgaagtcgtctttacatgtggatgccttgtgtccccaaaagcattgcacaacctttaggataaaagttttgtcttttccctcttagtgccctcattatcacagtgttttatgtatagtaatttctttttggatccaaatgaatgaaaggatgacagctgagacagcattcttgacactctcaaaaagctgctgcctaatgtgtctcctatcacatttctcccttctggggctttaacatgaatgctttctttgtgttccatctcctatgcaagaaccaagaaagtagcttcttagactaatacttttcactattgcaaagtattgtgaagaagcaaatataatcttgtgattagtcatgttaaagaccactgataaggctaagggaccatcttagaaatgtgtgctgtgttcatagctaggtagatatcgttaactctgaagatgaatataatttctactccaaatatggactaattctggtgacagaaattaagaaattcaataaaactgcttcttgacaaccttatccgaaaagtagaggtaggtattagggaggtaattgactgaagacagaatcaagggaagccccaaacagtatgcaagtttttctcgtgcctcaggaagattaggaatctttctaattctttccttcagtcagagaggacctcggtttacgtctcttcatgagatcttgctatggaacattctacagctgacaaaccttcaaagtgctctcctcctgcactctccaggagcacagaccttcctaaacatcagcagagctcctattgtttgtttagtaataaagggacatagcatggatacaggtagtgccacaatgaactgtgacagtaataactgcaaaatttctgttcttggattatagaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcaggtaaggagggagagggctagggcagatgacatgacctagggggcaagaggttatggctgggctctccacaaggactcaaccccatcctccttggctaggaaaggatcttgctcattgttcctctcaatggttccacataacttcaagaatcaggagaccataaacagtaattccttagagcaaaaaccaagaaggacagagaacagggggaaatttaaggatagcaaatggaatctaattaagaggaatgccaagagtgagctctggaaagatgcatcactgtcagtgccagtgcatgtgggaaaggactggcctctgctcaaagcaataactgttgaaaaaggcattttctccaggaactattctcagttgcagagttctgggccattggctaaccaggagaggtttggtagagaaaaagccttgttaccaaataagagcaaaggatattttatagttaagtatcttctcccttataataggggattccttttcctcaagagaggactgtattttctccccaaatctgagatgcttcagatctccgaaggtaacggttagactttcatgccatcaccgtgggtctgggaagctttcccacatttctttttcccctcaagaaatctatttgttgttctctttcccagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaatt

SEQ ID NO: 4688 - DNA, 379791 bp, human
ggagttttctgaacgtcctcgtgcgctgtggacggaggttgtggagagagcagggcggcattggtggctgcggctgaggtgagtggtttagtgggcaggaaggggtagaataggcttcaagcacaagttagttgggtagtttataactagcaagaatatattatagccattaggccaaaactttttagagcggccctaaggcagtgactttgtactacagaactgctcgtcgctctcaaggcgaacgaagatgggcaaatgtaatgtttttggacgaggattgaggagtatggggagcggtggtgggccactgaaaaccggagatagtagttactgtagtttagatgctaaaggacctaaattacgttgaagcgggactgttgatgaccgttgggggcaatgtaatgttttttgatgaggatggaggagtatggggagttgtggtgggccactgaaaaccggagatagtagttattgttgtttagatgctgaaggacctaaattacgttgaagcaggactgttcatgaccgttgggggcaggatactgaaggtgctagcgttctcacagagcgggaaaaaggaccgtgagtgattggatgctttgaatgtgcggttggtagcggaagcggattttgagccaattaggaagaagcagcgagacccagccagaccaataacagggtaccactcagctccatttcccccgttgccaggcagacttatggtaagaaaaggtcccttttatgtaacttggcagcctggccctgcccctcacaaaagccctttcatgggcttttaactttactcagcctttttttctccctttggataacaagtaacgggaaacatttcactggaaagaaatttgttgagaaactagaggataaaacagagtattaaaatatgttattatttcacaggcttgagccagagatttaaaaatggacaatgatgattttttttccatggactttaaaggtacgtagctctacgtggtagtacaaaatagtgtcaaactgctgctttaagatctaaatattgctgggcgcggtggctcacgcctgtaatctcagcactttgggaggccgaggcgggcggatcacgaggtcaggggctcgagaccagcctgaccaacatggtgaaaccgcgtctctactaaacatacaaaaattagttgggcgtggtaatcccagctactcaggaggctgaggcaagagaatcgcttgaacctgggaggcagagtttgcagtgagcagagactgcgccactgcgctccagcctgggcgacagagtgagactccgtctcaaaaaaaaaaaaaaaaatctaaatattttgtttctgagttttgtctttctgcagtgtccatagcaccaggttttctcatttatgtaccagaaacaatgtctatttttaacacattgggaacctttttatgaactagtgtagggagacagaattcacaattcataacttgtttttttttcaggatttttatggcatgcaaaataaaacgtttaatctggaagataaatctattgcaataaaaataagtttaaaaaattactgcaagatcttggagttcctttccataatcatccgtgaaaaataaattatatcctgtgtagttttagacttaagtacattttattgtgtcttaattcttttgaaaattggtaatccatgtttgctatttatgggaactctcaataaacaaaagcaatttgactgaccagaacaccagattcctcaactgtgctagatataggagagtttgtggtactatctttgtttttggggaataatgagacctgtggtaccttcacattcatataataatgaaatatgtggtaagaaatgtggctacaaatctatgattttaaaaagtttaggtcaacattttgttaatacttttttttgtttgcttgttttgtttgtttgtttgttgagacagttttgctcttgttgcccaggctggagtgcagtggtgccatcttggctcactgcaacctctgcctcctgagttcaagcgattcttctgcctcagcctcccaagtagctgggactacaggcccgcgccaccatgcctggctaattttttgcatttagtagagacagggtttcaccatgtcggtcaagctggtctcgaactcctgacttcagttgatacacctgcctcggcctcccaaagtgctgggattacaggtgtgagccaccatgccaggccaatatttgttattttaaaacaataacaataaagcctgctactatctactttaagttttaaattaggataaaatatcttaaaggtataaagatggaatagggattatgactcttaagttgataatatttgagactttgtatttacataaatatttgaatcacacagaaaagtatagaaaataatataatgaacatctgtgtacctaccactgagttttgtcaaatcttaagcttgccatatgcttcagatatttcaaagaactaaaagattacatgtaccatttttctttttaaattttatataaatagttattttatatttctttttcctgcagcttgtcttcttttttcctttttttgctcagcattgtgatatatatatatatatatatatatatatatatatatatatatattttttttttttttttttttttttttttttttttttttgagacagagttttgctcttgttgcccaagctggagtgcaatggtgtgacctcggctcactgcaacctctgccttccaggttcaagcgattctcctgcctcagcctctcgagtagctgggattacaggcacgtgccaccatgcccggctaattttttgtatttttagtagaaacggggtttcaccatgttggccaggctggtctcaaactcctgacctcaggtgatctgcctgcctcagcctcccaaagtcttaggattacaggcgtgagtcactgtgccaggctgtgtttttaatatttacccatatgaatacttttagttcatttatttccactgctgatgagtagtatttcattgaacctaaatgtaccacaatttattcattcagtctcctttgttggacataaaaatggtttcaaatatttgctgttaaaaacaacaatgctacaacgaacactgtgtttctgagagtttaacagaaactttcaaaaacatctttgactaccactcatggcaagaaaatgttttgattacatcccagtacatacatactgtgtcaaaagtttaataaaacaaaattttatcctcattacatgcagtacactatgatattttctattctatttttctcattaaaaaaatgctgggtattcagcaaaggtctgactgaaaagaaatgctgggtatgactcactacctcaatacattgactgattttttttttcttttgagacagagtctcactctgtcgtccaggctggagtgtagtggcacgatctcggctcactgcaacttccacgcctcccgggttcaagcaattcttccgactcagcctcccgcgtagctggggctacaggtgcatgccgccacgcctggctaattttttgtagtttagtagagatggggtttcgctgtgttgcccaggctggtctggaactcctgagctcaggcaatctgcccgcctcggcctcccaaagtgctaggattacaggtgagagccactgctcctggccttgagccactgcacccggccttgatttatttcttgagctactggtaggtgaggctctagggcagtgccgtccaactgacatggtgcaaaaacaaaaaattttatattttctagtagtcatattaaaaatgtttaaacagatgaaaataattttaatgatctaatttttttaactcagtgtatcaaaaatgttattataacataatcaatatacaaattattaataagttattttacattctacattttttggtacaaagtctttgaagtctggcatgtattttatacttaaagcacatctcattttggatcagccacatttcaagtgctcaatagtcacatgtggctagtggctaccatattggacagtgcagttctagagtttacatttgggagtgtaactgctgagtcaaaagctatgagcatctttaactttatagatattgccaaattgctgtccaaaatggtcttaattcaaactcccttttccccatatccttactaatatttgatattgtcagacttttaaaattttacaattttgaagactgttgtcatttttatttaccattttactttggaataattttagatttacagaaaagttgcagagatagtgcagagagttcccatatactcttcaggcagtttcattttcccaaatgttatcatcttacatgggtgttgttttgacttatattttcctgataactagtgaagttggtgtactttcatagatttactggctgtttgagttttctcttatgcacacataaactttttagtcaagttttataaaaatggagcataaaagcctatccaatggcttttagcaatggctatagttcattccttcttagggagaattgacataacaccagtcttttttgtatcaccaatctcaataaattttcaagaccaaggccaggcctggtggctcacgcctgtaatcgcagcactttgggaggctgaggcgggaggaatacttgagcccatgagtttgagaccagcctgggcaacagagaccctgtcttcaccaaaaaaaaaaaaaaaaaaaaaaaagctggatgtggtgttgcatgcctgtagtagtctcaggagccagaggtgggaggatcgcttgagcctaggaggtggagcctgcagtgagccttgattgctccagcttgggtgacagagtgagatcctgtcttaaaaaaaaaattcaagaccaggaaggaatagaaatttgtctagataattacacccactggggctaaataaatgtaactccttttctgcatgtcatcttcaactatttgaagataacttatcttgtaccccggaaagtgtcttcagattgagcattctcagtttgttcaaacattcctgatattacctggtttctagtccccttatcattttgtgtgctatcctttaaacatgctctatccttttcgtgttatttcttaaagtgtggtacccagaatagaacacaattctctatgtttgatatgatcagcataaaatacagtcatgtgctgcataatgacatttcagtcaataaaggacagcatatacaacagtggtcccagaagattttaatggagctgaaaagttcctatcccctagtgatgtcagagctgttataaagttgtagagcaatgctttattcatgtgtttgtggtgatgctggtgtaaacaaatctactgtgctgccagttgtttaaaactatagcacgtacatttatgtacagtacataatacttgatggtgataataaatgactatgctactggtttatgtattcactataccatactatgctatcttatactatttttttatcatcatcttagagtgtactccttctatttataaaaaataaagttaactgtaaaatggcctcaggcagttccttcaggaggtattccagaaggcactattatcgcagtaggtgacaggtccatgcattttattgcccctgaagaacttccagtgggacaaaacgtggaggtggaagacagtgatagtgatgatcctgagcctgtgtaggcctaggctaataatgtatgtgtttgtgtcttagtttttaacaaaaagtttaaaaagtaaaattaataatgttaacagaaaaaagcttatagaatagggatataaagaaagaaaatatttttgtacagctgtataatgtttgtgctttaagctaagtgttactacaaaagcgttaaaaagttaaaaataattaaaaagtttgtactttgggaggttgaggcgggcagatcacttgagctcaggagttcgagactggcctgggtatcatggtgaaaccctgtctctaccaaaaatacaaaaaattatcatggcatggtggcacgtgcctgtggttccagctactctgtggtcccagctactccataggttgaggtgggaggattgcttgagcctgggaggcagaggttgcagtgagccgagatcgcaccactgcattgcagccccagtgacagagtgagaccccatctcaaacaaacaaacaaacaaagcttataaagtaaaaaagttacagtaagctaaggtaaatttattattggagaaagaaacatattcttttataaactgagtgtagcctaagtgtgcagagtttataaagtctacagtagtgtacagtaatgtcctagaccttcacatatattcaccactcactcactgactcacccagagcaacttccaggtctgcaagctccactcatggtaagtgccctatacaggtgtacctttttttatcttataaaaatttattattatgttatttgaggtagggtctcactctctcacccaggctggtgtgcagtggtgtgatcgtggctcaccacagcttctacctcctgggcccaagtaatcctcccacctcaacatcttgagtagccgggaatcacaggcatgcaccaccatgcccagataatttttaatttttctgtggagacgggatctccctatgttgcccaggttggtttcgaactcctgggctcaagcgatcctccttcctcggtgtcccgaagtgctaggattacagctgtgagccaccgtacccagtcatttttaatcttttatatttttacttaccttttctaggtttagatatgtttaaatacacaaatacttatcattgtgttacagttgcctgcagtattcactacagtaacatgagttataggtttgtagcctagaagcaataggctataccatatagcctagatgtgtagtaggctataccatcttgtgtaagtacactctatgacggggtcctcaacccctgggccacggaccattacctgtctctggcctgttaggaacctggctgcacagcaggagatgagccctgggccagcaagcattaccgcctgagctccgcctcctgtcagatcagtggccagtggcattagattctcacaggagcctgaactgcccacacgagggatctaggttgcatgctccttatgaaaatctaactaatgcctgttgatctgaggtagaacagtttcatcccgaaaccatccccccaccatccgtggaaaaattgtcttctacaaaactggtccctggtgccaagaaggttgaggaccactgctctatgatgttgggacaatgacaaaaatcaccaaattacacatttctggaatgtatccctgtccttaagtgatgcacgcctgtaatctttctctttagatttaggactgatgatttttctctttagataataatatagctaagactgaatttgctttttctttctttcataccacgctagttattcattttgaactttttgccccccaaatccctcagtcttttttaagtatttatttatttatttagacaaggtctcactctattgccaggctgtagtgcagtggcgctatcctcctaggttcaagcgatcctcccgcctcagtttcctgagggaatataggcatgcgccaccattcctgactaatttttgtatttttggtagagacagggtttcaccatgtttcccaggctggtctcctgagctcctgagctcaagcgatctgcctgcctactggccttttttctagatttttctttctttctttttttgaggcagagtctcactccattgcccaggctggagtgcagtggcataatctcagctcactgcaacctccacctcccaggcgcaagcaattcttgtgcttcagcctcctgagtagctatgactgcaggcatgccaggctaatttctgtatttttagtagagacagggttttgctgtgatggccaggctgctctcgaactcctggcctcaagtgatccacccacctcagcctcccaaactgctgggattataggcatgagtcaccactactgggcttcactgatcttttatatatatatattttcattttaatttcgtttatttctattctggtctttattatttcttttcttcaactaactttgggtttggtttgcttttgcttttctagttgtttaagatgcatcattaggttgttcggagtttttcctcttttttgatgtaggcactcatagtgataaacttcactctgtatcccatacgttttggtatgctgtgtttccattatcatttgtttcaagaaaattttcaattttcttcttcttcttctttttttttttttttttttgagatagagtctccctctgtagcccaggctggagcgcagtggcacgatctctgttcactgtgaccctgcaacctccgcctcccgggttcaagcgattctcctgcctcagcctcccaagtagctgggattacaggcacccaccatcacacttggctaatttttgtatttttattttaactaattaattaattaattttttgtttgttttgagacagagcctcactctgttgcccaggctggagtgcagttgcaccatctcggctcattgcaacctctgcctcccaagtttaagtgattctcgtgcctcagcctcccaagtagctgggattacaggcgtgcaccaccactcctggctatttttaaaaaaatatttttagtagagaccgggtttcaccatgttggccaggctgttctggccaacatggtgaaactcctgacctcaggtgagctgcctgcctcagcctcccaaaatgctgagattacaggcatgagccaccacacctggtcctttttttttttttttttttttttttaatacaggacctctctttgtcacccaggctggagtgcagtggcatgaacgtataggtatgcaccaccacgcctggctaatatttgtatgttttgtaaagactggattttgccatgttgcccaggctggtcttgaactcctgagctcaagtgatctgcttgcctcggcctccagattacaggaggtgctgggattacaggtgtgagccacggtgcccagcctctatattttctttttctattatatttatgatgattgttagggaggtagacattagctaatttgtttcatcaagtcttcagaatatagttccaatgtatactcaataccagccctgtccagtagaaatataatgtgagttagaaatgtaacttaaaattttctagtaatcacgtttaaaaagtaaaaataaataggtgaaattaatttttaatataataataattttaatgctatagcccagcatattcatacatttttgttccagcatataatcagtatacaaaattgctgagatattttactttcttattttaaactaagtctttgaaacccatgtgtattttacaattaaagcacatcccaatttgaactagccacattttaagtgctcagtagccatatattgctaccatattagagagtgcagatctagactaaaaagtttagtagtaaaactcagtcaagataattggctttcattgaatctcaaaggactttatttgtaatcttccctgaactatcttttcctttaaatacaacaatgggatcctcagattaagaatgacagagttattaggaaatatcccaagacagggccacatagtttagaatcatgagcatacttattttacagcctgtacagaaatcttacagataatcagtgagataatcactgatgccacctggtatgcacctattagggggaatagtacagtttatggccgggtgccgtggctcacgcctgtaatcccagcactttgggaggccgaggctggtggatcatgaggtcaggagatcgagaccatcctggctaacactgtgaaaccccgtctctactaaaaatacaaaaaattagctgagtgtgctggcgggcacctgtagtcccagctactcgggaggctgaggcaggagaatggcgtgaacccgggaggcggagcttgcagtgagctgagattgcgccactgcactccagcctggccgacagagtgagactccatctcaaaaaaaaaaaaaaaatacagtttataaaataaagacattgagtgacccacagaattgaactttcttagtatgccatacagtgtcttccaagttctggcccctgtatacctttctaatggtgttttctccagccatacataactgcttatgcttgtttgaattcattgtgctttttcacacctctgtgctttgccctctggcgtgttcctttccctcagtatctgcctggaaatctctaactcatccttcagccccacctcaagtaacacttcagtgaagcttatcctgctattcctatattccatccctcaaatgggcatttatgcaatccttttacattgctgtagcgtcttccactcacagcacttattacattatattataatttttaaatttttatttatttttaattttttcccttcatcctactttgatctcatgactgattactactataatttttagaatgtaattacctttggtagtgcaatcctcatgatggcatagactgcttcactcatctttatattcctagcaagacaccaggcattcaagaaatgtttgttgaactaaattttacaaggagacacgtagacatcagccaaagcagaaagggtgcagtttccttggattctgttcagggctgagttgctaatagctttgatcttggccaagttagttaacttctccatgctttattttaatcaattataaaattagagtgtattactggaattttaaggtgatttagaactttaaaaagttggttcattgatgcatgtatgagactgtgtcttgttcatgtcatatctttggtgcttaacaaagtacttggttatcattaaagttttattgaatgattgaataaaataactcttgtctcttttctttctttctttctttctttctttctttctttctttctttctttctttctttctttttctttctttgttttccttccttccttccttccttccttccttccttccttccttccttccttccttccttttttctttctttctttccttagatggagtctgtctctgttgtccaggctggagtgcagtggcatgatctcggctcactgcaacctccgcctcctgtgttcaagcgattcttctgcctcagcctcccaagtagctgggactacaggtgcatgccactacgcccagctaatttttgtatttttagtagagacggggttttaccatattggccaggctgctttcgaactcctgacctcgtgatctgcctgcctcggcctcccaaagtgttgggattacaggcatgagccactgtgccaagccaactcttgtctgtttcattcatattgcccacaaggatagcaacactatcaccaagagttactctctgtatatatatataaaacatatatatatgttatatatatataatatataacatatattatatataacatatatataaaaatatatatgttatatataatatatatctatttttgagacggagtcttactctgttgcccaggctagagtgcagtgtcgtgatctcggctcactacaacctctgcttcttgggttcaagcgatcctcttgcctcagcctcctgagtagctgggactgcaggtgcacgccaccacatctggctatttttttttgtatttttagtagagatggggtttcaccacgttggccaggctggtcttgaactcctgacctcaagtatttgtcctaaggctctccctccctttggcccccaccacctgatgggccctggtgtgtgatgttcccctccctgtgtccatgtgttctcatgcttaactcctacttatgagtgagaacatgtggtgtttggttttctgttcctgtgttagtttgctgagaatgatggtttccagcttcatccatgtccctgcaaaggacatgaactcattctttttttatgactgcatagtattccatggtgtagatgtgctacattttctttatccattctatcattgatgggcgtttgggttggttccaagtcttcgctattgtaaatagtgctgcagtaaacatacatgtgcctgtggctttatagcagcatgatttataaccctttgggtgtataatcactaatgggattgctgggtcaaatggtatttctggttctagatccttgaggaattgccacattgtcttccacaatggttgaactaatttacactcccaccaacagtgtaaaagtgtacctatttctctgcatcctctccagcatctgttgtttcctgactttttaataatcgccattctagctggtgtgagatggtatctcattgtggttttcatttgcatttctctaatgaccagtgatgattaactttttttcatatgtttgctggccgcataaatgtcttcttttgagaagtgtctgtttatatcctttgcccactttttgatggggttgtttttttcttgtaaatttgtttaaggtccttgtagattctggatattagacctttgtcggatggatagattgcaaaaattttctcccaattctgtaggttgcctgttcactctgatggtagtttctttggctgtgcagaaactctttagtttaattagattcaatttgtcaattttggcttttcttgccattgctttggtgttttagtcatgaagtctttgcccatgcccatgtcctgagtggtattgtgtaggttttcttctagggcttttatggttttaggttttacatttaagtctttaatccatcttgagttaatttttgtataaggtgtagggaagggatccggtttctgttttctgcgtatggctagccagttttcctggcaccatttattaaatagggaatcctttccccattgcttgcttttgtcaagtttgttgaagatcagatggttgtagatgtgtggtgttatttctgaagcttctgttctgttccattggtctatatatctgttttggtaccagtaccatgctgttttggttattgtagcctattagtataatttgaggtaagacagcgtgatgcctccagctttgttctttttgcttaggattgtcttggctatacaggctcttttttggttccatatgaaatttaaagtagtttttctaattctgcaaagaaagtcaatgatagcttagtaggaatagcattgaatctataaattacttaggtcagtatgcccattttcatgatatttattcttcttatccatgagcatggaatttttttccatttgtttgtgtccccgcttatttccttgagcagtggtttgtagttctccttgaagagatccttcacattccttgtaagttgtattcctagatattttattctttttgtagcaattgtgaatgggatttcactcatgatttggttctctgcttgtctattattggtatataggaatgcttgtgatttttgcacattgattttatatgctgaagttgcttatcaccttaaggagtatttgggctgagatgatggggttgtctaaatatacaatcatgtcatctgcaaacagagataatttggcttcctctcttcctatttgaataccactaatttctttttcttgcctcattgacctggccagaacttccaacactatgttgaataggagtggtgagaaagggcatccttgtcttgtgccagttttcaaagggaatgcttccagcttttacccattcagtatgatattgactgtgggttgtcataaatagctcttattattttgagatatgttccatcaatacctagtttattgagagtttttagcatgaagggctgttgaattttattaaaggctttttctgcatctattgagataatcatgtgctttctgtcattggttctgtttatgtgatggattatgtttatcgatttgcgtatgttgaaccagccttgcatccccgggatgaagccgacttgatcgtggtggataagcctttttgatgtgctgctggatttggtttgccagtatttttttttttttttagacggagtctcgctctgtcgccaggctagagggcagtggcgcaatcttggctcactgcaacctcttcctcccgggttcaagtgattctcctgcctcagcctcccgagtagctgggactacaggcatgcgccaccacgcctagctgatttttgtattcttagtagagacggggcttcaccaggttggccaggatggtctcgatctcttgacctcatgatctgcttgccttggcctcccaaagtgctgggattacaggtgtgagccactgcgcctggcctggtttaccaatattttattaaggatttttgcatcagtgttcatcagtgatattggcctgaaattttcttttttcgtgtgtgtgtctctgccaggttttggtatcaggatgatgctggcctcataaaatgagttagggagtagtctctctttttctattgtttggaatagtttcggaaggaatggtaccagctcctctttgtacctctggtagaattcagctgtgaatctgtctggtcctgggatttttttggttgctaggctattaattactgcctcaatttcagaacttgttattggtctattcagggatttgacttcttcctgatttagtcttgggaggtgtatgtgtgcaggaattcatccatttcttctagattttctagtttatttgtgtagagatgtttattgtattctctgatggtaatttgtatttctgtgggaccagtggtgatagcctctttataattttttattatctatttgattcttctctcttttcttctttattagtctagctagtggtctatctattctgttaatcttttcaaaaaaccagctcctggactcaatgattttttgaagggttttttgtgtctctatctccttcagttctgctctgatcttagttatttcttgtcttctggtggcttttgaatttgtttgctcttgcttctctagttcttttaattgtgatgtttgggtgtcaatttcagatctatccagctttccgatgtgggcacttagtactataaatttcccacttaacactgctttagctgtgtcccagcacaacaaccctggtatgttgtctctttgctctcattggtttcaaacaacttcattatttctgccttaatttcgttattacccagtagtcattcaggagcaggttgttcaatttccatatagttgtgtggttttgagtgagtttcttaaccctgagttctaatttgattgcactgtgttctgagagactgtttgttatgatttcctttcttttgttatgatttccgttcttttgcatttgctgaggagtattttacttccaattatgtggtcaattttagaataagtgctatgtggtgccgagaagaatgtatattctgttgatttggggtggagtgttctgtagatgtctattagctccacttggtctagagttgagttcaagtcctgaatatccttgttaattttctgtctcgttgatctgtctaatattgacagtggggtgttgaagtctcccactattattgtgtgggagtctaagtctctttgtaggtctctaacaacttcctttatgaatctgggtgctcctgtattgggtgcatatatatttaggatagttagctcttcttgttgtattgatctttttaccattatgtaatgccctcatcttttttgatctttgttggtttaaagtgtgttttatcagagactaggattgcaacccctgctttttttttgctttccatttgcttggtaaataaccctccatccctttattttgagcttctgtgtgtctttgcacgtgagattgatctcctgaatacagcacagtgatgggtcttgactctttatccaatttgccagtatgtgtctttttttttttttgagactaagtcttgctttgtctcccaggctggagtgcagtgggtcgatctcatctcactgcaacctccgcctcccaggttcaagggattctattgcctcagcctcccaagtagctgggattacagacgtgtgccaccacgcccagcaattttttgtatttttagtagagacagggtttcactatgttggcccagctggtcttgaactcctgacctcttgatccacccgcctcagcctcccaaagtgctgggattacaggcgtgagccactgcgcctggctagtctgtgtcttttaattggggcatttagcccatttacatttaaggttaacattgttatgtgtgaatttgatcctgtcaacatgatgctatctggttattttgctcattagttaatgcagtttcttcatagtgttgttggtctttatattttggtgtgtttttgcagtggctggtaccagtttttcctttccatatttagtgcttccttcaggagctcttgtaaggcaggcccggtggtgacaaaatccctcagcatttgcttgtctggaaaggattttatttatttttatttatttatttatttttgcttatgaagcttattttggctggatatgaaattctgggttgaaaattattttctttaagaatgttgaatattggcccccactctcttctggcttgtagggtttctgtagagagatccactgttattctgatgggcttccctttgtgggtaacctgatctttctctctggctgcccttaacatgttttccttcgtttcaaccttggagaatctgacgattgtgtgtcttgatgttgctcttctcaaggactatcttagtagtgttttccatattttctgaatttgaatgttgggctgccttgctaggttggggaagttctcctgggtaatatcctgaagtgtgttttccaacttggttcctttctccccatcactttcaggtacaccaatcaatcgtaagttggatcttttcacatagtcccatatttcttggaggctttgttcattccttttcactcttttttctctaacctttttttcttgctttatttcattaatttgatcttcaatcactgataccctttcttctacttgatcggatcggctattgaagcttgtgcatgcatcacgtagttctcgtgccatgttttcagctccatcaggtcacttaaggtcttctctacacagtttattctagttagccattcatctaatctttttttcaaggtttttagcttccttgcgatgggtttgaacatcctcctttagcttggagaagtttgttattactgaccttttgaagtctacttctgtcagctcgtcaaagtcattctccatccagctttgttccattgttggtgaggagctgcgatcctttggaggaggagaggcactctggtttttagaattttcagcttgtctgctctggtttctccccatctttgtggttttatctacctttggtctttgatgttggtgacctacaaatggggttttggtgtagatgtcctttttgttgatgttgatgctattcctttctgtttgctagttttccttctaccagtcaggtccctcagctgcaggtctgttggagtttgctggaggtccactccagaccctgtttgcctgggtatcagtagcagaggctgcagaacagcaagtattgcagaacagcaaatattgctgccttatccttcccctggaagcttcatcccagaggggcacccgcctgtatgagatgtcagtcggcccctactgggaggcatctcccatttaggctacacgggggtcagggacccacttgaggaggcagtctgtccattctctgagctcaaacactgtgctgggagaaccactgctctcttcagagctgtcagacagggacgtttaagtgtgcagaagtttctgctgccttttgttcagctctgccctgcccccagaggtggagtctacagaggcagccagccttgctgagctgcggtgggctctgctgagttttagtttccccagctgctttgtttacctactcaagcctcagcaatggcagacccccctccccctgctaggctgctgccttgcagtttgatctcaaactgctgccctagcagtgatcaaggctttgttgtcgtgggacctgccaagccaggcatggaacacaatctcctggtgtgctgtttgctaagaccgttggaaaagcagagtagttgggcaggagtgtcccgtttttccaggtaccgtctgtcatggcttcccttggctaggaaagggaaatcccttgccctttttgggtgaccccttgccctttttggtgaggtgatgccctgccctgctttggctcaccctccgtgggctgcacacactgtccaaccagtcccaatgagatgaaccaggtacctcagttggaaatgcagaaatcacccgtcttctgtgtcgatcacgttgggagctgcagaccagagctgttcctatttgaccatcttggaatggaatcctgaattaacctctttatcagtatataatgacctttgtctctttttagtttttttcatgaaatctgttttttctgacataagtatcggtactcctgctcttttttggtttccattggcatggaatatctttccatccctttattttcagtctgtgtgtgtctttatatgtgaagtgtgtttcttgtaggcaagggatcaatgggttttgttttctcaatttagccactctatgtcttttgatttgagaggttaatccatttacattaaatgttattattgataagaacttactcatgccattttgttatttattttctggttgttttgtggtcttctcttccttctttccttcctgtcttccttcagtgaaggtgattttctctagtgatatgatttagtttcttgctttttattttttgtgtgttcattgtatatttttaggtttgtagttaccacgagtcttgcaaatactatcttataacccattattttaacttgataacaacttagcactctgcataaacaaacagggaaaaagaaaactaataaaaaccttatgccttaacttcatcctcctgctttttaacttttttgttgtttttatttatatcttattgtactatttctggaaaagttgtagttgttatttttcattggttcattgtttattcattctacttagagtagtttacacaccacagttacagtgttataataattgtgttataacagtgttactttttttttgtacttactattaccagtgaggtttgtacctcaagataatttttttttttgagatggagtctcactcttgtctcccaggctggagtgcaatggtgcagactcggctcactgcaaccaccgcctcctgggttcaagcgattctcctgcctcaccctcccaaatagctgggattacagatgtctgccaccactcctggctaatttttgttctttttagtagagatggggtttcaccatgttggccaggctcgtctcaaactcctgagctcaggtgatccacccacctcggcctcccaaagtgctgggattacagggatgagccactgtgcctggcccagatgattttttattgctcattattattataagagaggatcaaaatcctctctttagcatttcttgtaaggcaggtctggtgttgatgaaatccctcagcttttgtttgtctgggaaagtctttctccttcacatttgaaggatattttcactggatatactattctagggtaaaagtttttttcccacagcactttaaatatgtcatgccagtctctcctggcctataaggtttccactgaaaagtctgctgccagacatattggagctccatttcatgtgatttgtttcttttctcttgctgcttttaggatcttttctttatccttgagctttgggggtttgattattgttacatgccttaaggtggttttcttgggttaaatctacttggtgttctataacctttttgtacttggatattgatatctttctctaagtttgggaagttctctgttatccctttgaataaactttctatccctatgtctttctcttcctcatctttaaggccaataactattagctttgctcttttgtggctattttctagatcctgcaggtgtgcttcattgttttttattcttttttcttttgtctcctctgactatgtattttcaaacagcctgtcttcaagctcactaaatctttcttttgcttgatcaattttgctattaaaggactctgatgctttcttcagtatgctagttgcatttttagttcagaatttctgtttgattaatttaaagtatttcaatctctttgctaaatttagctgatagaattctaaattccttctctgtgttatattgaatttctttgagtttcctcaacacagctattttgaattatctctctgaaaggtcacatgtctcttgtttctccaggttggtccctagtgccttatttagttcatttggtgaggtcatgttttcctggatggtgttgatgctagtagatgttctttggtgtctgggcattgaagagttaggtctttattgcaatctttactgtctgggcttatttgtacctgtccttctttggaaggctttccagatatatgaaaagactttggtgttgtgatctaagctgtatctgctttagggggcaccccaagtacagtaatgctttgtttcttgcagactcgtagagataccaccttggtggccttccataagatccagaagcattctctagattacccagcagaggcttttctcttactttctcccagagtctccctctctgttctggaagcctggatctgggggaggggtgacagaagcatccccatggccaccactgccaagactgtactgggtcaaacctgaagccagcacagtactgggtctcccccaaggcctgctgtaaccacctttgtaaccaaggcccgctgctaccacctttgttcactcaaggccctagagctctacaaccagcaggtggtgaagccagccagccttttgtctttctcttaagggtatggagttctcccaggccctgggtgggtccagagatgctgtctgggagccgggacctggagatggaaaccttagacatctacctggtgcactaatctactgtggttgagctggtgttgaaacccccagacaaagtccttcccactcttccctcctttttccccaggcaaaggagtctatccctatgcccaccactacaggcccatggggagtaatgccaggctactgccgatgtttacttaaggcccaagggctcttcagtcagcttctggtgaatcttccaggcctgggactcatcattcaggatagtgggctcttctctgacccaggttaggtccagagacggtgtccaagagccaaggactggaatcctggaccccaagagcctgcttggtgtttttccctactgtggccaaggtggcacctaagctcaagacttactcctccatctgcttttcttaagcagaaggggtctctccctgtagccaccacagctgtgaatgcactgccttgaagggaaggatacagacctggtaggattcatcacctgctaactaaagagcccttgggccctgaataaccatcaatgataaccagggagtacatacccactgtgggccttgctgctgtgggccttgggcgagactctgagatgtgttggcttcaggtgtgaaccagcgcattcacagctatcctttagtctctaaagtttagtgttttgaatgtgactagataggtttcctcaccagaatcaagttggaaattcctttgtgattagcatgatattgtcagctcttgcctccctccacccccagccaattgccttccaaaacttaacattgctttatcttccgatgagcccagtttgtaggtttaggtttgctctattctctgagcctgttctattcaaaggaagaaagaatagtaccattgtagagtagggaagctgttggtttggattaagttatactggccatcagatttgagctttaacatactaggggcatattctatgcacctgtttagctttggagttgtatcatttctttttttattgtggtaagaacgtttaatatgagatttgctgtcagcaaaactttaagtatacattattgactgtaagtatagtattgtatagcagatctgtattgcttattcatcttgcttgactgaaacattatgcccgttgcttagtaactccctattacccctttcccccagcccttggaaaccaccattctactctttggttctatgaatttgactattttaggtatttcatgtaagtggaaccatgcagtatttgtcttgtgactagcttatttcacttagtataatgtcctcaaggttcatccatattgtcacatattatggaatttccttctttttgaagactaaatggcattttattgtatgtatataccacattttctttatccattcatttgctggtggacatttgcatcatttccacatcttggctattgtgaatagtgctacagtgaacatgggagtgctaatatctcttcaagaccctgatttcaattcatgtggataaatacccagaagtgtaattgctgtatcatatgcgagttgtatttttaattttttgaagaaccttcatactgtgttccatagcagctgcaccattttaccatcctaccaacagtgtacaagagttccaatttctctacatcctcaccaatacttcttattttttctttctttctttctttctttctttttcttttttttttttttttgtggcagtgtctcactcttacccaggatggagtgtagtggctcgatcttggctcactgcaacctctgtcttacaggtttgagcaattctcctgcttcagcctcccaagtacctggcactacaggtggtgccaccgtgcccagctaatttttgtatttttggtagagacggggtttcaccatgttgctcaggctggtctcgaactcctgacctcaagtgatccacctgcctcggcctcccaatgtgctgggattacaggcataagccactgcgcctggccttattttctattttttgatagtggttatcttaatggatgtgaggtgatatatcattgtaattttaaattttagtttgcatttccctgatgattagtgatgttgagattttttccatatacctgttggccatttgtatatcttcttggagaaatttttggtactttaaaatattttctatctctgttgaaattctcactttgttcatgcattgctctcttgacctcagtgagcatcttcatgagagttgttttaattctctgtcaggtaaattatataactctatttattagggttggtttatggagattatcttgttcctttgtttggaacatctttgcctggtttttcattttccttgacccactgttggtgcctgtgttaaggcacctctctcattcttcatgggcttgtcttgtacaggagaagggcccccccaattaggcttggcagagattctgggggcctctaccacctctttctctccccagagagaagctggaagctatagtttttgtctgcttgttctgggctgagccagagtggagagctatggcatgtaccagctcaagccactgtctcccattctcccctgagcagctagagtttgccggacccatctgagcctcaaaactagagagatatatgcaagttcttttggcagccctggagaagttggggcactagaggcacagatcaactcttttccctccccaccaggaagcagagagctggagcttttcatctgtggaggtgtatcatttctgcttgtcatgattttcatgaggttagcctgccctgcatccatccctagttaactctccaggatcaggacactgctcagaactacaatacactgctgtgaatagatctgttggaactatggtacatacagttccatctgacttctgctttatgacttgctgcttggattctcttgtaccatatccaatttgtcatttgggacttcctggaacattatataggaaaaattattatctttgtgaccgtggatagaaattacgatttacaatgtaattttagtctatgactaaacctgtttgcctgattttgccagacccttttgacactgttttggatattttggctgtcctcattcaaaccaacctctgcagtttgaatagttttctttagcccacaatcagagctatagtgtagtgctctgaatgcttttggctcatttctttcctttctgctgtttttcagttgtctgagtgtcctagcttatcacttgttccagatccttcctgatagaaccagtatagtggaaagtacaggatttcaaatcagaaagcctgaattcaagtcctagcttactactttctattttatcaccatcaagaagtcactttatccagcaaaaaggcctgatttttaaaaagtcacttcattttgttaaaacttagtttccacatcttatgaaataaaaatatcttccttacagaatagattgaagattaaatgagaatgcatatgaaaaagcttcgagactggaaagcaatatgcaaatgttaattttattgtcatttctggttcttttctcactaaagaagttgcatataattattgtgacttggagtaaaatcttgaattgattttggcaggtctttgagctgctttggcttttgaatgactggttgagctgatggaggtcacagggaaagacttggcaggacagttgatagatttttgcatgttgtaacagaagctcccttcctcaaggacagggaaaatgtttattttctattatacggtacctagaatgttatctacttaatcagaattaattgatacagattaacgtggctgcctcaatcgagtgaacccccagttttaactagaatgcatctcatttaaattaaatggactaaaatctgttgtaaatcatagtttctttttgtagccaggaagataatttaataatttttttcaaaacgtacaatcttgcttgacaaaaccttaatacagtttgctgtcttctcatctcaggagtagactgcattttgtatttgagacagtctctgccgcttaggctggagtgcaatggcgtgatcacaactcactgtagtttcaacctcctaggctcaagcgatcctcccacctcaaccacccgagtagctgggaccacaggtgtgggctaccatgcctggctaattttatttatttatttgtaaagatggggtctgtctatattgcccagggtagtctcgaactcctgggctcaagcaatccccttgccttggcctcccaaattgctggaattacaagcgcgagacactttgcccagctgtagactgcatttatagaagttcttttcatcggatgcagtggcacacacctgtaatgccagctacttggatgggaggatcacttaagcccaagagtttcaggccaggctgggcaacatagcaagaccctgtctcaaaacaaaaacaaaaacaaaaacaaaaaatagaatttattttctgagcttctcccagatgcaaatctcttctttatagtgtaactctcaacctttcagctatgtgatctctatcacttacccagctttgctgactgcattttatccttaaaggactgcaatgctgtcattgcctcagctggtgtcggtgaaattgctcagctgaataacactgaaaatatgttttgaaaggaccagaattatttagacaaaaatgagttaataaaacattaaccacttaagagaacattcacaaatcaaaatatatgtcttcatagtctcataaactatgtaaccagaaactattattggtattctacaataacatcttaggatttttttttttttgagagacaaggtcttgctctgtcacccagctggagtgccgtggcatgatcatagcttaactgcagcttccacctcctgggctggagtgatcctctcacctcagccaccgagtagctggaactacaggtgtgagccaccacacccagataatttttaagttttttatggagatgaagtctcactgtgttccccaggctggtctcaaactcctgagctcaagcaatctacctgcctcagcctcccaaactgttaggattacaggcatgagccaccacggctggccaggatgttttttttaaaacgtatattggtggcatgtgcttgtagtcccagctactcagcaggctgaggcaggagaattgcttgaacctgggaggcggagattgcagtgagccaagatcccccactgtacttcagcctaggtgacagagtaagactctgtcttaaaaacaaaacaaaacaaacaaacgaaagtttatattggggttttgttttcttctcaaaaatatttttaaaaatctgttctttaaacaatatttgtatttttaaaaacatcaattttaaaatctccctgattctgttaccaatattttgagtaagggctatataaatatatgcccctcagcccaatacttacctaatcttagaggagtcaagatatttaacatcagtctttccattaaacaacttatgggaaaaagaaagatagagggtttcttttttcttttttctttttctttttttttttttttttgagatggagtcttgttctgttgcccaggctggagtgcagtggccgatctcagctcactgcaacctctgcctcctgggttcaagagattctcctgtctcaccttctggagtagctgggactgcaggtatgtgccaccgtgcctggctaatttttgtatttttcttttcatatatagtttttcacctaaagtatttaaaatgtgtgaattttaaatactttttaatttgctttgtgacgtctttattggaatctatagtcttatgtttagctagaattttaatttttaatttttatttttatacgtacatagtaggtgtatatatttataggatacatgagatattttgatacagacatagaatgtgtaataatcacatcagggtaaataggatatccatcacctcaagcatttgtttaactgaaatttttgtagctgatttattttttactgtagcaaggtaaaagttctgtttattttagcagcttaaaaatcttttagaaggtgcttttatagtactgttatgaatattaacatttttgctaatttgaggctcaagaatgttgcaagaaattagaaatatgtagcttatggacatttctgtcacgagtttgaaaaaaacctcaattttgataatatgaagggcatcaattgtgattctacatcatgcttattgtttagttttagttttttttttttttttgagacacagtcttgctctgttgcccaggctggaattcagtggcatgatctgagctaagtacaacctcaacctcccaggctcaagcaattcttatgcctcagccaccccagtagctgggattacaggcgggcacaccacgcctagctaatttttgtatttttaatagggatggggttttgccatgctgagcaagctggtcttgaattcctggcctgaagtgatctgcctgcctccgcctcccaatgtgctgggattacaagcatgagccactgggcccggtctagttttagttttagtttttttttttttttttttttttttggatgatgtcttgctatgttgcccagcctgtttcaaactcctgggctcaagggatcctcctgccacagcctcctgagtagttggtactacaggcgtggagcatcctgcccagctaatgcttgggtttgaaggaattccatggcctggtaagattcagctatttggagtctggagctcagaccatttagaaaatggtgacatcatttgtgcagattcaatatctggttaatgttgctaattgagcatgtcatttttttcttgcaaagtaagttcaagacttcagagccagcagttagctatgtctgtctaatgcttgaaaatattagtaagtttttcagttttacagggcacatattcagaacttctttcagaatttctacattttctggttttgaagacactgttaagttcagttttgcagggtttttgtttgtttgttttagagaaagggtctcactctgtagcccatgctgcatggagtacagtggcaggatcgtagctcactgtagccttgaactcctggactcaagtgatcctcctacctcagcctttggactagctagggctaaagacgtgtgccaccatgcttggcctgttttgtacttttaatattacctaataacattactatttgtgaagtcaatgcattttactttctgagaatgagtaatgattaagttataaacaagtgactcccaaagaatgcaaattttatttgaaaattatactctagcttaaagaaactttaaatctccagtttggttttactctaaggatcaagttccttcatgctgtattcatttggccaatgatttagacatagatttaaaaatgatttgctacatttagccaatggtaatagttcacagcacatttatcatccattgtcatttcagaagttgttgaaaacctggttacaaatgataattcacctaacataccagaggcaattgatagactcttcagcgacatagcaaatatcaacagggagtctatggctgaaataacagacattcaggttagtataaaaataattctgtttatgataagtttcgatgattcttcattttaaccaatgtattatataggtaaaaaagtagtcttcatgcttaaccattgctaaacatataaaaatctatttttggatgttcacacctaatttagggggaaaaattttagaaaccaatgggaacatatgtgctcgtttaatatttattatttatttatttattagcaatgttatttattattaatatttattaacctccccaggcttcagttttctcacctgttaaatgataatagtaatacccacctccaagtgttgttatgaatagtaaacaaaataacatatataaggtcctgggcacatactagttctcttttccttccctttgcaacaaagtagtggagccacccagtagtggagaactcagttgactataagccttcagaagtgctttttttgggggtaattttctaatgtttaaatgaaggtctgttacttacttaatatggaagctgtcttgaggcttgaaacacttttgagaatatttaccttgggcaaatacttccattttggtgactacttgtatggaaaggtgagaggaaagtttactgtaaatctctcttcctctttatatatataagtatctatatatgtatatatgtgtttatgtatatataaatacctttatttagatataatttacataccatgcaattcacccatttcaagtatacaattcaatagtttttagtatttcacagagttgttgtgcacctatcaccacagttagttaattttagaatattttcatcacctcaaaaagaaaccgcacacccgttcacaaacactctccatttcctcccatcctcttccctccctcaccctcagccctaggcaaccactaatctacttttggtctctatggttttgcctaatgaggacattttatataaatagaatcatacaatgtgtggtttactgactgttttcacttagcaagatgttttcaaagttcatccatattgttgcatgtatttgtacttcatacatttttatgactgaataatatcccattgtatggatataccatattttgtttgtccattcatctattcatgaacgttttcattgcttccaccttttggctattatgaataatgctgctataaatactcatgtacagatttttatgttttcatttttcttaggtttgtacctaagaatgaaattgcttccaccttttggctattatgaataatgctgctataaatactcatgtacagatttttatgttttcatttttcttaggtttgtacctaagaatgaaattgctgggccatgtgttaactctaaacttttttttttttttactttttttaaattttaagttctagggtacatgtgcacaacgggcaggtttgttacatatgtatacatgtgccatgttggtttgctgctgccagattgttttccaaagtggccgcaccattttacattcccactagcaatataagagggatccagttggctgggcacggtgactcacgcctgtaatcccagcactttgggacgccgaggcgggcagatcacaaggtcaggagatcgagaccatcctggctaacacagtgaaaccctgtctctactaaaaatacaaaaattagccgggcgtggtggcaggcgcctgtagtcccagctacttgggaggctgaggcaggagaatggcgtgaacccagaaggcggagcttgcagtgagccgagattgcaccactgcactccagcctgggtgacagagcgagactccgtctcaaaaaaaaaaaaaaaaaaaaaagagggatagagggatccagtttttccacctccttgctgacatttgtcattatttgtctttttgattatagtcattctagtgggtatgaagtgttatctcattgtgttttttattgcggtaaaatacacataacacaaaatttaccatcttaactatctttaggtgtatagttcccttgtgttaagtatgttcacattgtgcagctattatctagaacccttttcgtcttgcaaaactgaaactctatatccattaaacaactcccccttgccctctaaaattcttacgaattttgggatcagcttgtcaaccaccattctactttctctctctataaatttgactactctcagtacctcatgtaagtggaatcatgtaataattgtctttttgtggctggtttatttctcttagtataatgtcttcaaggttcattcatgttgcagcatgtgtcagaatttccttcctttttaagactgaataatccattgtatgtgtgtaccacattttgtttatccattcatttgttgatggacacttgggttgcatctaccttttgcctattgtgaataatgttgctatgagcattggtatggaaatttctgttcaagtccctgcatttaattcttttggatatatacccagaattggaattgctgtatcatatggcaattctgtttttaattttttgaggaaccaccatactgttttccatagcaactataccattttacatttctattagtagtgaacaagggtaccagtttcttcacattatcaccaatacttgttgttctgtttttttattgatagtagtcatcctagtgactgtgaggtggtatctcagtttttgtttttgtttttgttttttttttttaagacaatcacactctgttgcccaggctggagtgcagtgtcaggatctcagttcactgcaacctctgcctcctggtttgaagcagttctcgtgcctcagccacccaagtagctgggattacaggcaggcgccaccacacctggctaatttttgtgtttttagtagagatgtgtttttgccatgttggccaggctggtttcgaactcctggcctcaagagatccacccacctcggcctcccaaagtgctgggattacaggtgtgagccactgtgcccggtggtaaatctctttttagatcataacctcttactgtacttagctgttagtgaaaacaaattataagattccaagagtttgggtttgtttgtttgtttgtttgttttttgagacagtgtcttggtttggagtgcagttgcatgatctcagctcactgcatcctcgacctcctaggctcaagtgatccccctcagccctccgagtagctgggactgcaggcatgtgccaccatacccagctaattttttgtatttttcatagagatggggtttctccatgttgcacaggctagtcttgaaatcctgagctcaagcaatctgccctctttggcctcccagtgttagaattacaggcatgagccataagagtttggtcttatttttgaagaagatctgcttggttttggaaatgccttgaatttattttctttctggaaagtctaatcttcatattatttacttctgtttgcagcatgtatttaccatgcttatcattatacatttatgtaaacctaagacaaaacctgccacatcttaggtgcttaatatatatgtgttgaataaatatgttttctgattatgaagtatttacagtcatagtttatcttatcctttctaacacaatatgagaaaatacaagaatttatttaaaatcataaagtaacataacttcacagaaagtttaaaaaaatggatacaaaatcacatgcaaacacaccacttcaatataactactattattttaatgtattttctttaatagttttacagtttaaatgttatttagctataattatactgtacatgtaatatttctggcatcataaaaggcaatttgctctgttttcccaacattttaaaataaacattttcaaacagaaaagttgaaagaatattacactggacacctatgtaacagccacttacattctacagttgtaaacattttaccatattcgcttcatcacatatacatttgtccattagcgcatcttattttttgggtgcattttaaaatgagttgctgacaacagtacacttcccccctaaatgttttagtgtgcatatcattaactagaatccaatattttattgaagttcttctttggggtaagatttgcatatgtacaactttctgtacatacagttttgtatctttccttctttcctttttcactagacatgtaataaatattttcccgtgttaaaaacatagttttcatgaccactattttattttatttttgtttttatttttatttttttgaggcagagtctcgctctgtcgcccaggctggagtgcagtggcacgatctcggctcactgcaacctccacctctcaggtttaagtgattcttctgcctcagcctcccgagtagctgagactacaggtgtgcaccaccacacctggctatttttttttttttttttgtatttttagtagagacggggtttcaccaagttggccaggctggtctcgaactcttgacctcaagtgatccacctgcctcggcctcccagagtgctgggattacaggcgtgagccaccatgtctggccatgaccactattttaaatggatgaatactattccatcaaggaaggttatcataattcacctatttctttattattggatatttatattgtttctcatattgttcctcatttttcactattataaataatgatatgaagaacactattaagtgcaaagattatccccccacacattttcatctatttcttaggataaagtctcaaaagtgcaactattgggacaaaagatatgaactttatttgtttatttatttatttactcatttatttatttttattgagacagagtctcgctctgtctcgcccaggctggagtacagtggcatgatcttggctcactgcaacctccgcctcctggggtcaagtgattctcatgcctcagcctcccgagtagctgggattacaggcacctgccaccacgcacgactaatttttgtatattttagtagagacagggtttgaccatgttggccaggctggtctcgaacacctgacctcaggcaatccgaccgcctcggcctcccaaagtgctgggattacaggtgtgagccaccgcacccaggcgaacatttttatatgttgccaaattgctttccaaaatgccaaacaagtagcttctttaagctatttagtctggatgctcatttcccatcataatatgtcaaatcatttgttcttctgggtaatttggagtgcagttattaactccatgtgtttttagtgatacaaatgaaataatacttagtatgaaagtcagccgggtgtggtggctcatgcctgtaatcccagcactttgggaggttgaggcgggcggatcacctgaggtcaggagttcgagaccagtctggcctacatggtgaaaccccatctcaagtaaaaatacaaaaattagccaggcattatggtgggtgcctgtaatcccagctacttgggaggctgaggtgggagaatcacttgaacccgggaggtggtggttgcagtgagccgagatcacgccattgcactccagcttgggcaacaaaatgagactctgtctccaaaaaaaaaaaaaaaaaaaaaaaggaagtcatcatttgatcaactgtggcattgaggatactatgtgatggagatggacatgataattagccccagaataataagtgaaatgacaaccatgctgcattaggctgtttgcattgctataaaggaaatacctgaggctgggtaattgataaggaaaagaagtttatttggctcatggttctgcagatcatataagaagcatggcactggcatctgcttccagtgagggcctctggaagtttccaatcatgttggaaggggaaagggagcaggcatcacatgatgagagaggaggaaagagaaaggaggaggtaccaggctcttttttaagaatcagatcttgcagtaactaatagactgagaactcactcattactgtgaggacagcaccaagacaatgagggatccatccccgtgacccaagtacctcccatcagccccacatccaacattggggatcaaattttgatatgagattctcaggggaaaaatatccaaactatatcacatgttaaataaatcatctgtttaaactgaagctcatcagaaaaatgtgaaatggtaagtgagaaaagtggcatggaagaaaagacttaaaactaacatacattttgtaccactgctgtgcataaattgggttaaagaaaagaaataaaacaaagaataaatgatacaaagtaatataattaattgccaaattgtatacaacttaatgaatatatgaattcaaagaagaaagaacaacgtagactgtaatggttgctgaaagcttcatttatgttgttggtgagactgaaatggatttgagttacataaaaacaaagggaggaggtatatcaggtgaaggtatatcaatagtatgaataaagacacattgataggaatgaacaagttgtgttcaggaaatagataattactctaacagtgggtaagtttttgcggggagaggtagaatgcgactagattatggagggcctggaaatgacccacaatagttacataagcatacaacattcaagaatgaaaataccgttggaggtggccagtattttaactaactaaggaaatgtttctctttgaccagattgaagaaatggcagtaaacctatggaactgggcacttaccataggaggaggttggcttgtaaatgaagagcagaaaattagatgtatgtatacatattgtgacatgtattatgaggcgtgttcttactatatattgggtagtattcctgcagtttaaataatgttttgacccattcttagatagagatttgttaaaagacaaacaaaacaacccaggaacaatggtttctcaagcaaatggcctccctcagttttatgatttttttttcagaggttagctccttattaacaaacgtttaaagatatcactgcaagaaatagtcaggaggtgaacaacaaagatgattaaaaggtgggacagtgagaacttaaagaaatgttaaaggacatggattatttctcatggagatgatcaaaatcttcagggttctgaaggaccatcaaatagtagtttcccctctattaataatagaataagtgttgccatatgacatattcagattttaaaaagtgtaaagaatagtttcctcaggagatggattgataaacattggaatgagttactgagaaactatagaaatgatttctacctgtgagagcaaacaacaagaacaaaaaaaccaaaaatctcaaactaaactcatcttcttggatgctttgaatgtggtccactgtctggcaatgttctagtgctttagctaaatgggcaaagtctagtgtgctgacagttagtgattttcaacaggcatagtgacagcaaatgcatttatgggaagtatattgccaattataaaggatacattgaagtaacataccaaagggtgaacctctggactgcttgacattgtaaagacaaatgacttttgtctgtatgcaacaaatataatttactactaactatttatctttgtgaatatgaacaaaactgtatacaacttccgtgtagatatagggtaattgtgcttaatataatcaagaatatacttgctcatgagtccactctattagcatgtttagagaacagttctagctctttaactcttagataaattgatatcattgctcccaggagcctcagatcctgtagttatggggaggtaagagctaggaatttatcagtggaagaaacttagtacacaggtgaaccgtgtgatattaaagtgcgttaattcttaactcctaccattctgcatatgaggaagtattgctttagctgtttactgcttatcagatagggatatggtagatgaagtgggtgtcacagcctcttcccatgtactgtctcatttctttttttctttttcttttttttttttaagggacggcaaggggtgagggcagaaccacacagtgttgatggggttagggccagggagatgagagagctagggaagagaaaagagactgttaaaaaaaagggggggtgctgtaagaggaaaaatactaaatgggtggggaaagtggagaaaaaagggggaagcaagaagaggagaaaggcaagaggggagagaagaagagggaaaagcaagagataagagaagaaaagggaaggataagagaggggacaagagacagtaaagaagagagtcccatgtactgtctcatttcacgtagcagttcttaatcagatatttgggtgcttgttatgtgtatcatactttttttgatacagtggagaatagattatcagcgcaggaggcctccaaattaaaataattttgtttcaaaaatatgtttattggaatatattttgtttccttaaaaacaaatttagtgtgcctggatgtgatgaaataagtcatgaagatttataagctataattctttattatttggaggaattatggaacaatgaacaggaaagtcagaagtagatgaatgacttgtaagttttagttttagacctgttgcatttgagatgacaataaggttggagatgtgagactagagcttatgagaaaggtcaggactgagcctacagatttggcaatgatttacacagaggtggtagttgaagacagaagagtagttgagttctttgaggaaaaaaataaagagcagtggttcttaaatattggtataaatcagaatcaggctggtagcggtggctcacgcctataatcccagcactttgggaggcctaggtgagtggatcacctgagatcaggagttcaagaccagcctggccaacgtagtgaaaccccgtctctattaaaaatacaaaaattagtcgggcatggtggtgtgtgcttgtaatcccagctacttgggaggctgaagcaggagaatcgcttgaaccctggaggtggaggttgcagtgagctgagatcgcaccattgcactccatcctgggcgacaagagtgaaactccgtccctccccctccccccaaaaaatcagaatcacctgtgaagcctgtgaaaaatacagatgcccaggcccttccattggtggttttgattcatttaggttcaggatgaaacctgggcatgtctataatttgaaaaaatgtctcaggaattctcatgcacaccaaaatttaagaatcagtggtattgagagaagaacaaagtagtgagattttaactctgaatctaccagcttcaaagttaaaataaaaagaatagggatagatgaccaaaaggaacagtcaaaaaattctacaggagattggccaggcacagtggctcacgcctgtaatcccagcactttgggaggctgaagcaggtggatcacgaggtcaggagattgagaccatcctgactaacacagtgaaactccgtctctactaaaaatatgaaaaattagccatgcgtggtggtgggctcctgtggtcccagctgctcaggaggccgaggcaggagaatggcgtgaacccaggaggcagagcttgcagcgagccgagattgcgccactgcactccagcctgggcaacagagcaagactccctctcataaaaacaaaaaaaaattctacaggatatttattagtcatttattgagtgcattctccgtatagggttctcgtaccatgttatggtacatagtaaatgaaagggaaaaggtaagataccagaacaaagataccaatcttaaattatgcttgaggatttcggaaggaatagtttaaagctagataaacaataatttaaaaatttataaatgtcagagggtataaccccgtgtttatctaaagtcaattcaatttcaggctgtgggtagagcagagtaaagcggatgttcaaaggtatcagtcaccaattatgtaaccaagatgtttataatatagagaggtcaagaacaggctggtgagaagacaagatggagcaacagcaacaaagaaaacatctttatatggaagtagcattctgtttcagcctcagctgcctttggcttgaagacttattggtgataactataaacagctggattatgaatgtcaggattggagcagacaaagttcttagactaagatatttcccacacaaggaccaggatatttcaggccaagagggtaatttttttttttttgagacaggatctggctctgtcacccaggttggagtgcagtggtgcaatattgactcactgcaacccctgcctcctgggctcaggtcaacctcctacctcagcttcccgagtagctgggactacaaggcatgtggcatcacaccttactaatttttgtattttttgtagatacaggttttgccatgttgcttaggctggtctgaaactccaagggagtaatatttttcaaaaaggttatggccattttgaaatgttgctatgaagttaaggaaggtgatctttgggagtgcagttttagtaaagtggtaaggatgcaaaacagattgtggacatttaaggagatgagtgggtagcaagacagtagagctagtagacagacttttcaattcaagaagcttgtcaatcaaaggaagaggagaaatgggatgcaagcttgaagcatagtggggttagttgattttttttttcaaggtaaggagatgggtacgtttgaaggtagagaagaaggaataagttgagagggaggtactcaagatacttttagaaaggggcaataattgagagatcagagtctttgaaaatactgaaggattagcaaactttggaactttggaataaagaaaggaaacattttctttttcttttctttattttattttgttttattttattttattttattttattttattttattttattttattttattttattttattttattttattttattttactttaagttctgggatatgtgtgcagaacacgcaggcttgttacataggtatacatgtgccatggtgatttgctgcacctatcaacctgtcatctaggttttaagccccgcatgcattaggtatgcgtcctaatgctctccctccctttgcccccacccgctgacaggcccgggtatgtgatgttcccctcccttgtccatgtgttctcattgttcaactcccacttatgagtgagaacatttagtgtttggttttctgttcctgtgttagtttgctgacagtgatggtttccagtttcatccatgtccccgcaaaggacatgcactcattcttttgtatgtctgcatagtattccatggtgtatatgtgccacattttctttatccagtctatcattgatgagcatttgggttggttccaagtctttgctattgtaaatagtgctgcaataaacatgcgtgtgcctgtgtctttatagaagaatgatttataatcctttgggtgtatactcagtaatgggattgctgggtcaaaatggtatttctggttctagaaaccagaggaatcgccacattgtcttctacaatggttgaactaatttacactcccaccaacagtgtaaaagcgttcctatttctccgcatcctcaccagcatctcttgtttctgactttttaatgatcagcattctaactggagtgagatggtacctcattgtggttttcatttgcatttctctaatgaccagtgatgatgagcttttttaatatgtttttttggcctcaaaaatgtcttcttttgagaagtggctgttcatatccttcgcctactttttgatggggttgtttgtttttttcttgtaaatttgtttaagttccttgtagattctggatattagacctttgtcagacggatagatggcaaaaattttctcccattctgtaggttgcctgttcaccctgacgatagtttcttttcctgtgcagaagctctttagtttaattagatcccatttttcaattttggcttttgctgcaattgcttttggtgttttagtcatgaagtctttgcccatgcccatgtcttgaatggtattgcctacattttcttctagggtttttatggttttaggtcttatgtttaagtctttaatccatgttgagttaatttttttataaggtgtaaggaaagaatccagtttctgttttctgcatatggctagccagttttcccaacacatttattaaatagggaatccttcccccattgctttttttttgtcaagtttgttgaagatcgaatggttgtagatgggtggtgttatttctgaagcctctgttctgttccattggtgtatatatatttgttttggtaccagtatcatgctgttttggttactgtagccttgtagtatagtttgaagtcaggtagtgtgatgcctccagttttgttctttttgcttaggattgtcttggctacacgggctcttttttggttccatatgaaatttaaagtagttttttctagttctgtgaagaaagtcagtggtagcttgatgggaatagcattgaatctataaattactttgggcagtatggccattttcatgatattaatctttcctatccatgagcatggaatttttttccatttgtttgtgtcctctcttatttccttgagcagtggtttgtagttctccttgaagagatccttcacattccttgtaagttgcattcctaggtattttattctctgtgtagcagttgtgaatgggagttcactcatgatttggctgtctgcttgtctattattggtgtatgggaatgcttgtgatttttacatattgattttgtatcctgagactttgctgaagttgcttatcagcttaaggagtttttgggctgggatgatggtattgtctaaatatacaattatgtcatctgcaaacacagacaatttgacttccactcttcctaattgaatacgctttatttctttctcttgcctgattgccctggccagaactttcaatactgtgttgaatgggagtagtgagagagggcatccttgtcttgtgccagttttccacaggaaagcttccagcttttgcccattcagtatgatattggctatgggtttgtcataaatagctcttattattttgagatatgagagtttttagcatgaaatggttttgaattttattgaaggccttttctgcatctattgagataatcatgtggtttttgtcattggttctgtttatgcgacggattacgtttactgatttgcctatgttgaaccagccttgcatcccagggatgaagctgacttgatcgtggtagataagctttttgatgtgctgctggattcgatttgccagtattttattgaggattttcgcattgatgttcatcagggatattggcctgaaattttcttttctgttgtgtctctgccaggttttggtatcaggatgatgctggcctcataaaatcagttagggaggagtccctttttttctattgattggaatagtttcagaaggaatggtaccagcccctctttgtacctctggtaggattcagctgtgaatctgtctggtcctgggatttttttttttttttggttggtaggctattaattactgtctcaatttcagaacttgttagtggtctattcagggattcgacatcttctggttttgtcttgggagagtgtatgcatccaggaatttatccatttcttctagattttctagtttatttgtgtataggtgtttatagtattctctgatggtagtctgtatttctgtgggatcagtggtgatagcccctttatcatttttactgtctaattgattcttctctcttttctactttattaatctggttagcggtgtatctatttgcttaatcttttcagaaaatcagctcctggattcattgatttttttgaagggttttttgtgtctctatctccttcagttctgctctgatcttagttatttcttgtcttctggtggcttttgaatttgtttgctcttgcttctctagttcttttaattgtgatgttcgggtgttgatttcagatctttccagctttccgatgtgggcatttagtgctgtaaatttcccacttaacactgctttagctgtgtcccagagattctggtatgttgtctctttgttctcattggtttcaaagaacttcactatttctgccttaatttcgttatttacccagtagtcattcaggaacaggttgttcaatttccatgtagttgtgcggttttgagtgagtttcttaatcctgagttctaatttgattgcactgtgttctgagagactgttttgatttccgttcttttgcatttgctgaggagtgttttacttccaattatgtggtcgattttagaataagtgctatatggtgctgagaagaatgtatattctgttgatttgaggtggagagttctgtagatgtctattaggtctgctttctccagagctgagttcaagtcctgaatatccttgttaattttctgtctcgttgatctgtctaatattgacagtggggtgttaaaatctcccgctattattgtgtgggagtttaagtctctttgtaggtctctaagaacttgctttatgaatctgggtgcccctgtattgggtgcatatatatttaggatagttagctcttcttgttgaattgatccctttaccattatgtaatgcccttctttgtctcttttgatctttgttggtttaaagtgtgttttatcagactaggattgcaacccctgctttttttgttttccatttgcttggtagatcttcctccatccgtttattttgagcctatgtgtgtctctgtgtgtgagatggttctcctgaatacagcacactgatgggtcttgactcgttatccaatttgccggtctgtgtcttttaattggagcatttagcccatttacatttaaggttaatattgttatgtgtgaatttcatcctgtcatcatgatgctagctggttattttgctcgttaattgatgcagtttcttcatagtgccattggtctttatattttggtatgtttttgccgcggctgttaccggttttttctttccatatttagtgcttccttcaggagctcttgtaaggcaggcctggtggtcacaaaatccaacagcatttgcttgtttggaaatctcttttgctcgtgaagcttattttggctggatatgaaattctgggttgaaaattcttttcttttcttttttttttttttttttgagatggcatctcgctctgtcacccaggctggagtgcagtggcatgatctcggctcactgcaacccctgcctcccgggtttgagtgattcttctgcctcagcctcccgagtagctgagactacaggtgtgtgccaccatgcccagctaatttttttttttgtatttttagtatagaaagggtttcactgtattcgccaggctggtctcgaactcctgaccttgtgatccgcccacctcggcctcccaaagtgctgggattacaggtgtgagccactgcaccccgctgaaaattcttttctttaaaaatgttgaatattggcccccactgtcttctggcttgtaggatttctgcagagagatccactgttattctgatgggcttccctttgtgggtaacctgacctttctctctggctgcccttaatatgttttctttcatttcaaccttggagaatctgatgattatgtgtcttggggttgctcttcttgaggagtatcttagtggtgttctccatatttcctgaagttgaatgttggcttgccttgccaggttggggaagttctcctggataatatcctgaattgtgtttttcagctgggttccattctccctgtcactttcaggtacaccaatcaatcatacgtttggtcttttcacatagtcccatatttcttggaggctttgtttgttccttttcactcttttttctctcatcttgtcttcacgccttatttcagtaagttggtcttcaacggtcttcaatctctgacatcctttcttcgcttgattgatttggctgttgatacgtgtgtatgcttcacgaagttctcctgctgtttttcagctcatcagttaatttatgctcctctctaaactggttattctagttagcagttcctgtaaccttttatcaaggttcttagcttccttgcattgggtagaacatgctcctttagctcagaggaatttgttatacccaccttctggagcctacttctgtcaatttgtcaaactcattctctgtgcagttttgtgcccttgctggagaggagttgcgatcattttgaggggaagaggcattctggtttttggaattttcagcatttttgcactggtttttcctcatcttcgtggatttatctacctttttgatctttgaggctgatgatctttggatggggtttttgtgtgggggtcctttttgttgatgttgatgttgttgctttccatttgttagtttttcttctaagagtcaggcccctcttctgcaggtctgctgcagtttgctggaggtccactccagaccctgttcacctggttatcactagtggaggctgcagaacagcaaagattgctgcctgctccttcctctggaaactttgtcccagcggggcaccagcctaatgccagctggagcttttctgtatgaggtttttctcgacccctgttgggaggtctctcccagtcaggaggcacgggggtcagggacccacttgaggaggcagagtctgtcccttgtcagagcttgagtgctgtgctgggaggatcctccttgttaggatcagctgctctcttcagagccggcaggcaggaaagtttaagttcactgaagctgtgcccacagacgccccttcccccaggtgctctctcccagggtgatgggagttgtatctataagcccatgactggggctgctacctttctttcagagatgccctgcccagtgaggaggaatctagagaggcagtctggccacagccgctttgtcgcactgtgttgagttctgcccagtccgaacttcccctcttctttttttttttttttgagttggagttgtgttcttattgcccaggctggaatgcaatggcatgatctcaactcactgcaacttccgcctcccaggttgaagagactttcctgcctcagtctctctagtagctgggattacaggtatgcaccaccactcccagctaattttttttttttttttgtatttttactagagatgtggttacaccatgttggtcaggctggtcttgaactcctgagctcaggtgatttacccacctcagcctcttaaagtgttggggttacaggtgtgagccaccatgcccagccaaaaagaaacattttcaaaaattttcagaactggaaattcaagtcagtataaatatatgattagtaattattttaccaaaagtgttttttagaatgaattaattttgttaagtgatgaataaattttacactttatgatgggcaataaaaatctgaccatttcaattaccctgtaatttccgctagacaaatctctttttcaaaggactattaattagaagtggtgttagcataggtagaatggctgctgacatctaacataaaggtgactagttcatttatttgtgaagctgttttttaaaacttgaatatgttttatgctgaaataaactagagaaataaagaggttataattattcaaacttccctattttcagggaaaatgagttatataatgaagtagtctgtatcttctaaattatactttaagaactgttatgacatctacagaaaagaatatgtttaggccaggtgtggtggctcacacctataatcccagcactttgggaggctgaggttgggaggattgcttgagcccaggaatttgaggctgcagtgagctatgatcatgccactgtattctagcttgggtgagtgacagagcgagaccccctctctacagaaaaaaatatatatatatttagaaagtttcacattttaggagagaaatcgaaaactattctgatgtccagagattttgtcagatgttgaacagctttagatcaattgaatttacaattatttttctgttaacatggtatacacaagagcatcatgtggaatcaggtatttttagtgagtctttgggacttaagaccttaagaaattaaaatttaagtattaaatatctctctgggccggttgtggtggctcacacctgtaatcccagcactttgggaagccgaggctggtggatcacctgaggtcaggagttcaagaccagcctggtcaacgtggtgagtccccgtctctactaaaaatacaaaaattagctgggcgtggtggcgcatgcctgtaatcccagctactcgggaggctgaggcaggggaatcactggaacctgggaggtggaggctgtagtgagccaagatcatgcgtcactgcactccatcctgggcgacagagtgagactccatctcaaaaataaataaataaataaataaataaataaatctcttactgaaacattcagtaaatgattcatttaataagttttaggtcatttacttttgaaaattgattttttaaaaagtcctttacaggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaggcctttacaatttttatttttaataacaacaaaactggcttccttcaattgtcttttctctttggtgtatataaaaggagaatgaatgttttgtgtttatcattgtctaattactgttttgcagtacattatgttgcttgcaagttgctgagtatgtgtgaagcctcatttgcctcagaacaaagtattcaacgactgattatggtaagtcttaatttaggagaaagtggagatgaaatgagatggttgttacttctatgaaaatggtaaagttagtgtgaaactggaagggggttgaatcttttagtgctatccttttttgatggtgttccttttcagtgttccttttataatggtatatttactacgctaaagttctcagaatactgtagtaattacggtggttcagtgaaccaaatactgaacttataattctgggttgatgatttattttttacttttctcatctctaacttgatagagtaactgtttcttcatctaagggaatggtaatacttagttctaaatgagtttttcaaatgaaaaatttgaagcactaagtaaataaggaaaagggtacaggatttgaagtctcaagacctaggttaggtctgccgcttactagctatgtgacattggaagattacttagttttctcttttgtaagatgaaaatagtaatatctaccttagagtgttatagagttaaaattagagtttttgtgaaaaatgctttgtaaactataaaatatatgtgtaaatacatagtggtagaatttgtccatgtaaaatgctatgacaacagtctgataaatcctgtatcatatataatatgataaaactgagttgaatgcagggttcaccttgtgtgttttccttctttcaaagattgtagccactccaatgccttcacacagttatattttgtccagcttttagggttgtttagagtgggacagtcagtttgaattgagctattccatcatggctgaaagtggaagtcttcctcttgcatttctgttatttaaaagattttttccttataatttttattttgagagggagtcaccctggctggaatgcagtggtgtgatctgggctcgctgcaacctccatctcctgggttcaagcaattctcctgcctcagcctcctgagtagctgggattacaggcatgcgccaccacacctagctaatttttgtatttttagtagagacagggtttcaccatgttggtcaggctggtcttgaactcctgatctcaggtgatctgctcaccttggcctcccaaagtgctgggattacaggcatgagccactgcgcctggcctaaaagattaattttttaaacatttatttccaccccccaaaatacaaatgtatgtttatgtaaaattaaattgttcagaaaagtaattaaagtaataaaaagtgattttctgctccatctatctgttctctctttttttttttttttttttttggacaggatctcactctgttgcccaggctggagtgcagtggtgtgttctcggctcactgcagcctccacctctcaggttcaagcagttctcctgcctcagcttcccgagtaactgggattacaggtgtttgccaccatgcccagctaattttttttttttttttaagtagagacagggtttcaccatgttggccaggctggtcttgaactcctgacctcaagtgatccacccgccccggcctcccaaagtgctgggattacaggagtgagccaccacacccagccctatctgttctcttgctccttagaggcaaatacatttttttagtggaaaaatatttttcccagtgttttaaaatattttattatgtaaaaaagctcaaacatatataaaaaaggtaagacagtacaatgattccctccatttacccatcactcagttagagtaatcatcaactcatggccactcttgtttcttctatatctcctcaaatagcaaactcctggccccactggattatttttattattttttatttttttgagatagagtctcgctctgtcactcaggctggagtgcagtggcacgatctcagctcactgtaacccctgcgtcctgggttcaagtgattctcctgcctcagcctcccgagtagctggaattacaggcgcccaccaccacacccagctaatttttgtatttttagtagagatggggtttcaccatgttggccaggctggtcacgaactcctgagctcaggtgatccgcccaccttggcttcccaaagttctgggattacaggcatgagccaccgcgcctggccaacccactggattattttcaagcaaattcaacatgtataattttgcccataaatatttcagtgtgtgtttctaaaagacaatgtattttttttcagcttgtaaatgcttaatttttttaaacatagaggatgcttggtggtgtatatgtggccatttgatgtttttatgactaagagagttcaatctcttatagaatgtaaatgtacccctacacatttatttatttatttattttctattttttccataaattattggggtacaggtagtatttggttatgtaagttcttcttcttctttttttttttttcttgagatggagtctcactctgtcgcccaggctggagtgcagtggcatgatcttggctcactgcaacctctgccacctgggttcaagcaattctcctgcctcagcctcctgagaagctgggattacaggccactgcacccggctaatttttgtatttttagtagagacggagttttaccatcttggccaggctggtcttgaactcctgacctcgtgatctacctaccttggcctcccaaagtgctgggattacaggtgtgagccactgcatccggccatgagtaagttctttagtggtgatttgtgagattttggtgcacccatcacccaagcagtatacaaggcatcgtatttgtagtcttttatcccttgcccccctcccactcttccctccaaatccccaaagtccattgtatcatttttatgtctttgcatcctcgtagcttagctcccacatgtcagtgagaacatacgatgtttgattttccattcctgagttacttcacttagaataatagtctccaatctcatccaggtcactgcaaattctgttaattctttcctttttatggctgcatagtattcagttatatatatataccacagtttttttatccacttgttgattgatgggcatttgggttggttccacaattttgcaatacacatgcacatgtaattcttatcaaaattaagcttagtcactaaaagaagattcgctatctgaactttgttctgcaggattttcacttttgccatcaggcactggagcacctgacctctcaagaagatctgggtctagtccttctgatatcatttttcttattgccatcactggtacactcacttgaaccattttgagatatatgacatatcttgaatctttagctacagttaagatatttcctgctgatacttaactttcctgtggtccagagtcttaatgtactgtcctgctgtgattactctgaggtgacttcagaatgtgatccatttgtgacactagtggcacttgaaggagatacttcaaatgtgacatcatctaggcctggtatagatgacaactttgcatctacagtattgagaattgtttcaatttgctggataccaagataaaggtttgccagtttctcctcactaaatgtagaagagcgattgaggcactatacagtgtgtaccacattttggtttagaaaagccaccattcttttctgctgaatagctggcaccttgatcaagtctacgcctgactcccatgagaggaagcccatctttatccatctcctcaggaggcaggagacccaggactcacccatgaactcctcccagatggggcctgcccaaccctgtaatcgtgtcccagtgcttccccacgtcccccaagacaatgtatttttatattcaacaaacccagttcactttaccacacctgataaaacctaacaaagatttccccaaatcaaatatctagtcctcccaccccctctccaattggtttcttaaaatcaggaccaaagataatccatactttgtattttgttaatatgtctgttttaatgaaactacatgttttcttctcttttttttaaaaaaaaaatctgttgaacggatttatttgttgaagaaatgaggttgtcctatagagttttctaaattctgggttctggtgcttcttcatggtgtcacttaatagtccatcgtttcctttaacccttattttctgtaaactgataattagatctagaagcttgttctgatacaggtttgatttttgtcagaataatttataggcagtatgtttctgaatccttggattcaaccaatcatggattgaaaatattaccaaaaaagtcttaaaaagataacaatacaataaaaaataatacaaataaaaatacagtataacaactattcacatagcatttatattgtattaaatcatctagagatgatttatagtacatgggaagatgtgtataggttatatgcaaatattacaccatttcatgtaagagattatataatgtatttttatatttcaaaatataaaatattttaaaatatatgtacaaaatttatataaaatatgtgtttataagcagacaaatatatactcatatctcccctcattccgccattttcttagataaatggtaacagtccatatatactcttcttcacctgattttttccccctcgtttaacattatatcctagggattactccatagaaatatatagagatattccttatttttaatagctgtatttcaattgctgtatgtaccttattatgttcaaccagcctcccttgatggacatttggatgctgcaatgaattgccttgtgcctatgtctttgccacttttaaggctattactataaccatttctgttttcactctcatggttccctctatgtatcttagtcatatgcttgtatcactgtattggtttgctagggctgccataacacaatatcacaggttggttggcttaaacaacagatatttattttcccacagttttggaggctagaagttcaagattaaggtgtcagcaagtttgatttcttctgagtactctttccttggcttgcagatgttcgccttcttgctgtgtcctctcacatggcctttcctctgtgtgtgctcatttttcgtgcccatttgtgtgtccaaatttcctctggttataaagataccagtcagatgagattagggcccgccctaatggcctcattttaatgcaatcacttcttaaagcccctatctgcaaatacagttacattctgaggtgttggaggttagggctacagtgtaggactttgaagggacataattctgcttgtaacaataactaattcttttttttttttttgagacagagtctcactctatcgcccaagctggagtgcagtggcatgatctcagctcactacaacctccaccttctgggctcaagtgattcttgtgcctcagtctcctgaggagctggggctacaggcatgcaccaccacgcccagctaattttttgtatttttagtagagatggggttttgccatattgcccaggctggtctcaaactactgagctcaggctttccacccgcctcggcctcccaaagtgctagggttacaggcgtgagccaccatgtctggccaataactaattattgatttatcagctttatttatgatctatttatttgctattatgatggatgaggatttatctcatattatatcatgttacctccccatcccctctcaatttttgttagttatattatactattttaaatttatctgttggctgtcttttaaaacttaattatatatatttttatatacacacatataattttttgtatatatttcaaaagtatactttttattgagacagggtcttgctctgtcacccaggctagagtgcaatggcgcgatcttggctcactgcaaccttggcaccccgggctcaagcaatcctctcatctcagcctcccaagtagctgggaccacaggtgtgcaccaccatgcccagctaattttttgtatttttagcagagatgggggtctcaccgtattgcccaggctggtctcgaactcctgagcttaagaaattcgtccacctcggcctcccaaaatgctgggattacaggcatgagccacggcgcctggcctaaaataacatatgcttttttttttttttgaaacagggtcttgcctgttgcccaggctggagtgcagtggcatgatcatggctcactgcagccttcacctcccaggctcaagcaatcttcctgcctcagcctccctaatagctgagaccacaggtgtgcaccaccatgcccaatgaatttttaaattttttgtagagacagggtcttgctatgttatgttgctcaggccggtcttgaattcctggcctgaagtcatcctttcacctcagcctcacaaactgctaggattacaggcgtgagccacaccatgctcagccctaagtcatatatttaaacttttctttcttttttttttaaaatcaaatttggagtttatctctttacttgctactttgtgaggatatttccattctttctatctctctttccctttaaccttccaccttctgtcacctctaacatttgcattttgggctttgttgatccctaataatgaaaactgaaaaggcatgttattgattgtgactattatttaactctgtggattataatttggtatctctgtatgtttccatctgctagctctctcaattctattttctcagttattctgtttgttgagtgtgatgtcctttcatggcattggtttccctcaattgtttggtaattcttgctcatatttgatttgaaattctgtgatgatcttctatgaatattgtgtcacactgtgtactataacctgaatccagtgactgatgaagaggtaggactggatgtttttcattaacctgtgttgtcagccacctagaactctgtttctgtccagccaaagtaattgtactctctgttcctttctggagaggagggaggaagatacctttcttggggaggcctattgcctgatgttcctactgttcgcatccagggctgtttccacattttgcatttttgtgcatgttgggatatctaccagttacaatactgtgagctccttcagtgagactggaatataaaggtacttaataaacatttgttggattaatccaaattttattgcagatggaattaaaaactagaaccccagtagtctaatgcttatcatatgcctttcttcaagtatgtgaagcattaagttttcagaactttctcttcctatctaagttacttcaacgttttcttttaatatttcctcagaagatgtgtttttaagtctattaatttttgctattatttttgtctttatgaccatttcttttaaattgtggagttcaaagtagaacacagaactctaacaaatgctaactgttgctttttgttttctgtgagttataagactgaatatggacagaggattcaatattttctccaatattcccccaccaatttgggggaggtatgaatttttaaaaattattttctaatttctctcttctagatgaatatgagaataggaaaagaatggttggatgctggaaattttctaatcgctgatgaatgttttcaagctgctgtggccgtaagttaccattgacttttagctgaggcaattattagtagtaacatctgtggttattctcattgttacattgtactgtgggtttattttccagagtctggagcaattatacgtcaaattaattcaaaggagctcccctgaggctgacttgaccatggagaagattactgttgagagtgaccacttcagagtgctttcttaccaagcagagtcagtaggtatcgtgggcaccagggtcttccagtggggcattttccatatgtaaaagtaaaagtgatgatatatagcctattggaagaaagtcagatgtcactggccttttataggatattaatttgacctttttatctctgttatatctgaaggtgatgttactaatgctgattggaatctatggggtggctaagggtgagaagactgatatacagctaaacatcattttcaccccctgcatgtaacatctgtcatttatttatggcagcaatccctacttgaaacacctgtctctgtgactctctcttacattcacagtctgcctaaaatatttgcctgaaaagagccttctcatttgcagttgttctgagttgtctattgatgctttctaaaagtctgctgagatcatacactgtttaaagttatactttacctctgtttatcttgtgggtttcctccttttgccatcatacacttaggtgtgcatttgagctatgatgagtttgctttctgttattacgcaattctggaaatgaaaaatccccagctgggcatggtggctcgtgcctgtaatcccagcactttgggagcctgaagcggaaagattgcttgagcccaggaattggtgaccaacctgggcagcatagtaagacccccatctctaccaaaaaataaaagtgaaaaattagccaggcttggtggtgtgcacctgtagttccagctactagggagtctgaggcagaaggattccttgaacccaggtgacagtgagctatgattgtgccactgcactccagcctgggtgacagagctagactgtgtctcaaaaaacaaacaaacaaaacaacaatgaaaaagaaaagtccccttttttattttttgacatatttactgagatataattcatataccataaaattcacccatttacactgtgtaattcagtaatttagtatattcacagaattgtgcaatattcaccacaagctaagtttaaaacatgtttgtcaccccaaaaagacatccccatcagcattagcagtcattcctcattgcttctgaccctagctctagcaaccgtgaatttattttctgtttctatagatatgcctattttggacatttcatattaatataatcatgcaataagtggtcttttgtgattagcttctttcatttagcataattgttttcagggttcatcagtgttgttgcatgtttcactgtatgaatatgccatgttttgtttatccattcatctattgatgaacatttgagtggtttccaatttttgtctattgtgaataattctaatgtgaacattcatttactctgtgtgtgtgtgtgtgtgtgtgtgtgtgtgtgtgtatgtttttaattttctttggtatataactaagggtggaattgttgggtagcatggtaactctaagtctgtgtttaaccttttgagaaactgccagaatgttttccatagtggctgaactattttattacacttcccccagtagtatatgagggctccaccttctctacatctaaaggttttatagttttagcacttacacttagatctgtggtccattttacgtaaattttcaggtataatgtgaagtagtggtctaacttcattcttttgcatgtggctattcaattgtcccagtaccatttgttgagaagactattctttccccatattgaatgaccttagcacctttgtcaaaaatcaatttatcataagtgggagggtttacttctggactcttgattctattccatttatctgtatatctagccttatgctggtaccacacttgtcttgattactgtagctatgtagtaagtttcaaaattgggaattgcaagtcctccagttttgttctttttaaagagtgtttggacttttctgggtcccttacatttccatatgaatgttaggatcagcttttcaattggtgtacagaagccagctggaattttgatagggatagcattgaatttatacaacaatttgggggatattgttatcataagaatattgtgttctgatccatgaacatgggatgtcttttcatttatttaggttttgtttaattttctctcatttatttatttttatcttttttttgtagagacaaggttttgctatgttgcccaggctggtatcaaactcctggcctcaagcagtcctctcaccttggcctctcaaagtgctgggattacaggcgtgagccaccatgcctggccagacctatgtgtggtatttttgttgttgttttagagacaggatcttgctttgttgcccaggctggagtaatgtggcccaatcatagctcactgcagcctcaacctcctgggctcaagggatcctcctccctcaacctcccgagtaggtaagactatgggtgtatgccactgtgcctggctaattaaataaacattttttttttttttttgtagagggagggttttactatgttgtctaggctgttcttgaactcctgggctcaagtgattctcccaccttgccctcccaaagtgctggaattacaggcatgaaccactgcgactggccagacctatgtgttttaattgtccacaagctcaaacttaaatcagtgatgtgacgtaactgcaaaaaaagctagcacagtcctaggctatgttaatagatacatagtgtcctcatctaggtagttaattcacattttgaatattgtgataacttctaggcatcacattttaaaatcactgggttggtgtacaaaatatatgaaaaatatttggagaatatagtgatgtttgtctcagaaaaagaagacagtaggaatgatagctctctttgaatattttaaggactattgtattaaaaaggaattaaactccacaggatggaatgaagaacaatgggtagaaattataggaagacagattttggcttaatataaggagtagccttttatcagtgatagtaatcctataatggaatagctttcctgcaagattttaaatctgttttcactggaaatttgtaagcaaaggtgtgaatatcctaagaattatacattgcagaaggaattccttcatttggtaggaaatttgactactatgacccttaagtcccttttaacaccaagatcctatgatttcagaaagtcttgtagcatttgttcagtgtggtggatgttgatatctaaatggcatctttatatagctggttaaaagtgttagttgttataatcagtaatgagaactatataattcttgactttgataagtgatgacatcttcagaagttgtggtgaaggctaattccttttgctctaagttaatttttcatttctaagacattcgcaccattagagtttatgagttttgttgatatttgcttgggagaagacatctttaaaatggcggttaatagcggtgtttgataatgagttttctctgtcctaataaagctcctgagaggccttatctttctctaggcacctaccatttaaccagttagataattgctttattatttattaagttattcaacagacaaggaatatcttctatgaacagactactatgctaggttttgtggaataatgcaaataatcacatatcctatcctcaaggattatagtttaattggtgagataaaggatgcatatgcaagatagaaaaaattgggtactataatagttgtacagataagtgatctacatgcagtgttcagtgctatgtgtgagtggagatgtaatatatggtcattttccttaagaaaattataagctagtttgagagataggtcatgaatacattttctaaaactggaaaaagaaaaatattaagtgccaaatgaatgacttaggttaggtgggacacagactttgtctaaagtggtcacatgaccttcctaacaattgttaacattttatttttcctcaatccctatatccacttgcaaggtgaaggatacttttctgtgtatgcaagtgccagattacccttctgtaatcttttagaattgtaaaaataactatagatcttggtgtttctcctaattccccatttcccttggttactggcaatgcctctttctgcagtgtgcatcatctgcagatgcaagggtcgtatgttttgcttctgctccctcccctatttaaagtaggaccacttgtagaagctgacagggtcacactgaggaaggggctatgagcttacctataaagactatgatggaggctatcctggagatacaagccaagtgaaagccagctttctctattatatcaaggactttggttcaccatctttcctagtagttaaaaaagtagtaatgtaaaaaaattaatctgcattgtcagcttctagcatagtacgtagcatataatatatattatgtaaatgtgtgtggtacaaatgaatctgctctccccctattattcctttctgatctttttgcaccccccatcctatcaaaagagtgatcagtagtatgtaaaatgtgaaagactgaaaaacaccagtacaggcaagtgctacaagagtgtagaaaagtggggagattattgtggactgggttgtagaagacacacaggatttagagcatgatttgaactttgaaggaagaaacagacttaggaaagtggggaagagggcacagaatattccaggcagagcaaagtcatataggcagaaatgtgcatgccacgtttaaggaacagtgtgatcagtttatctgaaggaaagtattttgcaagggcacaatgagtgctaagtctggagaaataagtagggccaggttgagaaagcccaaatatacctctttgaaaaaatacttttgatattttcctaaaggtactggggtgattgaaagtgtttaggaagaggtttggtggcacctagtgaagagtaacctgtaatcgtgtttagaattgattgaaaagtgaacagaatcaaggcatagtgtaagcatgaactggtgaaagcctgtactatagtagtaccaatgagaatgggaaagaagggacagatacaggagacatataaaggaagcaatcatttatgctcagtgagaaggacttgaaccattgaatctttggaggcaggaaagggaggataataaagcctgttcattccacaaacatttacatgttgttgggaggtgggagagtgcagtcgaaagtagagcaaacactgctaggcatggtggctcacacctgtaatcccagcactttgggaggccaaggtgggaggatcatttgaggtcaggagttcaagaccagcatgggcaacatagctagaccctatctctgtgagaaaagaaaaaaaattagccaggcatggtggcacatgcctgtggtctcagcttcatgggaggctgaaacaggaggatcacagattgaggctgcagtgagccatgattacaccacggcactccagcctgggtgatagagtgaatccctgtctttaaaaaattaaatttaattacattaaaatttcaaaaagcagagcaaacgaaaaagaaggaataccagagatgaaagaggactagaacagtgtgggtcattcacgagaagagagtttggagaaaaggatgatcaacagtggccagtgcttcagagaaataaaagaaaatgaggtcggaataaacgccattggacctgacgtttaggaagatgatagtgaccatagaaagcagtttcagtagtaaggtgtcttagttcgttttgtattgctataatggcatacttgaggctgggtaatttataaagaaaagatttattcttgctcacggttctgcacactgtacaagaagcatatgccagcatctgcttctggccagggacttcagtaagcttccaatcatgccaaaagtcgaaggggagcaggcatgtcacatgacaagagagggaaaaagagatacaggggagggtgataccagactctttcgaacaatgccatcttagaggaactactagagcaagaactcactgttactgtggggagagagccaagtcattcatgagagatctgactccatgtcctaaacacctcccactgggccttacctccaaaattggggcatcacatctctttctttcttcctttttttttgagacagagtcttgctctgttgcctaggttgtagtgcagtggcgtgatctcagctcactgaaatctctgcctcctgggttcaagctattctcatgcctcagcctccagagtagctgggattacagtcacatgccaccacgcccggctaatttttgtatttttagtagagacagggtttcgccatgttggccaggctggccttgaactcctcgcctcaagcaatccacccaccttggcctcccaaactgctgggattacaggcgtgagcgaccatgcctgacctggggcatcacatttcaacatgagatttggaagggacaaatattccaactatatcataagataatagtagaaaatagactgtaagggtttaaggactgaatgggtggcgaggcaatggaagaagttatggtgggaggttctgggaggtcaaaactattttataataattctaaaacattatttgcctattttttgctgttttagcatttgctctggtgatgcaaagcaatgatgggtaagattgctggcacttcaacatgaatcaggatagtggcactagcatacagactagtcatctttttattcatcactgctatactcttactttaagaagaatgccagtcttaagactatactttcagggatcatttctatagtttgttactagagaagtttctctgaacgtgtatagcactgaaaaccacaaagaagaggtgcagcattatctcctaagtgtaaagccggctcttgatgttgctttgctgcaactgccatttgccattgatgatcgttcttttcttcctttgggagactgggaaggaaaggatgcaatctgagtggttttcatttaaaaaataaataaataaaaaggatgccagttttacacaaaaccatccttgataagcgagtaaagatgattaattttattaaatcttgggcccttgaacacatatcattttaatatgtgtgatgaaaagggaaacactcatatagcacttttgttgcatatcgaagtgtgatggttatctggaggagaggctcttaagtgattgtttaatttgtgagccgaattaactattttgtgtgtgcgtgtgtgatggagtcttgctctgtcacccaggctggaatgcaatggcacaatcttggctcactgcaaactccacctcctgggttcaagcgattctcctgcctcagcctcccgagtagctgggactacaggtgcgcatcaccatgcctggctaatttttgtatttttagtagagatggaattttgccatgttggccaggcgggtctcgaactcctgacctcaggtgatctgcccacttcagcctcccaaagtgctgggattacgggcgtgacccagtgtgccctgcctggattaactatttttaatttcaagaatgactgacacataaacttggctatttagcagatgttttcataaaaatgaatgaagtgggccaggcgcagtggcccctgcctgtaatcccatcactttgggaggccgaggcgggcggatcgcctgaggtcaggagttcaagaccagcctggccaaaatggtaaaaccccgtctctactaaaaatataaacgtgggctgggcatggtgtcaggtgcctgtaatttcagctccttgggagactgaggcaggagaatcgcttgaattcgggagacagaggttgcagtgagcagagatgatgccactgcacttcagcctgggtgacagtgagattccctctcaaaagtaaaagataaaataaaatgaaccaagtgaataggactctattgtgtatatgtaccattttgcattcttcatccattcatctgttgatggacacttaggttagcatgtgacttctgggaaaacaattgacagtattttttgccagtgaaaaagtttgagcttttaggtaaaaactgaaattttagaaaatgtgtacttctaccatgagcttggtagcttctaaatacttagtcttttttttttttgaggcagtctcattctgccacacaggttggagtgcagtggcacagtctcagctcactgcagcctctgcctcccgggttcaagcggttctcatgcctcagcctgggaggtagctgggattacaggcgcacaccaccactgctggcttttttgttttgttttgttttggtatttctagtagagatgggggtttccccatgttggccaggccggtctcgagctcctggcctcaagttatccacctgccttggcctcccaaagtgctgggactacaggtatgagccactgcctaaatacaaagtctttttttttattttattattattgtactttaagttttagggtacatgtgcacaacgtgcaggtttgttacatatgtgtacatgtgccatgttggtgtgctgcacccattaactcgtcatttagcattaggtatatcccctaatgctatccctcccccctccccccaccccacaacagtctccggtgtgtgatgttccccttcctgtgtccatgggttctcattgttcaattcccaactatgagtgagaacatgcggtgtttggttttttgtccttgcgatagtttgctgagaatgatggcttccagtttcatccatgtccctacaaaggacatgaactcatccttttttatggctgcatagtattccatggtgtatatgtgccacattttcttaatccagtctatcgttattggacatttaggttgcttccaagtctttgctattgtgaatagtgccgctataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttaatgatgccattctaactggtgtgagatggtatctcattgtggttttgatttgcatttctctgatggccagtgatgatgagcattttttcatgtgttttttggctgcataaatgtcttcttttgagaagtgtctcctcttcatatccttcgcccacttgttgatggtattgttagtttttttcttgtaaatttgtttgagttcattgtagattctggatattagccctttgtcagatgagtagattgcaaaaattttctcccattttgtaggttgcctgttcactctgatggtagttccttttgctgtgcagaagctctttagtttaattggatcccatttgtcaattttggcttttgttgccattgcttttggtgttttagacatgaagtccttgcccatgcctatgtcctgaatggtattgcctaggttttcttctaggggttttatggttttaggtctaatgtttaagtctttaatccatcttgaattaatttttgtataaggtgtaaggaagggatccagcttcagctttctacatatggctagccagttttcccagcaccatttattaaatagggaatcctttccccattgcttgtttttgtcaggtttgtcaaagatcagatagttgtagatatgcggcattatttctgagggctctgttctgttttggtaccagtaccatgctgttttggttactgtagccttgtagtatagtttgaagtcaggtagcatgatgcctccagctttgttcttctggcttaggattgtcttggcaatgtgggctctttttggttccgtatgaactttaaagtagttttttccaattctgtgaagaaagttgttggtagcttgatggggatggcattgaaactataaattaccttgggcagtatggccattttcacgatattgattctttctacccatgagcatggaatgttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctgttgtctgttattggtgtataagaatgcttgtgatttttgtacattgattttgtgtccggagactttgctgaagttgtttatcagcttgaggagattttgggctgagatgatggggttttctagatgtacaatcatgtcatctacaaacagggacaatttgacttcctcttttcctaattgaataccctttatttccttctcctgcctaattgccttggccagcacttccaacactatgttgaataggagtggtgagagagggcatccctgtcttgtgtcagttttcaaagggaatgcttccagtgtttgcccattcagtatgatattggctgtgggtttgtcatagatagctcttattatttggagatatgtcccatgaatacctaatttattgagagtttttagcatgaagtgttgttgaattttgtcaaaggccttttctgcatctattgagataatcatgtggtttttgtctttggttctgtttatatgctggattacatttattgatttgcgtatgttgaatcagccttgcatcccagggatgaagcccacttaatcatggtggataagctttttgatgtgctgctgaattcggtttgtgagtattttactgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctgttgattattgccacaatttcagagcctgttattggtctattcagagattcaacttcttcctggtttagtcttgggagggtgtatgtgtcgaggagtttatccatttcttctagattttctagtttatttgcgtagaggtgtttgtagtattctctgatggtagtttgtatttctgtgggatcggtggtgatatcccctttatcattttttattgcgtctaattgattcttctctcttttcttctttattagtcttgctagcggtctatcaatttcgttgatcttttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatcttttctgcttcctcttgtgggcatttagtgctataagtttccctctacacactgctttgaatgtgtcccagagattctggtatgttgtgtctttgttctcgttggtttcaaagaacatctttatttctgccttcatttcattatgtaccgagtagtcattcaggagcaggttgttcagtttccatgtagttgagcggttttgagtcagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcaaagctgagttcaattcctgggtatccttgttaactttctgtcttattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagttcttcttgttgaattgatccctttaccattatgtaatggccttctttgtctcttttgatctttgttggtttaaagtctgttttagcagagactaggattgcaacccctgcctttgtttgttttccatttgcttggtagatcttcctccatccctttattttgagcctatgtgtgtctctgcacatgagatggctttcctgaatacagcacactgatgggtcttgactctttatccaatttgccagtctgtgtcttttaattggagcatttagcccatttacatttaaggttaatattgttatgtgtgaatttgatcctgtcattatgatgttagctggtcattttgctcgatagttgatgcagttttttcctagccttgatggcgtttacaatttggtatgtttttgcagtggctggtaccagttgttcctttccatgtttagcgcttccttcaggagctcttttagggcaggcctggtggtgacaaaatctctcagcatttgcttgtctgtaaagtattttatttctccttcacttatgaaggttagtttggctggatatgagattgtgggttgaaaattcttccctttaagaatgttgaatattggtccccactctcttctggcttgtagagtttctgcagagagatcagctgttagtctgatgggcttccctttgtgggtaacccgacctttctctctggctgcccttaacgttttttccttcatttcaactttggtgaatctgacaattatgtgtcttggacttgctcttctcgaggagtatctttgtggtgttctctgtatttcctgaatttgaatgttggcctgccttggtagattggggaatttctcctggataatatcctgcagagtgttttccaacttggttccattctccccatcactttcagctacaccaatcagacgtagatttggtcttttcaatagtcccatatttcttggaggctttgttcatttctttttattcttttttctctaaacttctcttctcgcttcatttcatcttccatcactgataccctttcttccagttgatcgcatcggctactgaggcttctgcgttcatcacgtagctctcgtgccttggttttcagctccatcaggtccttgaaggacttctctgcattggttattctagtatccgttcgcctaattttttttcaaagcttttaacttctttgctattggttcgaatttcctcctgtagctcagagtagtttgattgcctgaagccttcttctctcagctcgtcaaagtcattcttcgtccagctttgttccattgctggtgaggagctgcattcctttggaggaggagaggcgctctgacttttagagtttccagtttttctgctctgtttttttcccatctttgtggttttatctacctttgttctttgatgatggtgacctacagatgagtttttgatgtggatgtcctttctgtttgttagttttccttctaacagacagggccctcagctgcaggtctgttggagtttgctagaggtccactccagaccctgtttgcctgggtatcagcagtggtggctgcagaacagcagatattggtgaactgcagatgctgctgcctgatcgctcctctggaagttttgtctcagaggggtacccggccgtgtgaggtgtcagtccgcccctcctgggggtgcctcccagttaggctacttgggggtcagggacccacttgaggaggcagtctgcccgttcccagatctcaagctgcgtgctgggagaaccactactctcttcaaagctgtcagagagggacatttaagtctgcataggttactgctgtctttttgtttgtctgtgccctgctcccagaggtggagcctacagaggcaggcaggcctccttgagctgtggtgggctccacccagttcgagcttcccggctgctttgtttacctaatcaaacaactaactcagcaatggtgggtgcccctccccgagcctcgctgccaccttgcagtttgatctcggactgctgtgctagcaatgagcgagactccatgggtgtaggaccctctgagccatgtgcgggatataatctcctggtgtgccattttttaagcccgttggaaaagcgcagtattagggtgggagtgacccgattttccaggtgccatctgtcactgctttctttgactaggaaagggaattccctgaccccttgtgcttccctggtgaggcgatgcctcgccctgctttggcttgcgcacagtttgctgcacccactgtcctgcacctactgtctggcactccccagtgagatgaacccggtacctcagttggaaatgcagaaatcacccatcttctgcgtcgctcacactgggagctgtagactggagctgttcctattcggccatcttggctcctccccctctaatacttagtcttttctgatgaaattggtggtggtattaaacaaatgtgattttattttattttatttgttctgagaccaagtcttgctccgttgcccaggctggagggcagtagtgccatcttggctcactgcaacctccacctcctgggttcaagcgattatcctgcctcagcctcccgagtagctagctgggactacagacagccgccaccatgctaggctaaattttgtatttttagtacagatggtgtttcaccgtgttgaccaggctggtcttgaactcctgacctcaggtgatccacccacctcggcctcccaaagcactgggattgcaggtgtgagctaccgtgcctggccaacaaatgtgtttctaaaaattttttaaaattttgaaataagcatagatttgcaggaaactacaaaaatagtaaagagagatctgtgtacccttcacccagctttttgccagtagcaaaatcttgcatacatatagtgcaatataaaaccaggaaatagacattgatacaatccacagaccttatttagatttcaccagttttacatgaactcacttgtgtgtgtttgcatgtgtttatagagctctatacaatttcagcacatgtgtaggtgaagattcatgttcactaccaccaccacaatcaagatacagaacagtttcattaccacacagattctttacataacccctttatagggatacccctttcccatcatccaaaacctcaggcaaccaaaacctagtctccatctctataattttgtcattttaagaacattatataaatgtaatattacactatgtaaccatttcatattggttgttttcactcagcatttttttttttgcgatccgtccttgtctttttatgtgttaatagtttgttctttttgtttgtttgtttgtttttgagacagagagtctcactctgttgcctaggctggagtgcaatggcgtgatctcggctcactgcaactactgcctcctgagttcaagtgattctcctgcctcagcctcccaagtagcgtgagattacaggcatgtgccaccttgcctggctaatttttttgtattttttagtatagatggcgtttcaccaagttggccaggctggtttcaaactcctggcctcaagtgatccacccacctctgcctatcaaagtgctgggattacaggcatgagtcaacgtgccaagccctgttctctttttattgctatgtagaattctatgctatggatgtaccaatttgtttagccattcaccattgaaagaatttgggttgtttccaatttttggctattgtaaataagttggcatgaacatttccatacaggtttttgtgtggacataaagggtatatttagttttattttttttttagaaactgccaactgttttctagagtggccatgccattttacattctgtgttttgttttgttttcttgttttcttttgagacagagtctcactctgtcacccagggtggagtgctgtggcatgatctcagctcactgcaacctccgcctcccaggctcaagtgattctcctgcctcagcctcccgagtggctgagactacaggtgcgtgccaccatgcctggctaatttttgtatttttagtagaaatggggctttgccatcttggccaggcttgtctcaaactgctgacctcaggtgatccacccacctaggcctcccaaagtactgggattacaggtgtgagccactgcacccggccaccatttagattcttaccagtaatgtatgagagatcccatttctttgcatccttgacagcatttggtattgtgaccaatttttttattgtagctatcctaataggtatatagtgatatctcattgtggttttaatttgcatttctctaatggctaatgatgttgaacatcctttcatttacttatttgccatctgtatctccctttaggcaaaatatctgtcatttttcttgtctattttctatttggattgtttgatagtttactgttgaatttacaggattatttatatattctagatgtgattcccttgtcagataaatattcgcgaatattgtcttgttgtagcttgtctttttgtcctttttaatagggtcacagaatacagttttgatgaagtccagttgattgatttctttttcttttatggatcatgcttttggtgtcatgtctcagaatgtttcacctagccctgggtttcttaaatttccatttgaattttaagatcagcatgttaatttctgcaaaaaaggccaactggaattttaatggaattggattaaatttatagatcaactcggggagtattgccattttaatatattgtcttttttttttttttttttgagacagagtctcactctattgcccaggcaatattgcgccatctcggctcactgcagcctctgcttcccgggttcaagcgattctcctgcctcagcctcccaagtagctgagattacaggcacgcaccaccatgcctagctagctactttttgtatttttagtagagacagggttttgccatgttggacaggctggtctcgaactcctggcctcaggtgatcagtctaccttggcctcccaaagtgctgggattacaggggtgagccactgggcccagccctgatggtagttttgattgccccaaatgtacacatttttgaatactgacttacagtttatgaaatgctttcacatctgtgatcccatttgatcctcataaaaatcaatcctatattgtagacattactgtccctattttatagttaacaaaatagagcctcaaagagattgtgacttacctaagttcactgagccaagaagtggaaaaactgggaatgcaaagctcatattcttttcactacatcagtatacgcaggacatcactccagatctaatgaatcacagtctccccaagttgtgagagctgggcatgtgattttcagaaagctccactggtgagtctgatgctcacaaaaggttactacagcactgtattgtgctgcctcttctttaagacttcttttactttaaatctttatcttttgggcttgaaatatttgtttctagtcataagaagatgaataaattttcaaaagtagcctgaattattagagctttgatttctctaagataaaatctgagtaatgatagacactttatgggttgtttgaacattaaagtctcatattgttttatatgttataagaacagacagcaacatctatcctctgatatggtgttgtcactcagcatttctcttttatagtaagattttctccaccttgaataatgatttaatcagcaagtattcatagaatatagtgtagacaggaatattattttctaatctctatatagagatttggcttattgaggcacttgtgttagcaatttattttcccctttaataatatctagtattaaagccttataagagagtatctactcagcaagatgtcaggcttactattcagcagttagaagagaaaactagagagaagctggtgtcttacgttgtttatattttcttctgtctactcaattcttttattattcaaagcacaataatatttgacaccacgtaaagaagagaagaaagaaaatagcaagtgtagtactttattatttccttgtatgtatccatgtttttcttaaaaaatgctgtgtcagccttttttttttttttgtgacagagtctcgctctgtctcccaggctggagtgcaatggctcgatctcagctcgctgcaacctccgcctcccgagtagctggattgcaggtgcccaccaccacacccagctaatttgtgtttgggttgttttgttttgttttgttttgttttgtttgtttgttttttggtagagacgggatttcaccatgttggtcaagctggtctcagactgctgacctcaggtgatccacccaccttggcctccctaggtgctgggattataggcgtgagccactgctcctggccaactaagttcttcaatggctgaaacaagcctcttctacaagtgctaaagtatgtgtgattgatgtttacattcatttgggggtgttcagacatagaatggtagaactgaaaggaaccctgcagatagtctagtacagtctcctcactttatggatgaggaaacaatctgtgagagcttaaggctcaaagttacacatgataaatggcagagcggctcttttggcttcatgatgagattgtacgaagctgcttttcttttttcttaaaattttttttttttttaagagatggggttttgctctgtcatctgtggcaggagtagagaggtatcttcttagcttactgcagcttcgaactactggacttgagcaattttcccgcctcagcctctaaagtagctgggaccataggtgtgtgccaccatgtctggctaattgataagctgctttttgtagtggatatacatagcagttcagactatgaggttattgtgatcttgctttaagacaaagactgctgtttagcttaattcctctaatgtagaagtgaatagaagagctattcaagttgcagaagcatctagtagacctggcattatgtcatagtataataacataaggcagtacaaccagtttttgcatttccagaaaaaagtaaatgactcctgctcattcagtatcaactctgtgtcaccaaagattaccacttattcttctgtattttgagcaagctatctgtttagcttgaacaactagtattgctaaaaatattagaaaacaaaataagacttttaaacactagttaaaatatgctaaaattgacttagagacaaataaccttgtcattttaaccaattattgacattctttatctttttcaggcagttgctcaaggggattttcaaagagcatctatgtgtgtactgcaatgtaaagatatgttgatgaggctcccccagatggtgagtgaagtctgcattctccaagagtttgaaaatatgctatatcaagttccaggaagaatcattactacttcatgcaaccttttggagattctatttgagatcagttccacataagtagctgatctttgaaatattttgcttcctttgttctttaccagaaagggcatttgaaaaagctatatggaatatttcttttttttcttttcttttcttttcttttcttttcttttttttttttctgagatggagtctcactctgtcacccaggctggagtgcagtgatgtgatctcagctcactgcaacctccacctcccgggttcaagtgattcttgtgcctcagcctcctgagtagctgggattacaggcctgcgccaccacacctggctactttttgtatttttagtacagacagggttttgctatgttgggcaggctgctctggagctcctggcctcaagtgatccacccacctcagcctcccaaagtactgggattacaggcgtgagccaccacacctggctgatatggaatatttcttaaaattttctttgctttgtcttttattgtcaaatcattttgataacatttgctccatattcatgctatacaacaaaagaaagaaaaaaatgagtttgtctgctgacaaggttgatagcagttaatcatcttactgccatagtatttttctatactgggatttggagatgtgagagatttgataggataaagcctgcatcctggactggatctcatgaaaattcctaaatacatagttttttgctttttcattttatcttccctttccattctttctctcctatttcagcgcctatgcctacttcagtctttactatcacagagggattaataatggagatataattggatattagggagaatgttcccagtattgcatacatcgtacctatttgtgagattggtcttattttttccccaaattgggtgtcataatgtagagcttaattcagtaaacatttatatgttgcctgttatatgtcacatcagacattcttctaggctttaaaaacttttaaaacaatttcatatttatagaaaagttataagaatagtacaaagaactcctgtatatcctttgcttggaaacgtcattcaaattttccaataatgttctatatagaaaatggtttcaatctagaattatacatagtcttcagtctccttcaatctggaaatctggaacacctcctcattcttgccttgttattcatgatcttggcagttttgaagattacagatcagtcattttgtagcatgtgatttaatgtgggtttagccaaagtttcctcatgattagaacaggttgtgaatttgaggccagaaaaccacagaagaaattctatgttctactcatggcttcctattgggtggtatacaggattgatttatactattattggtggtgctagctttgatctcttgattaagatcgtgtctttcaggttttttcactgtaaacctgtatcatttcgtgagtgatacactgaaactatggcaaatcaaatttctcattctactttcaccatctttattcttttttcctccatttttctagctttattgggggtataattgacaaaatttgtatatatttatggtatataacataatattttgatatacattgtgaaaagatcaccacaatcaagccaatttatatattcatcaactcacacaggttttttttgtggagaaatatttaagatctactttcttagcaattttcaagtatacaatacattattataatattaactgtagtcactgtgctgtacagtacagccccagaacttattcatacggcctaaatgaaactttgtaacccctccccttttatttgaagagatagagtattgctctgtcgccaggctggagtgcagtggcatgatcctggctcactgcagcctcaacctcctcggctaaagtgatcctcccacctcagcctctcgagtagctgggactacaggtgcgtgccaccaaggctggctagttgttttatttttttgtagagatgggggtttcactatgttatgcaggctgatcttgaactcctgggctcaggcagtcctcttgccccagccacccaaagtactgggattatagacgggagccactgtgcttggacactttgtaccctttgaccaatatctcctcatccattccccaaccccctggcaaccacctttctactctctacttctatgaactcagctttttcagaatccacatataagtgagatcatgcagtatttgtctttctgcggctggcttatttcacttagcttaatgtcctccaggttcatctgtgttatcacaaatgacaggatttccttcttttttatggctgaatagtattctattgtatataaataccacattttctttacccattcatctcttgttggacccttaggttgattccatagcttggctattgtaaataatgctgcagtgaacaagggattgcagatatctcttaaagatacttattttatttcccttgggtatatatccagaagtgagattgctggatcatatggtagttacatttttaattttttgagcaacctctatactgttttctgtaatgggtatactaatttacattcccaccagcagtgtacaaagtttccttttctccatgcccttgccaacacttatcttttgtctttttgataatagacattctaacagatgtgaggtgatatctcattgtgattttaatttgcatttccctgatggttagtgatgttgagcattttttcacatacctgttgctgatttgtatgtcttccttagataaatatctattcaggtcttttgcccattttttcattgggttatttgtttatttgctattgcagtgtttgagttccttgtatattttggagattaactctttatcagacgtgtgatttgtggatattttctcctattctgtaggttgtctcttcactctgttgattgtttcctttgctgtgcagagcattttggtttggtgcaatctcatttgcctatttttgcttttgtcacctgtgggggtcatatccaaaaaaatcattgaccaggggtctatctctctctttccctctaataattgctttatatatctgagtgctccagtgttgggtgcatgtgtatgtaaaattgttatagcctcttgctgaattttcccctttatccttatatagtgacctttttttctctctccttaaagtttttgtcttgaaatccattttgtctgatataagtataggtactcctgctctttcgtggtttccgttgtcatggaatatctttttccatccgtttattttcaatctgtgtgtatcttcataggggaaatgtgtttcttataggcaagagatcattgggtcttgtttttttttaatccattcagccactctatgtcctttgattggagagtttagtctatttacattcagtgttattactgataagtaaagacttactcctgccactttgttatttgttttctgattgtttttggttttctattttttattctattatatttctttctttcctgtcttccttttagtgaaggcgattttcactggtggtatgatttaatttcttcctttttatttttttattttcgttgtttttcagtttcaggttaccgtgagccttgcaaatgctatcttataatccattattttaaattgatgacagtgtaacactgattgtattaacaaagagccaaacacacacatacacacacacacacacacaaactaataaaaactctacactttaactttgttcccctgattaactttttttgtttttctttatgtcttatggtactgtccatgttttgaaaagttgttgtggttattatttctgtttggttcatcatttattctttctacttaagtcaagagaagtttacaccccacaatttcagtgtgataccattctgtctttttctgtgtgcttactgtttttttttttttttttttttgagacggaatgttgctctgtcacccaggctggagtgcagtggcatgatcttggctcactgcaacatccgcctcctgggttcaagtaattctcctgcctcagcctcccaagtagctggaactacaggtgcatgccaccacacccggataatttttgtatttttagtagagacggggtttcaccatattggtcaggctggtctcgaactcctgacctcaggcgatccacctgcctcggcctcccaaagtgctgggattacaggcatgagccactgtttccagctgtccagccttgtgcttactattacccatgagttttgtaccttcaggtgatttcttcttgctcattaacatccttttctttcagattgaacaactccctttagcatttcttgtaggacaggtctggtgttcatgaaatccctcagcttttgtttgtctgggaaagtctttatttctccctcatgtttgaaggatactttctgctggatatactatcctagggtaaacatttttttttctccttcagcactttaaatatgtcatgcctctctttcctggcctgtaaagtttctgctgataagttggctgccagatgtattgaagttcgattgtatgtgattttttttcttctcttttactgtttttgggattctttctttatccttgacctttgggagtttgattattaaatgccttgaggtgttcttctttgggttaaatctgcttagtgttctataaccttcttatacttgaatgttgatatctttctccaggtttgggatattctctgatattatctcttcgaataaacttcttacccatagctctttccctacctcctctttaaggccaatggatcttagatttacccttttgaggctattttctagatcatgtaggtatgcttcatgcttttttattttttttcttttgtctcctctgattgtgtattttcaaatagcctgtcttgaagctcactagttttcttctgcttgatcaattctgctgctaagagactgatgcattcttaagcatgtcaattgcattttcaactccagcatttctgcttgattcttttaaattatttcagtctctttgttaaatttatctgatagaattctgaattccttctttgtgttatttcaaatttcttgcagtttcttcaaaatagctattttgaattttctgtccgaaaagtcacatatctctgtttctgcagaactggtccctggtgccatatttaattcatttggtgaagtcatgttttcctggatggtgttgatgcttgtagatattcatcggtgtctgggcattgaagagttaggtatttattgtagtcttctcaatctaggcttgctcatgccagtccttcttgggaaggccttccagttattcaaagagacttggaccccaagcctaataatgctgtgtttcttgtagacccataaagggtactccttgatgaccttggataacatctgaaagaattctctggattaccaggcagaaactcttgttctttacccttactttctctgaaacatatggagtcactgtctctgtgttgagctgggggtgtggtgatgcaagcactgggcctgtgctgtgtcagacttgaagccagcacagcactggaccttgcccaaggaaggcccttccctttaggatggtgagttcccccacaacccaggtgtgtccaaagatgctctctgggagccagggattggagtcagaaacttgagcaatttacctgttttattctactgcagttaagctggcactcaaatcacaatacaaagcccttcccactcttccctccctttccacaggcagaggagtctctccctgtggccgccaccatcagtggtccatggggtgttctgctaggccaccactgatgttcacataaaacccaaggtctcttccatcagcttgtggtgaatgctgccaggcctgggactcacccttcagggcagtgggctctcctgtggcccaggacgagaaatactgtccaagaggctacacctggatttggggaccccaagagccaagctggtacctagagtgcagtacaaagtcctctttacttttcctgggcttttctcaaacaaaaggagtctttcactggagccaccacagctgggaatgtgctgggtgtcccctgaagccagcacttctcagagcccaaggcccatggtgtactccctgggtcgttaatggttattccagggttataccaagggttctttagtcagcaggtgattaatcctgccaggactggatcctttccttcaaggcagtgggttcccttttggcccaggatgtgtctagaaatgtggtttgagagctaggtcctggaatgggggcctcactactctgcccagtgccctgtcctactgtggctgagctggtatccaagatgctagacaaagtcctctttactcttcccttccctctacttaggcagaaggaaggagtcactttcattgctacgagctttattgcctggggttggggaagggatggtgcaagccctccctttgctgtgccagctgttgtctccctaggtcacgtggcaagttcactggctctaagcccagccttacactaggagttgcctaggaattgcagtccttgtgccctagactgccactcaagtttatgtaggaccccagagcacttcagcccacagtgacgaggcttgccaagaaactcaagttcccaccactgggatgagggtaattctcctgtggctaaggctggtccaaacactccctctgtgcacaagcgctggctgaacccagcatgacttttttctctactgtgactgtgcagcactgagttcaatgtaaagttccccagctgctgtgctcttcctctgcaatgtgcacagattctctctctgcactgcatagctgctgccagggaagcggggaggggtggccttggagattgaagactgtttatcctgccctcttcaatgcctctttccacaatatgtagttaaaaccgggtactgtgagtgttcacctggttttggttcttgtgattgtgcttttctgtgtgcagacagttgttaaaatttggtgttccagtggagggtacaaacaatgcaggcttttattccatgatcttgccccacccttattttagctttttttttttttttgacaaggagtttcgctcttgttgcccaggctggagtgcaatggcacagtcttggctcactgcaaccttcgcctcccgggttcaaacgatcctcctgccttagcctcccaagtagctgggattacaggcatgagccaccatgcccagctacttttttgtatttttagtagagacgttgggggggtttcattatgttggtcaggctgatctcgaactcctgacctcaggtgagccacccaccgtggcctcccaaagtgctggaattacaggcgtgagccactgcgccaggccaacatctcttataaggtgattatttatttatttattttatctgagactgagtctcactcttttgcacccaggctggagtgcagtggcgcgatctcagctcactgcaacctctgtctcccgggttcaagccattctctcacctcagtctcccaaagtagctgggattacaggctcctgccactacgtccagctaattttttgtatttttagtagagatgtggtttcaccatgttggccaggctggtcttgaactcctgacctcaggtgatccacccaccttggcctcccaaagtgctgggattataggcgtgagccaccacacccggccaaagtgattttactggaaaaacatttcgtcaattcttgtatgctgctctaaacttaaaaaagatcctttaagaatgtaaaaacttttaaaatctcaccatccatattggcccacaggttgtaatttgctgactcatttctttactgagactatatttttctatttatttcatgagtgtttataattatttgttcaaacagttttaaaacatctgatttaaagcccttatcagatagttttaacattcatatcatctttctatgattgtcttttcttatgtatgttgagattttcaagcattgtcatataccgagtagttttttattgaacaatatatatatatacatatatataaatatatgtgtatatatatttgttttttgagactgagtctccctctgtggcccaggctggagtgcggtggcatgatctcagctcactgcaacctccatttcccgggttcaagcgcttttcctgcctcagcctccctagtagctgggattacaagcgtacaccaccatgcccagctaatttttgtatttttagtagagacagggtttcgccatgttggccaggctggtctcagaattgacctcaagtgatctgcccgcctccgcctcctaaagtgctgggattacaagcatgagccaacacacccaacccctatacattttctatattacatttttggcttctgggtcttgtctaaattctgggagagtgtcgatatttttattatagcaggtaatcaatctggtagattcaggcaaattttaaactcattttttgtgggttatggtttcaatgttgtttcaattttgcagtgtgcttcaggtttgtcttgcgtatgcaacactcattgatcagtcctggtacttggcagaggtttatctgttagctcagttatcaaagtttttgttatgtaaattaggttgagattcctggttattaaggttgtaggataagccttgaacttaatcaactttattttgttgcttttctgagctcctctctctctctctctatgatcttcttggtagtttctggttctctgagctgtccttttcagtcctctaaccaatagctatccataatctgcagttgcactgtgactggggccaagcagtaggaagacacaggcagaggaaaaaaagcagtgggagtttgccccatcctgtgggaactactgctgcagtgaatggacagtaaggttttcctctctcaaagttttgagtattttggtttcccctggctaccactgctgttgccaccatgggattgcctagggcctgagcacaagagaatggaagaaagatgaaataaaaaccaaaattgaatatttgcactttctctgagcaattcaagccagaagtagagaagcaccctcagtctgtaccacagcattcgcttctgagtttctggctgcattaagtttaggccaggggatattagaggaaaagaatggtaaacttaccaccagtttggtgttaacttgaattctggtgttcttcctttatttgccttctgctattattttctcagagtcctcaaatagctaagtgcattctgtcgaggtttatagttacattcagtgggagataaagggtggtgcatacttactttatcttacccaaaactaaaacactatttatttatttattatttttattttttgagatggaatctcactatgtcgcccaggctggagtgcagtggcatgatctcggctcactgtaacctccatctttcagatttaagtgattctcctgcctcagcctcccaagtagccgggactacaggcatgcgggcatgcaccactatgcctggctaatctttgtattttttttttagtagagacagggttttatcatgttggccaggctggtctcgaactcctgatttcaagtgatctgccttccttgccctcccaaagtgctgggattacaggagtgagccactgcacccggtctaaaacactattttgatggttaactctttctacatttggccattaagaggccctttaagctgatttgtatgtcttttttggaatggcagggtggtttactagcctggtgatctatttgtgtcctttcagtttccggcctgaacttgtcttttttttgaaatatttattttggtagaattgacaaataaaaattattatgtatttaaggtgaacaacttgatgttttgatatacatacatattttggaatgatcactgtgataaaggtaatgaacatattcatcacctcacatagttacctttttttttgtggtgagaacacttaagatatagtctcttagaaaaaaatcacctatacaatacacaacacaatgttattaactatagtcaccatgctgtgcattagatctccagaacttattcatcttatataactgaaactttgtatgctttatctaacatcgccctatttccccttcccctgagcccctggcagccaccattttattctctgcttttgtaagtttgactcttttcattttacatataagtgagatcatgtagtatttgcttttctgtgcctggcttatttcatttagcataatgtcatccagatttatccatatagtttcaaatgagacaatttccttttcttttaaggctgtggtatgggttcaatgtttgacgccacccgccccccaccccccaaccaaatctcatgttgaaatttcatccctaatgttggaggtggggcttagtgggaggtgtttgcatcatgaaggtgatgaaggcagatctctcatgaatggcttggtgcagtcctcatggtaatgagtgagttctctctattagttcctgctagagctggttatttaaaagagcctgtcatctccctctgctctctgtcttgcttccactctctagccatgtgatttctgcgcaggctagcttctctttgccttctaccatgagtggaagcagcctgaagccctcatcagaagcagatactggcaccaccttgtacagcctgcaaaaccgttaatcaaataaacctcgttttaaaataaattaccctaggagtgacagaaaatgtgaaaaaaagttactcttcctcaggtattcctttatagtgacacaaactgactaaggccgatatgggtgtgtgtgtgtgtatatagatacatacatatatatacgtatatacaatatcctgtgtgtgtgtgtatatatacataccacattttgtatatacatgcatatgtatatcctgtgtgtgtgtatatacataccatattttctttatccatttatccatcaacaggtattaggttgtttccatatcttgggtattgtgaataatgctgcaatgaatatgtgagtgcagatatctcaaaatcctgattttagttcctttgcatacatacagttagccctctgtgaccctgggttccacatccatgtatttaaccaactggggattgaaaatacttgggaaaaaaggatggttgcatctgtaccaaacatgtagatacttttttcctactactttcctattcctacctaatacagttgttatactgtattatttatattattccctaaataatacagtataacaactatttacatagcatattcattgtattagatattataagtaatctagagatgatgtaaagtatataggaggatgtttgtaggttatatgcaaatactatgccattttatataagggacttgagtatctgtggattttggtatccacagagggtcctggaacaaatccccagcagatactgaaagatgactgtacctagaagtgaaatggctatatcatatagtagttttattattttttattaaccttcctactattttgcataatgattgtacagatttacattgccaacagtgtacaagggctcccttttctccattcctcaatgacacattatcttttgactttttgataatagtcatacaaacaggtgtgaggtgatgtcccatcgtggtgttgatttgaatttttctgatgattagtgtattagttcgttctcacattgctataaagaactaccagagactgggtaatttataaagaaaagaggtttaattggctcacggttctacaggctgtacaggaagcaaggcttggggtggcaggggctctggaaacttacaatcatggcagatggtgaaggggaagctggcgcatcctacatggctggagcagaaggaagagagagtgaagggggaagtgctacacactttcaaacaactaaatctcatgagaactcattatcatgacaacagcaaaagggaaatccacccctatgatccaatcacctcccaccaggcctctcccccaacactgggggttacaattcaacaagagatttgggtggggacacagagccaaaccatatcaattagtaatgttcaacactttttcatacacctgttggccatttgtatattttctttgaagaaatggtctattcagatcatttgcccatttttaaattgagctatctggtttttgttttgttttgttttgttttttgttttgctattgagttgtatgagttccttacatatcttgcacattaattcctcatcagatatatggtttgcaaatattttgtctcattttgtaggatgctttttcactctgttgatggggtttctttgctgtgcagaagcattttagtttgatgcaatcccacttgtctatttttgtttttggtgcctgtgctattagagtcatatacaaaaactcattgccaggatgaatgtcaagaagcttttcccttgttttcttctaaaagttttacggtttcaggtattaagtctgatatggcttggatatttgtccctcagaatctcatgttgaagcgtaatctccaatgttggaggtggggcctggtgggaggtgattggatcatgggggaggatcccttatgaatagcttggtgctattcctcacaatagtaagtgagttctcactcagagttcacacgagatcttgttgtttagaaaagtgtgtggcacctccctcctcactgtcttgctcccgttcttgccatgggacatgtttactcccctttgccttcctgaggctctcaccagaagctggccatgattataagcttcctgaggccctcatcagaagctgagaagctgttggtgccattcttgtacagcctgcagaaccatgagccaattaataaacctcttttctttataaattacttagtctcaagtatttctttatagcaatgcgagaacagcctaatacaaagtctttaacttattctgagttgatttttgtatacagtgtgatataagggtccaatttcattattttgcatgttgatatccatcaacactgactgaagagactgtcttttcttcattgtgtgttcttggcactcatgttgaagatcagttgcctgtgaatgtgtggatttatttctggctcttctattctattccattagtgtatatgtttgttcttattctagtaccatactgttttgattactatagctttgtaataaattttgaaatgaggaagcatgatgctcctgggtttgtacttcttgcgcaagatttctttggctatttggattcttttatgattttatatgaattttaggattgtttttcctatctgtaaagaatgccattcagattttgatagtattacattgaatctgtagatcattttaggtagtatggacattttaacaatattaattattccaatctgtgaatgtgggatgtatttccatttatctatgtgccctttaatttccttcattgatgctttacaattttcaatgtagaagtctttcacctctttaagtttattgctaagtattttgttttttgttgttattgtaagtggattgttttcttaattttcttcttggatagtttgtttttagtgtatagaaacgtcactgatacttgtatgttgattttgtatcatgttactttaatttgtttattagttctaacttttttttggttgagtttttaggattctcgaaatatatgatcatgtcattggcaagcacagatgattttacccttccttctcatttgggtgcttttttctttttctttcctaattgctgttgctgggacttctagtactatgttgaatagaagtgttgagggatgggcttccttgccttgtactagatcgtggaggaaaagctttcagtttttcccatcaattatgatgttagctgtgggcttttcatttatggccctttgtattgagttatgttcctcgtatacctattttgttgagagtgttcagtttaatggatgttgaattttgtcaaatgctttttctgcatctattgagataatcatgtggttttaatctttcattttgttaatatagtatatatcacattgattttcacgtgttgaaccatgcttgcattccagggataaatctcactggattgtggtgtatgatccttttaatatccttgttggattcagtttcttagtattttatcgaggatttttgcatctgtgttcatcagggaaattggcctgcagttttcttctggtgtccttgtcttgctttggtatcagagtaatgctgatttcataaaatgaatttggaaatattccctcttcttttattttttggaagagtttgagaaggattgatattaattcttctttgaatgtttggtagaatacaccagagaagccatttagtactgggatttttttttctggggcattttaaaattattgattcaatctctttatttgttattggtctattgtttctatttcttcttggttcagtgttgttaggctgcatgtttctaagactttagaagtaatcacctcttgcagacattgtggactggttttggtagggaaaaaccttcacctgtgggtgtgtgcaggtgtgctagattggtgaggtgtgtggtggtgctggttctggatgcatgcaagaatgctaatcccagggatatgtggtggttctagggctagggagtgcgtggtgccaccagctcaaagggggatgcttgagatcaccttgggggagcagtatcacaggctccaggtgcattggttgtgggctttgggtggctccagcagctgaggtccactttggcaaagactgtgggggtcctccactctgaaggctgaaatagtcctcagtggaaggcttctggaattttcctgttctccttttccttcactttggaactcatagctgaaggaatacctctaagtattgagctaccctggcctagggcatggggtgatgcaggcaaaataaaactgttctgttcttcctactgttttctatgtggttatcctcagattttgtgttccagtgggttgcttcagcttcttcttcttctttttctttttttcaagacagggtctcaccttgtcacccagactggagtgcagtggtgcaaaagcggctcactgcagcctggacctcctgggctcaagtgatcctcccacctcagccagccccacctccctcctgtgtagctgggattccaggcgcgcgtcaccacgcctggataatttttgtattttttatagagatggggtttcgccatgttgccctggctggacttgatctcctgggtttaagtgatccgcccacctcggccttccaaagtgctgggattacaggctctggagctctctgagagctgtttttgcctgtatatagttgttaaatcattgcttttgtggagacactagggctgggagctcttagtctgccatcttgctggtgttacttgacttctatgtgttttttacgtgttgccattacttttgagcacgtcattcctttcgggcacaataaaatattacaggcttattttgtattcctttcctttccttttttttcctttctttttcattcctttccttccttttcctttcctttcttttcctttttcctctttccttttttgagacagggtctcactctgtcacccaggctggagtgcagtgatgtgatctcactctctctgtcacctaggctgagtcacccaggctggagtgcagcggcatgatcttggctcactgcaactactgccacctgggttcaaggggttctcctgcctcagcctcctgagtagctgccattacaggcgtgtcccaccacgcccggctaatttttgtatttttagctcactgcagcctcgatttcccgggctcaagcaatcttcccacctcagccttctgggactacaggcacgtgtgtgctttcttgatcaagccatgaaattaactatgtatctcaggagaccttatttattttagtagaaaatcttatttagaagccaagatctgggcattacgcatccttattgcttttgggatgtcactgctctctcagaccctcacagtggaaagagcatatgtgtgtgtgtgtgtgtgtgtgtgtgtgtgtgtatatatatatgtgtgtgtgtgtgtatgtgtatgtgtatataaatatgtgtgtgtgtatgtatatatatctatattatatacactcatacatttccattacatttatctatattatttattatctatctatcttctatcatctctaatatactgaaaaccatgatatcgtctgtttcaatccaacaacaaaatattcatcctaattttctcccttttcatgtttctaattctcttctccaacaacaaaaaacttggcttcaattatccttaatgtatttatgtatttaatcagtacccctgtatgttaccagtcttccatattctctgccactctattcactgtgaggatgccctcttctccatgctcattctctgattcttcattttgggtttctttccctgggtgcttaccctcttccttctactctgactccctttaccttaccattatttcatgtctatgttctctcaccctatttgggctctgaatctacatgctcatctcctggatggaagaataatactttttttttttttttgagacagagtctcactcactctgtcacccaggctggagtgcagtggcacgatcttggctcactgcaactgccgcctcccaggttcaagcgattgtcctgcctcagcctcctgagtagctgggattacagacatgacccattgtgcctggctaatttttgtatttttagtagggctgggggttttaccatgttggccaggctggtctcaaactcctgacctcaagtgatctgcctgcctcagcctcccaaaatgctgggattacaggcaagataatactttcttatactagactgattgcatagaatcttatcggggagaccactcagtcctcagaatctctgtccccctggaaaattatagaactataaaaataaattttaaaaatacctgttattcaagtggccactgctataggaagagaaagtacataaaaaatggatgccagtcatggagtaatgggtgatgacatcagtatgcctctaatcctattggagactattattctaagcgaagtaactcaggaatggaaaaccaaacatcgtatgttctcactcataagtgggagctaagatgtgaggatgcaaaggcataagaatgacacagtggactttggggactcagggggaaagggtgggaaggggatgagggataaaagactacaaactgggtgcagtttatactactcggttgatgggtacaccaaaatctcacaaatcaccaccaaagaacttactcatgtaaacaaacaccacctgttctccaataacctatggaaataaaaagttaaaaaaattaaataaaattttaaaaagatgtccttaatacttttaagatgattttgtgaagtcctaaaaaatcaaaaccaaaaaacatactcttaagcaagtcaaatctaattaacttctattttaaagtaaatatatgccacacagcacttgtagaagtttgacagaagcgtgaaatcaagcgatgaaatggatagcaatgcagtagtccccccttatccgtgggggacatgttccaagatgtccagtggatacctgaaactgcggatagtaccaaatcctatatatactatgttttttcgtatatatacatacctctgataaattttaatttataaattgacactgtaagaaatgaatactactaataaaatagaataattataacaatatcctataataaaatttatgtgaatgtgatctctctctcttttaaaataccttattttattatactcacccttctttccttgggtaaccgaagccatggcaggagggaaaaccatggatggggggaactactgtaatggtttagtgtccagcttctataagtttatagtaataaatgtattaactggaataactaggacacagtaatgttttatttaatggaacttcctgatttagtgagagttagaaaattcttatattttgaacatttattttaaaaaatgtttgcatatacttacttttataagtggaacatagggattctttctttgatatttgagactcttgtaattaattactcaagacaatgctcatgatctgtgtacagccttgtaggaggagctactcattagtatcgctagttgtgagacatttcactgctttgaaaatcagtattctcatctgtaaagtgagagtgtatgacaacatggtctcaaagatcacttcagtgtaaaaattcctagtcctcaatttagggaagccctgagccatagtgcagagggtatgtgttcctatgtatgtattttttataataaaattctctgggagcagcttgtttacttaattctttacctctttctcctgttaatcagaattttattttgagtagtttgtatgctttggcttgctttgttatcttttatttctatctttagtttcttctagaagttatcttatgtatagagttttacttcattgtgaagcttttatttatgcaaaggaaatggccaattgatgtctgaaactctttgaagtaattcgttcaagattcagctagatttcattgctgctctgtgggacacaaagcttctaaatgaggtctaggttgcttactctattacaattcttttattctcttttgcctaaatttaccattttgtagccaaatatttgaaagataacgtgtaaatattctgtacatttctctctgtagtaacattgaatctcttggcacataaatgaattactccttttgatgtaaaactcagttttctgcctattatgggctagtaggcatatatttgctttctgtagacctttctgcccactgctttacgtatctgggagagcctaatcacttaaggttatctagtttcattccaaactcaaaatcatttgagccttaaaaatgactcactggtttttgtcaggtttgtcaaagatcggatggttgtagatgtgtggtattatttctgagggctctgttctgttccattggtctgtatctctgttttggtaccagtaccatgctgttttggttactgtagccttgtagtatagtttgaagtcaggtggtgtgatgctttcaactttgttcttttggctgaggactgacttggcaatgcgggctcttttttggttccatatgaactttaaagtagttttttccaattctgtgaagaaagtcattggtagcttgatggggatggcattgaatctataaattaccttgggcagtatgaccattttcatgatattgattattcctatccatgagcatggaatgtgttcttccatttgtttgtgtcctcttatgtttcactgagcagtgatttgtagttctccttgtagaggtccttcacatcccttgtaagttggattcttaggtattttattctctttgaaggaattgtgaatgggagttcactcatgatttggctctctgtttgtctgttattggtgtataagaatgcttgtgatttttgcacattgattttgtatcctgagactttactgaagttgcttatcagcttaaggagattttgggctgagacgatggggttttctagatatacaatcatgtcatctgcaaacagggacaatttgacttcctcttttcctaattggataccctttatttctttctcctgcctgattgccctggccagaacttccaacactatgttgaataggagtggtgagagagggcatccctctcttgtgccagttttcaaagggaatgcttccagtgtttgcccattcagtatgatattggctgtgggtttgtcataaatagctcttattatttcaagatacatcccatcaatacctaatttattgagagtttttagcatgaagggctgttgaattttgtcaaaggccttttctgcatctattgagataatcatgtggtttttgtctttggttctgtttatatgctggattacattcattgatttgcgtatgttgaaccagccttgcatcccagggatgaagcccacttgatcatgatagataagcttttggatgtgctgctggatttggtttgccagtattttattgaggatttttgcattgatgttcctcagggttattggtctaaaattctcttttttttgttgtgtctctgccaggctttggtatcaggatgatgctggcctcatgaaatgagttagggaggattccttctttttctattgattgaaatggtttcagaaggaatggtaccagctcctccttgtacctctggtagaattcagctgtgactccgtctggtcctggactttttttggttggtaggctattaattattgcctcaattttagagcctgttattggtctattcagagattcaacttcttcctggtgtagttttgggagagtgtatatgttgaggaatttatccatttcttctagattttctagtttatttgcgtagaggtatttatagtattctctgatggtagtttgtatttctgtgggatcggtggtgatatcccctttatcattttttattgcatctatttgattcttctctcttttcttctttattagccttgctagcgatctatcaattttgttgatcttttcaaaaaaccagctcctggattcattaattttttgaagggttttttgtgtctctatctccttcggttccctatttaataaatggtgctgggaaaactggccagccatatgtagaaagctgaaactggatcccttccttacaccgtatgcaaaaattaattcaagggccaggcgcggtggctcatgcctgtaatcccagcactttgggaggccgagacgggcagatcacgaggtcaggagatcgagaccatcctggctaacacggtgaaaccccgtgtctactgaaaatacaaaaaattagccggcctggtggtgggtgcgcctgtagtcccagctactcagaaggctgaggcaggagaatgatgtgaacccaagaggcggagcttgcagtgagcggagatcgtgcgccactgtaatctagcctgggtgacagagtgagactccgtctcaaaaaaaaaaaaattaattcaagatggattaaagacttaaatattagtcctaaaaccatgaaaacctagaatggtattgcctagaagaaaacctaggcaataccattcaggacataggcatgggcaaggacttcatgtctaaaacgccaaaaacaatggcaacaaaagccaaaactgacaaatgggatctaattaaactaaagagcttctgcacagcaaaataaactaccatcagagtgaacaggcagcgtacagaatgggagaaaatttttgcaatctacttatctgacaaagggcaaatacccagaatctacaaagaactcaaacaaatttacaagaaataaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcagggatcttgaactagaaataccatttgacccagccatcccattactgggtatatacccaaaagattataaatcatgctgctataaagacacatgctgacatatgtttattgcggcactattcacaatagcaaagacttggaaccaacccaaatgtccatcagtgatagtctggattaagaaaatatggcacatatacaccatgaaatactatgcagccatagaaaaggatgagttcatgtcctttgcagggacatgggtgaagctggaaaccatcattctcagcaaactgtcacaaagacaaaaaaccaaacactgcatgttctcactcataggtgagaattgaacaatgagaacacttggacacaggaaggggaacatcagacgctggggcctgttgtggggtgggggcaggggggagggatcgcattaggagatatacctaatgtaaatgatgagttaatgggtgcagcacaccaacatggcacatgtatgcatatgtagcaaacatgcacgttgtgcacatgtaccctagaacttaaagtataataaaaaaattttaaaaaatgactcattggaatatttgtaacgacatgttctgtaaattttaagtgagtcatatacttttaaactaaatatctacggtatatggaaagcttggttagatttgtccatgttttgaggctctttatgtagccattagaacatttattattcattctaacaaataccaatgttgatttttagctcaggttgtcactgttattttttaaagtatggggtttactttttttttttaatactttaagttctgggataaatgtgcagaatgtgcaggtttgttacatagatgtacacgtgccatggtggtttgctgcatccattaacccgtcatctacattaggtatttctcctaatgctatccctcccatacctcctcacccctcaacaggccccagtgtatgatgttcccctccctgtgtccatgtgttctcattgttcagctcccacttatgagtgagaacatgcggtgtttggttttctgttcctgtgtcaggttgctgagaatgatggttttcagcttcatccatgtccctgcaaagaacatgaactcattcttttttatggctgcatagtattccatggtgtatatgtgccacattttctttatccagtctatcattgatgggcatttgggttggttccaagtctttgctattgtgaacagtgttgaaataaacatacgtgtgtatgtgtctttatgatagaatgatttataatcttttggctatatacccagtaatgggattgctgggtcaaatagtatttctggttctagatctttgaggaatcaccacactgtcttccacaatggttgaactaatttacacccccaccaacagtggaaaagcgttcctatttctccacatcctctccagcatctgttgtttcctgactttttaatgatcaccattttaactgtcgtgagatggtatctcattgtggttttgatttgcatttctctgatggccagtgatgatgagcattttttcatgtgtttgttggtcgcataaatgtcttcttttgagaagtgtctgttcatattactttttaatgcctacttgttgcatgtaattcttttttatcagtgtgtatctatacatagtttaaagagtaaaataagtttacaggtctttttacaaaatcaccagtacctatgaaaaattagccaggcttggtggcgggtgcctgtaattttggctattcgggtggctgaggcacgagaatgggttgaacctcggaggcagaggttgcagtgagccgagaacgcaccactgcactccagcctgggcgacggagtgactctatctcaaaaaacaaaacaaaactaaccccgaaaaaccaagatcaccagtacccatcctgacttttggacttatttttatctcacgtaacagctactttcagttattttagttggctctttttgtatttacctccatgtatctacatagtgttcttatactgctgtgctgcttgatttttttacttttagatattatatattgacttcccactttagaaggtgaatttagtttcttttctttttccctctacccccaacacatatgctcacttcctgtcactccatcatctctatatagtttaccataactttggttagattaatatttagtgtttacactccagtgtttatatgaatactatcatagttgaatcatataaagtaccatgattacttttcttttcttttcttgcacaaaagtttgtttttccctggagttaattatattggttttcctgactacttagtatttcatgtacttggtattgtttcttccctaattatgtaaacttctttttagtatgttagaatgtattagttattttatcactttcacttgcttaaagaaataactgtcatagtttctgatcttctcttatctgtacagattgttgtgtaagcatcctgttcagttatcgttttgagattttcctcctccattgacttgggaattcctttcaactccctcatagattgtaaccctgtttcttgaatcctgtgtctttctttttctgattttactccctaaattttgtggggcatatcctccagtagcttcttgagaaaggttgcatgaaatgaaaattgtttgaagagtttgcatgtctaaacatatttttattgtaccatcataatttatgctttcactggatataaaatttggacttggaaataatttttcctgagtattttgaaaacatcagttagattctcatctagcttctgatttgactactgagaaatgtgttgcaattttattttcttttactttttttaaatataaaatttttacttttgtgggtatatgatagatgtatctatttatggggtacattaaggttttgatgtaagcatgcaattgataataatcacgtcatggaaaatggagtattcatcccttcaggcatttatcctttgtgttacaaacaatccaactgaactatgttagttatttttaaatgtatattatttatataataataataattattattattttgagatggaatctctctctgttgcccaggctggagtgcggtggcatgatctcagctcactgcaacctctgccttccgggttcaagcgattctcctgcctcagccacccaagtagctgggattacaggtgcccaccaccacgcccaactaatttttctatttttagtagagacagagtttcaccatgttggccaggctggtctcaaactcctgacctcaagtgacccacccaccttggcctcccaaagtgctgggatttcaggcttgagccacggtgcccagcttaaaatttataattaaattattattgaccatagtcactctgtagtgctatcaaatacttggtcttattcattcattcttttttttttttttttttttttttttttttttttttgagacagagtctcactctgtcatccaggctggagtgagtgcagtggcacgatctcggcttactgcaacctccgcctcctgggttcaagagattgtcctgcctcagcctcctgagtagcccggattacaggcacctgccaccacgcctggctaatttttgtatttttagtggagacggggtttcgccatgttggccaggctgatcttgaactcctggcctcaagtgatccacctgtcttggtctctcaaagcgctcggattacaggtgtgagccaccgtgcctggcctattctttattttagattcaaatatatagtaggtctaatgtgctcagacatgcatattgaacttctgctatgtgaatgtactgtaattcaaagggaaacttttttgaagcaagacaggtctttatacattacttatgaataacttgcttcagatcttggattcttagttgaggatctgcttctgtagtcttactcgggtaaaacttataaaagactttttatatgggtataatcaaattctctagataggtggtttctataaatgctgaggggatatttggataaattattagcatcaaaatttctcctatgccatttcccagtattttgagagatgaaaattatgtaaaacatggcattaatgcagggactgagatgctgattcctaaggcaacattcatatacttgttcctactttcatctcaatgctaatttatgtaaagaaaatgattgttgatgctaaagagtgtccatgaaactatttctaaatacgtcttttgactagatagtgctttggacacattttagaacttcagaatttttagaattgtctcaattttgaaaaaaaaaaatcattcatttcccaacctcactcctcgtcaatagtgattttttgtctttgaatatactccctgctctagtgcctttaactggatctggcaaccaaaagcagggttttagcctgccctttggctgggcaatgattgggtttctcatttcctgttacaaagcatcttttaacttctattagtaatttattgtaatactttttcatacataactaattctccaacctgaatgttttgcagttcttctttatacaaattgagaagttttgataaggaagcttattttgatgtataggacacattaagtatgtttttgtttgtttgttttttgagacggagttttgctctgtctcctaggctggagtgatgtggcaccgtcatggctcactgccacctcggcctcccaaagtgtgttgggatttaaggaaatcatgaatctaatgcattttttttatattgcagacttcaagtcttcatcatctctgttacaactttggagtagaaacccagaagaataataaatatgaagaaagttctttctggcttaggtaacataaacaaaaaactgaatgtaaactcgggaatattatcatagatgtcagttaatatttactgtagagtactttggcagtttaaaccttctctgacttcagaagccaacatgctatatttatttactcttttaacatgtattgtttattattcttacacattgtcagttcatagaaaaatgtgttcttccttccttccttcattctttctttcttttttcctttctttctttttttcttcttttttttttcgtatctctctctgtcacctaggctggagtgcaatggcatgatctctgctcactgcaacctctgccttctgggctcaagcgatcctctgacctcagccttccaagtagctgggaccacaggcatgtgccagcatgcgtggctaatttttaatatctttggtagagaaggggtttcgccatgttgcccaggctgttctcaaactcttgagctcaggcaatccacctgcctcggtctctcaacgtgctgggattacaggcgtgagccaccacgcctgaccagtgttctcttcttaatataagagcttactcctctctcttcattcctcctttatatctctatcaagagtatagaaaattttgttgttgttgctttgatacttattgttgtctggcaacaccagagtataaggtggaggtgtgattgggagtagtattggctaaaattattagtcttagatgaattttggcattttaatatcagtcaagtaagtatatatttaacgctgtatgctgagtactatactaagatttggagtgttgtgctttatctggaaatatcaagaaaattatacaaaaatataggaaatgtgcaagaaccctttctttcactgaaaacctaggcccagcacagattctgacacacagtagatactcaataattgttagttaaatgaatatatgtgaaaaatgtatttttgtggagatgtcacataaggtgcagtgctttgaatatcaggagattatggaggaggctgggcatggtggctcacacctgtaatcccagcactttgggaggccaaggtgggcagatcacctgaggtcaggagttcaagaccagcctggccaacatggcaaaaccccatctctactaaaaatacaaaaattaggcgggtgtggtggcacaggcctgtaatcccagctactcgggaggctgaggcaggagaatcgcttgaaccagggagatgcagcttgcagtgagccgatatcgcaccgctgcactccagcctgagcgacagagagactccgtctcaaaaaaaaaaaaaagaaaaaaaaatggatcatggagtaaaatatatcaaatcaattcactaaatgtttaccctttctgagtgcaggattagttctagttatttggggatactcctatgattaactatagtctaacttttgtgaatatgatgtttgtcatttaacaaaataaatacaaatctgggcactgagattataatactcagacatatctatcactagcaaaatgttgatgcaaatgacttatataagagactttttaaagcccaaagattgatcaaactctatataaagaactattcctaatagaacaggctggagttctattccagtatttgacagtatttgggagtagaacactcacaaagtttatggcatcaatgtatcaaaagaccagtatgccaagaaggcaggaatagggagatccaaaaaaaaaaaaaaaaaaaaaaaggatgctggtgccatggatggcttctggaagcttaagactagatgtgagcttggagtttatgccaagaatgagggtgagttaggagtcataaaaataaatgttctctaggaactggtcataacagtaggttgaggcctgacatggcatgacttgtaggttatttgcacatacgccattggtttttgacttcttatctgttatcattttctaaagaatctcatggaaagaaaatatgttgatgagacatccatattataaactagaatatcttagcggctatatttgtaggaatataatctgacccacaatgatattttcataaaaatctaaataaataacaaatttatatagcaccagtatgagtcttttgtgttcacatcactagaataatattgaagaaaagaagaaaaactttaattttagccctagtaattacatatgattttaatctttctgcttcattttttcttgcacatcttttgggaatataaaaataacctggtgaaatattcacaaatgttttaaaaggaattatcatattttaatgtctaaaaagaggcaaaaataattatcagtattattaactgtaggaattgtagcacagtgaatagtttttctaacagtagactgactgtcagaatttgttgtcatctaagaccttagtgttaaattgttaaatattgtgatactttatttagaattgttgtggggtttacatatgataatgcatgtattatagagtattcagtaacatgcctggaaaacagaaactgcttaacaaacggaaaatgctgctactatctctacgtgatgtttgctatttattagagatggactctcttgtggccattccactagtttattctaaaatgtatcacagtcggatcaagcatggattacttactaagttcccaaataaaatgtcataaaaacaaacatctacatctttaaatctttggaacaattaaaaaaaaaaaacattgtttttttgtagaggcggagcctcgctatataaaccacggtggtctcaaactctggcctaaagttatcctcccacgtcagcttcccaaactgctggaattacaggtgtgagccactgcgcctgaccctttggaataatttcttcatgctttatatccacatgttaaaaaaactgttggcagcagttggtgatgcaagcagagatgaatagctgctaattaagcaccgttttctgtaaattttataccagaaggaggtcatggaaaatgagtacacattctacaggcttaactcttttgagaacagtgaatatcttagactagaggttatatataatttggaagtacccattcagtctaaaagtaaaaacctcatttttcacaaatgataatatataaaaatgctgtagtatattcgaatttttttgaaattgaagcctagagcaatactaaacgtaaagagtggtagtgggtattgtttaaaaagctcatttatttcccttgatttttgttaacatctcagtgcaggacctttctgagtttttatcaccctcctgccttttcttttgctaagaaaagttcataaatagctgctgctctccttgctttctgccacactcttttgatcgtgttcccttagagataccacaggttaagagaaagctgctgtaattatgaatgaaattaaaattccttcagctcgctttactgtggattgtcaacgtatttgcctcaatgtattaaatgacaaattctcttagacctttataaaatacaaaatttcagatttttgaaatccgaatgcaaggtttggaaataatatatttaagagtttttttgtttgtttgtttaataaaataccattttttcctccttctcctcctctttcgtaagtcttgcagtactgagctcctatgtctgctcctggcagaaggcagggctaagtagatgagaagagattgttgatagagaaatttccctcacaatctagacaacttgttagtggcctccattgttctggtggaatttaaattgtgtttagctcttaaagtcctatctaatgattaggacatatattatgctgaacttggcttttcagaaaaggtatacagaaatttcattgtaacaaatttgtattctacaaagaagaattgcatattaacacaaataagttcaactcaaaaggctttagggttacatttattaaccagaaagacttcgcagatttttttccctgggagaaaaatgctctactttccaaaccttagtcatattcttaattctgggtgatttttcatttatctctagtagttttatttctaagtcatttaactgtattccttggcactgctgacctacagcaatatcagacatctctgtggctgataaacacttgagaagctcactattttccttttgaagtaagaagacctcctactactttcttttcccctcaagcttcgttgaggtataattgacaaattaaaattgtatgtatttaatagtgtacaatgtgatgttttgatatatatatatacactgtgaaatgattactacgatcaagttgattatcatatccatcacctcacatagttaccatttttttctcacatgtcattataacagaattttattagtaatcatcaaacacacattgttcaaatttcactgattgtctcataaaatcttatacaattgatttgtcaaggcctatatactgtgattgattaaggtgtctcttatgtctactttaatcctaggtttcttcctttttttccttgcaatgtatttgttaaagaagtcaggtagcttcctgcattttgaattttgctgtttgtgcccctgttccttaacatgtttattttttctgtgttctctgtatttcctacaaattagtaattaagattctaaaggctcttaccagattttttggcagaagtatttcacaggtggtgtggtgtatgtccatcaggggtcttgtatgttagttgttttgttttttgcgatattagcagccatcagtgatcattgcctggattctttatttcatcagtgtttgtaaaataatagtattctaattgtgtcattttacttttcctttatgagctggaatacttctctagagtacaacttcccttagcaactgttagattactctgaggtccaattgtctgagttgccttttttttgtgtgtgtggtgagaatatttaatatctactctcagcaaatttcaagtgtacaatgcagtattatgaactatagttaccaagctgtacactagatctccttttaagaaagagagaagaaagaaagaaagaaagaaagaaagaaagaaagaaagaaagaaagaaagaaagaaagaaaataaaagaaaagaaggaaaagaaagaaaagaaaggaaagaaaggaaaaagagagcattcatggagacaatgccccaaagaaatcagaaattttcaaatggataactcctttgaagaaggaatgagattcctgtaatggctgcttcctggaaggcagtgtcatgtggaaccccttagcctcagcatccagagctccaggaagggaacatttccagtcaggtagaattatatatatactatttctttggaaacttcagccatcaagattcagccatcaaaattccaccatcatgacttctgtttcaacacaatggctcttagtcctcattttactgcttttgttgctgcctgttgttgaagcagtagaagccagaaatgcaattgctgtcatgttgggtgtggttctcagcattacaggcatttgtgcttgcttgggggtatgtgcacaaaagagaaatggacagatatgactttgaagggcatcccaaatcaaactttgccctgaaaacctttggactagtgaggctaaacttgagctttggtgtttgaaaatttccaagaaacagtaaataggggagttccacattcttagttgttttccataaaatgagagcaaattgctatgtataagaaaaaatgttttccttacaataaataatgcactgaaaaattaagcctataatttgtatttgctgcttagaaagggggttcaagaagtaagatggttgacatttacataagtaatatttcatagttttctaattatctaagctgggcatggtggcatgcgcctgtagtcccagctacttgaaaggctgaggtgggaggatcacttgaacccaggaggtcgaggctgcagtgagtcatcatcacaccactgcagtacagccttggtgacagagtgagatcttgtctcaaaaaaaaaaaaaaaaaaaaaaagcacatgaaataggaagaaggaagttcttgcccagaatcctaagaaatcaccactgttcagttataatcactgcctcctgaatcattgaggagtcttttctccatattttcattagacttttgttattgcccaagttaatattgtatttaaatatcaaatagccaaacatagatgcttttatctctggagaaaaaacatttagaaaaatgcattcagtgtatctaacattgaagtggagaaaagagttaatgtaaaaaaatcctttatttttatatttatcattttaaacttttattttaggtttggggtacatgtgaaagtttgttacataggtaaactcatgtcatgggagtttgttgtacagattatttcatcacccaggtattaagcccagtacccaatagttatattttttactcctctccctcctcccaccctccaccctcaagtagacctcagtatctattgttctcttctttgtgttcatgagttcgcatcatttagctcccacttacaagtgagaacatgtggtacttggtttgctttaaaaaaacactttatatttacattgaaatggagaagatatttaatgttaaaaaactttatattaattaattgagtaacatccccatggggagaagtactatattaaatataaactcattatgttgttaaaaaaaaaagaagggacgaaatgatgttgaagatgaaacctgcagcagcaggctgtacacaacaatttgtgaggaaaaaattaatcgtttgtgctctaattgaagaggagtgatgattaatagtacaaataatagccaacaccatagacatctcaatttgttctgcttatacaaatctgactgaaaaaattgaagtggagcaaactcaatgggtgccaaaaccattgtgcccagatcagcggcagataagagcagagctttcattggaaattttaaacaagtgggatcaaaatcctgaagcatttcttcaaagaattgtaacaagagatgaacatggctttaccagtatgatcccaaagagaaattacaataaaagcagtggctaccaagaagtggaagtggtctagtcaaagcaaaagcagctctgtcaagagtaaagatcatagcaacagttttttgggatgctcaaggcattttgcctggtgatttttctggagggccaaagaatgataatgtctgcttattatgagagttttttcagaaagccaaaattttagcaggaaaatgcctgaaaagcttcaccagtgtccttcaccacaacaatgttcctgctcattcctgtcatcaaacaaaagtaatcttgtgaatttcaatggaaaaacattaggcatccaccttacagacatgatttggctccttctgacttctttttgtttcctaatcttaaaaaatctgtaaaaggcacccatttttcctcagttaatgtgaaatgtgaaaaagattgcattgacatagctaaattcctcagttctttatggatggactaaatggctagtatcacaaaggtatcttaaacttgatggagcttatgttgataaataaaatttatattttaatcttttaattccatttttccaaaagttttttgaggtctcataatattctgcaattccacaggctgtctcttcactctgttaattgtttcctttgcagttgtacatggtatttagttagatgtaattccatttgtctatttttgtttttgttgtctgtactttgggggtcatatctaaaaaataatttcccatacaatatcaataagctttcccccagttttcttctagtaattttacagtttctggtcttacatttaagtctgtaatccatttttaattgattttttgcataaggtgggagataaggttccaattttattcttctgtatgtggatatccaggtttttccaacaccatttattggagaaactctcttttccccattgtatgttcttggcaactttgttgatcatcagttgcccataaatatgtggattttgttctagatattctattctattccattggtctgtatgtctttttaaaatgtccataccatgctgttttaatgactattagatgtctagtgtattttgaaatcaggaaatgtgatggctccagctttgttctttttgctcaagattgctttggctatttaggtcttttgtgattccatataaatttgaggattattttttctgcttctgtgaaaatgccattgtcatgttgacagggataagactgaatctgtagaatgctttaggtagtatggacatttaaaaatattaagtcttccaatctatgaacacaggatatctgtccctttatttgtgttttcttcaatttctttcttcagtgttttatagttttcagtgtgcaagtctttcacctccttggttaaatttactcataagtattttattttttgacactattataaatgggattgttttcttaatttttgggtatagttcattgtttgcatataaaagctactgatttttatgttgattttgtgatttgcaactttattgaatttattagttctgacagttttttggtagcattttaaggttttctaatataagattatgtcatctgcaaacaattttacttcttcctttcaaatttgaatgcctttccccccccctcatcttgcctaattgctctggctaagacttctagtacaatgttgaatagaagtggtgagagtgggcatctttgctttgcttttttcctatgttagaggaaatgttttaacctttttaccatctagtatgatgttaactgtggacttgttgcatgatttttattatgatgaggtacattccttctattcctaattttttgaaatttttttttaatcttgaaaggatgaattttgtaacagaagatttttctgcatctatcaagatgactatatgatttttatcctttattctgttcaaatggtgtatcacatttattgatttttatatgctgaaccacccccaccctcatatctgaggaataaatcctagttgatcgtgctgtatttggtttgctagtattttgttaaggattttttcatctgtgttcatcagggatagtttttttgtcatgtccttgtctggctttgatattagggtaatgctggcctcatagaatgagtgtggataggttctttcctcttcatttttagggaagagtttgagaaggattggcgttaagtttttcttaaatatttagtagaattcaccagtgaaggcatttggccctgtgttttccttggttgtgagatttttgattactgattcagtcaccttaacattattttatgtttctgtgtttgttaacttaaggcctccagctgcatccgtgttgctgcataggacatgatttcattctttttaaatggctacatagtatttcatggtgtatatgtaccacatttaccttatgcattctgccattgatgggcagcaaggttggttccatgtctttactattgtgaatagtgctgcaatgaacatacaggtgcatgtgtctttttggtacaacaatttgttttcttttggctgtatccccagtaatgaaattgtggaatcaaatagtagttctgttttaagttctttgagaaatctccaaactgctttccacagtggctgaactaatttacatccccaccaacagtgtaaaagaattcccttttctctgcagcccagctaacacctgttattctttgactttttaataaaaaccacttcgactggtgtgagatggtatctcattgtggttttgatttgcatttctctgatgactagtgatgctgagcattttttcatatgtttgttgaccacttgtatgtcttcttttgagaattgtctgttcatgtctttttaacccccactttttaatggggttatattttgcttgttgaattatttaaattccttaaagattctgggtattagacctttgttggatgcatagcttgcaagtatttactcccattctgtaggttgtctgtttactctgttgatagtttcttttgctgtgcagcagttctttagtttaattaggtcccacttgtcaagttttggttttgttgcaattgcttttggtgaggacttagtcataaattattttccaagactgatgccacaaggtagtcttctttggcttaaatccacctggtgttctataatctgttacttgaatattgatatctctctaggtttgggaagttctctgttattatccctttgaataaactatctaccactatatctttctctacctcctctttaaggtcagtgattcttatatttgccctttatgaggctatattctagatcttgtaggaatacttcattcttttttcttttgtctcccctgacttgtatttttaatagcctgtcttcaaggtcactacttatttcatctacttgttcagttgcactattaagatactctgatatcagtatatcaattgcatttttctattccagaatttctgcttgattctttgtaattatttcaatcactttgttagatatatctgataggattctgaattccttctctgtgttatcctgaatttttttgtttcctcaaaagggctaatttgaattctctgcctgaaaggtcacatatctctgtcactctgggattggtccctggtgccttatttagttcatttggtaagggcatgttttcctggatggtcttgaggcttgtggatatttgttggtgtctggacagtgaagagttaggtatttactgtagtctttgcagtctgggcttatttgtatccatcatttttgggaagactttctaatatttgaagggatttgcatgttgtgtgctatgtttttggtcacagcagccgtatctgccttagaaggcaccccaagcccagtaacactgtgagtcttgcagacttttagaggtctcaccttggtggtgttggatggggtccagaaaaattctctggattaccaagcagagactctttgttctcttcccttgctttctctctaacaaatggagtctgtttttctgtattgaactgtctggagctaggggaggagtgatacaagcacccctgtggccactacccctgggactgctgtgtctgacctgaagccagcgtagtactgggtctcacccaaggcctgctgtaatctgctacctggctaccacctatgtttgcttaatgaacgagggctctaatagcaggtgaggcgatgaagcttgccaggcttgtgtccttcaattcagggcagcaagttccccctggctcctggtgggtgcaaagatgctggccaggaacaagggcctggagtcagaatccttagggagctacctggtgctcctttttactgtggctgatctggcacccaagccacaagaaaaagtttttttctactcttccctcctctttccacaagcagaggagtatcttcctatggccaccactgtcacaggcccgtggggagtactgccaggctccactgatgttcactgaaggcccaagggctcttcagtcagcttgtgatgaatggtgccgggtctgggactcatcttgcaaggcagtgcacttctctctggcccagggtaggtccagaaatgccatccaagagtcaaggtctggaattggggacccaagagactgcttggtgctctaccccactgtggctgacctggtacctaagctgcaagataaagtcccctttcatcttccccttttttttgtcaagcagaaggagactctccccatagccaccatagctgggaatgtgttggctcacacctgaagccagcacatctcagattctcacccaaggcccatctatggtatgcactacttggctatcgctgctgattgttcaaaatgtgttggctttctagccagtgggtgatgaatcctttcaggacctggtctttcctttcaaggcagcagatccccttctggccctggttgtgtctagaaatgttatccagtagctagggcttggaatgggtgtctcatgactcttcctggtgtcctatcctaccatagcagagttgttatccaaattgcaagaccaagccctgtttactcttccctttcctctcctcaagcagaaggaagggggtctcttggagctgcaacctgtgctgcctgggcttgggggaggggcagggtaggcactcccttggccacccaggctggtgtctcacatgccccctaagtttactgactccatacccacaaggacttgccttgtggcctagactgcctttcaggtttatttaggaccccaatgcactttagccgacagcaatgaggcttgctacaactcaagttccaattactggaatggatgattgccctctgactagggctggtctaaatgtgctctccattgacgtcaactgatttgtgcctagtgttttctgctgtgaaagggcggcactgagttgcgatgcagagtctcacaatcattgcactctctatcccccaaacgcacagattcttcccattatgtggctgtgaatggggaagggatggtgtgggcaattcaagactgtctttcctaccctcttcagtgcctctttcagttatatgaagttaagaccaggcactgtgaccactcacctgatttttggttcctacaaaattgctttttttgtgcagatagttgtcaagtttggtgctcctgcagggagaatgatcagtggagacttccatttggccatcttgctctatctccctctacatttattttgtatcctgaaattttactgaagtcatttattagttctaagagccttttttttttttggaggctttagtgctttctagttatagaatcataatgtcagtgaagggagatagtttgacttcttcttttcctatttggatgcttttaatttctttctcttgcctgatcggtctggctaggatatatagtacgtattaggccattcttgtttgctataaatacttgagactgttttaatttataagaaaaaaggtttaattggttcatggttctgtaggctgtacaggaaacatagtgctgtcatctgcttctggtaaggcctcagaaagctttttctcatggcagaaggtgaagcgggagcagacatttcacccggcaaaagcagaagaaagagagtgagggtgggagggaaagtgccacccacttctacaaaaccagatttcgtgagaactcattcactcatcaccaaggggatgggctaagccattcatgagagatatgcccccatgatccaaacatcttccagcaggccctatctccaacactggagattacaagtcaacatgagatttgggcagggacattcaaactacaccacagtactatgttgaatagaagtggtgagtgtgggcgtccttgtttgttccagttctcaagggaaatgttcctagttttggcctgttcattatgatgttggccgtgggtttgtcatagatggctcttattattttgagatatgttcctttgatgcctagtgtattgggggttttttatcatgaatgggtgttggattttattgaatgcattttctgtgactattagagatgatcatgtggtttttgtttttaattctgtttatgtggtcagtcacattcattgatttgaatatattgaaccaatcttgtatcccaggaataaagcctacttgatcgtggtgaattaactttttaatgtgttgctggattcagtttgctagtattttgttgaggatttttgcattgatgttcatcagtgatattggctggaagttttgttttttgttgttcctgccagatttaggtatcaggatgatgccaccatcaggatgatgcatcgtagaatgaattacggaggagtctctcctctttgatattttggaatattttcagtaggattggtaccagctcttctttgcatgcctggtagaatttggatgtaaattctaggtccagggctttgttgtcattgttgtttttgtcgttgttgatcttctttctctattttctttgttaatttagctaccagtctgtgaatcttgtttattctttcaaataaaaccaagttttggtttcgttgatcttttgtatacagttttacatctcaattttattcagttttgctatggttttagtcatttttttttcttttgttagctttgaggttagtttgtttttgtttttctaattcctctagttgtgatgttacattgttaattttagatctttctaacttcttgatacaggcatttcatgctataaactttcctcttaacactgcttttgctgcatcccagatatatatttgtgtgtgtatatatatatatatatatatatatatatatatatatatatatttttttttttttttttttttttttttttgagacagagccttgccctgtagctcaggctggagtgcagtgggaccatcttggctcactgcaacctctgcctcctgggttaaagcgattctcctgcctcagcctcctgcatagctggaactacaggcgtgtaccatgcctggctaattttttttttttttttgagacggagttttgctcttgttgcccgtgctggagtgcaatggcgcaatctcggctcaccacaacctctgcctcctgggttcaagtgattctcctgcctcagcctctcgagtagctggaattacaggcatgtgccaccatgcccggctaattttgcatttttggtagagacggagtttcttcatgttggtcaggctggtcttcaactcctgacctcaagtgatccacccgcctcggcctcccaaagtgctgggattacaggcgtgagccactgcatggcccatcccagagattttggcatgtcgtgtatcttaattaatttcaaagtattttttatttctgccttaattttattgtttacctgaaatcactcagtaacaagttgtgcttaatttccaggtaattgtgtggttttaagggatcttctttggtattcatttctatttttattgcactgtggtctgagtgtatgcttggtatgatttcagtttgtttgaattcattgagatgtgctttatgcccgaacatgtggtcaatcttagagtatgttctgcatgcagatgagaagaatgtgtgttccatggttgctgagtgacatattttgtagaaatctattaggtccaattgttcaagtgttgaatttaagtgcagaatttcctcataagttttctgccttgatgatctgtctaacgctgtcagtgggttcttgaagttccccttattattgtgtgactgaggctattcataggtctagaagtacttgttttatgaatcagcgttctctaatgttgggtgtatatatatttaggataattaagtcttcttgttgaattgaatcctttattgttatgtaatgtcctttgtcctttttgactattgttggtttaaagtctgttttatctgatataagaatagtgacccctgcttttttttctgtttttatgatagatctttctccatcactttactttgagcctgtaggtgtcattacatgtgagatgcatctcttaaagatagcagatgatggtttccagcttcatccatgtccctacaaaggacatgaactcatcatttttatggctgcatagtattccatggtgtatatgtgccacggtatacatatgtaacaaacctgcatgttgtgcacatgtaccctaaaacttaaagtataataataaaaaaaagacagcaaatgattgggtcttgttttttatccaacttgccattcttgaaacttctgacctgtgtgctcaaacgatgcaggattgggactgggcctgcagctttgtactctggcccctcatagttgaacactagctgtcctagcggggctgaagtgcacccaagccactggcaaagcactcaggcagggcagtggaggctatgctgtgtgcttgctcttgtaggagaatccaggcaggagccttgggaggtgttgccgacagaggggcatgcagatcagatgcactccagtactgcaggaaagccatctctgctctatcctctctcttggcccagcagtcatcagggtcgtgttttactgcagctgccttgcatgcagaaccttctgggctctgcgcaggcttgagctctgcctctgtctactctcctggcattttaccctgccaatttaaatgtctatggagtttgtggaatctcttgtagctaggatcccagaggtccgtggtgggagtgtgttgactcataattccttcatttaccccttccttaggacctgttgaaggctgagagctggtcctggtgcttggtgactccatgcggagttcccagtttcctgtgcctcttccaagtcagtgtctgtgttgcctctctgttgactttcagtgttttctctcaaaagatgtgtttgaagtgtgatggtttacttgatatttggtttctcttggtgagagaggtgcttcccagctgtgtcttgaaccatcttgttccttatccaagtttgtactttttaatcatcatctctacattctctccacagctctgtctctgtaaccaccattctactctgtgcttgtacgagttcagttgttttagattccaggtacaatttaaaacatgtggtatttgactctccgtgctggacttatttcacttagcataatatcttcctggttcatccatgttgtcacaaatcacagtttttccattcttttaaaggctgaatagtattccattgtgtatataatgctacattttttaatccatttatttgttgagggacacttaggtggattgtgtaacttggctattgtgagtagcgttgcagtgaacccagaagtgtagacgtctctttgacaaactgacttcaaatatttggggtaaatacccaaaagctgcatcatatagtaattttatttttagtttgttgaggaacttctatacagttttccataatgtttgtactaatttacattctcattgacaatgtacaagggtttccttttttcacatccttgccaactcttgttatctttcgtctccccataatcattctgacaggtatgaggtgatatctcattgtgggttttttgtttgtttgtttgtttgagacagagtcttgctctcggctcacttcaacctccgcctccagggttcaagtgattatcgtgcttcagcttcccgagtagctgggatcacaggcgcctgccaccatgcctagctaatttttgtatttttagtagagacagggttttgccatgttggccaggctggtctcaaactcctaagctcaggtgatttgcttgccttggcctcccaaagtttgggattacaggcgtgagccaccacacctgccctcactgtggttttaatttgagcttccctaatgtgtagcgattttgagcattttttcatatatctgttggccatttgtatgtgttcttttgagaaatgtgtattcacttttcttgccaacttttttttttttgagacagggtcgtgttgtatttcccaaagtggtcttgtgctggtctcgtactcctgtgctcaagcaatcctcctgcatcagcctctggagtagctaggattatagatgtgtgccaccatgcctggctttttgcccattatttatttggattatttgttttcttgctctctctctctctctctctctctctctctctctctctctctatatatatatatatatatatatatatatatatatataatcaaaacccttactggatatatggattagaaatactttctcccaatctgtaggttgactctttgcactgttaattgctttcattgctgtgcaaaagctttttagcttgatataaccccacttgtctctttttgcctttgtttcctgtgcttttgtggtcaaatccaagaaaacattgcccagaccaggccatgtagtttttcccctgtgtgtgtgtgtgtgtgtgtgtgtgtgtgtgtgtgtgtgtgtgtttcccaagagatttacattttctgatcatcagggttattgtagttttattttcttggaatgtctttgtctggctttagtatcagggtaatgctgaccctgttaaaagagtttggaagtattggttttttttgtattttggaagaattacatttaggtctttaatccattttaagttgatttttgtacgtggtgggagagaaggtttaaatttcattcttctgtgtgtggatatccagctttcccaacatcatttgttgaagagactatccttttttcattgcatattcttggcacctttgttgaaaaccaattgaccacacatgtgtgggttcatttctgggctctctattctgttccattggttgacacgtctatttttatgccactaccatgttgttttaattactatagctttgtaatatagtttgaaattaggttgtgtgaaccatccagctgtattctttttgctcattgtagcatttgctaattggtgttttttgtggatccatacacattttagtgtcgttttcccatttctatgaaaattgatattggaatttttatagggattgcattgaatctgcatatcacttttggtagtatggatattgtaacaatatgaattctttcaatccatgaacatggggtatctttccatttgtgttttcagttttttttttcagtttatagttttcagtatacatgcctttcacttccttggttaaatttatttctaggtattggatttttttgtagctattataagttagattgttctctttatttcatttttggatagttcattgatcgtgcctagaaacactattgatttttgcatgtacaatttgcattttgcaactttactgtatttttttattcattcttaacagttttttggtggagtattcaggattttctaatataaaatcatgttgtcagcatctgatacaatttcacttcttcctttcttgtttggatgtcttttactttctttcttttgcttaattgctctggtgaggacttccaatattatgttggatcgaaatggcaagagggggccgggtgcagtggctcatatctgtaatcccagcactttggaaggccgaggtgggcggatcacgaggtcaggagattgagaccatcctggccaacatggtgaaaccccgtctctagtaaaagtacaaaaattagctgggtgtggcagcatgtgcctataatcccagatacttgggagtctgaggcagaagaatcatttgaacctgggaggtggaggttgcaatgagttgagattgtgccactgcactccaacctggtgacaaagctagactccatctaaaaaaaagaaaaaaagtggcaagagggggattccttgtcttgttctagatcttagagtaaaggtttcagttttttactgttgagtataatgttagctgtgggtttcttatatatggactttattgtgttaagatacgttctttttatatctaatttggtgagagttttataatgaaaaaatgttgaattttgtcagatgctttatttatttatttgggatggagttttgcttttgttgcccaggctggagtgcaatggcacaatcttggctcactgcaacctccttctcccaggttcaagtgattctcctgcctcagcctcccgagtggctggaattacaggcatgagccaccatgcctggctaattttgtatttttagtagagatggggtttctccaagttggtcaggctggtttcgaactcctgacctcaggcaatccgcccgctttggcctcccacggtgctgggattataggtgtgagtcaccacaccgggacagtcagatgctttttccacatcaaatcagaggatcatatgttttttgtcctttactctgttaatgtgacataccacatttacgttttgcatattttgaactattccatctcaggaataaatcccacctgatcatagtgaatgatccttttaatgtgttgttgaattcagttgctagtattttgttgaggatatttgcatctatgttcatcaaggttattggtctgtaattttcttttcttggaatgtccttgtctggatttggtatcagggtaacgctaatcttgttaataaagtttggaagcattcccccttctgattttttggaagagtttgggaaggattgccattcattctattatttatttatctatttattttattatacttcaagttctacggtacatgtgcatgcacaatgtgcaagtttgctacataggtatacatgtgccatgttggtttgctgcacccatcaactcatcatttacattaggtatttctcctaatgctatccctcccccaagcccaccacctcctgacaggccctggtgtgtgatgttccccaccctgtgtccaagtgttctcatggttcaattcccacctatgagtgagaacatgtggtgtttggttttctgtccttgtgatagtttgctcagaatgatggtttccagcttcatccatgtccctacaaaggacatgaactcatccttttttatggctgcatagtattccatgctgtatatgtgccatattttcttaatccagtctatcattgatggacatttgggttggttccaagtctttactattgtgaatagtgccacaataaacatatgtgtgcacgtatctttatagtagcatgatttataatcctttgggtatatacccagtaatgggatcgctgggtcaaatgctatttctagttctagatccttgaggaatcgccacactgtcttccacaatggttgaagtaatttacactcccaccaacagtgtaaaagcgttcctatttttccacaaccttaccagcacctgttgtttcctgactttttaatgatctctattctaacgggtgtgagatggtatctcattgtggttttgatttgcatttctctgatggccagtgatgatgagcattttttcatgtgtctgttggctgcataaatgttttcttttgagaagtgtctgttcatatccttcacccactttttgatggggctgtttgattttttcttgtaaatttgtttgagtacattgtagattctgcgtattagccctttgtcagatgagtaggttgtgaaaattttctcccattttgtaggttgcctcttcactctgatggtggtttcttttgctgtgcagaagctctttagtttaattagatcccatttgtcaattttggcttttgttgccatagcttttggtgttttagtcatgaagtctttgccagtgcctatgccctgaatggtattgcctagattttcttctaggttttttatggtttcaggtctaacatttaatccatcttgaattaatttttgtataagctgtatggaagggatccagtttcagctttccacatatggctagccagttttcccagcactatttattaaatagggaatcctttcccatttcttgtttttgtcaggtttgtcaaagatcagatggttgtacatgtgtggtattatttctgaggcctctgttctgttccattggtctatatatctgctttagtaccagtgtcatgctgttttggttactgtagacttgtagtatagtttgaagtcaggtagtgtgatgcctccagctttgttctttttgcttaggattgtcttggcaatgtgggctcttttctgtttccatataaactttaaagtagttttttccaattctgtgaagaaagtcattggtagcttaatggggatggcattgaatctataaattaccttgggcagtatggccattttcacggtattgattcttcctacccatgagcatggaatgttcttccatttctttgtatcctcttttatttcgtggagcagtggtttgtagttctccttgaagaggtccttcacatcccttgtaagttggattcctaggtattttattctctttgcagcaattgtgaatgggagttcactcatgatttggctctctgtttgtacttggtgtataagaatgcttgtgatttttgtacattgattttgtatcctgagactttgctgaagttgcttatcagcttaaagagattttgggcagagatgatggggttttctaaatatacaatcatgtcacctgcaaacagagacaatttgacttcctcttttcctaattgaataccctttatttctttctcctgcctaattgccctagccagaacttccaacattatgttgaataggagtggtgagagagggcatctttgtcttgtgccggttttcaaaggaaatgctttcagttgttgcccattcagtatgatattggctgtgggttttgtcagaaatagctcttatttttttgagatacgttccatcaatacctagtttattgagagtttttagcatgaagagctgttgaattttgttgaaggccttttctgcatctattgcgataatcatgtggtttttgtcattggttctctttatgtgatggattacatttattgatttgcatacgttcaaccagccttgcatcccagagatgaagctgacttgatcgtagtggataagctttttgatgtgctgctggattcggtttgccaatattttattgaggatttttgcatcaatgttcgtcagggatattggtctaaaattctctttttttttgttgtgtctctgccaggcttttgtatcaggatgatgctgacctcataaaatgagatagggaggtttccctctttttctattgattggaatagtttcagaaggaatggaccagctcctctttgtacctctggtagaattcggctgtgagtccatctggtcctggacttttttttggttggtaggctatcaattattgcctcaatttcagaacctgttattcacctattcggagattcaacttcttcctggtttagtcttgggaggatgtaagtgtccaggaatttatccattccctcgagattttcttgtttatttgcatagatgtgtttatagtattctctgatggcagtttgtatttctgtgggatcagtggtgatatcccctttgtcattttttatagcgtctatttgattcttctttcttttcttctttgttagtcttgctagcggtctatcaattttgttgatcttttcaaaaatccagctcttggattcattgatgttttgaagggatttttgtgtctctccttcagttctgctctgatcttagttatttcttgccttctgctaactttgaatttgtttgctcttgcttctctagttcttttaattgtgatgttaggatgtcgattttagatctttcctgctttctcttgtgggcgtttagtggtataaatttccctctacacactgctttaaatgtgccccagagattctggtatgttgtgtctttgttctcattggcttcaaaaaacatctttaattctgccttcattttgttatttacccagtagtcattgaggagcaggttgttcagttcccatgtagttgtgtgttttgagtgagtttcttaatcctgagttctaatttgattgcactgtggtctgagagacagtttcttgtgatttctgttcttttacatttgctgaggagtgctttacttccaattatgtggtcaattttagaataagtgcgatgtggtgctgagaagaatgtatattctgttgatttggggtggagagttctgtaggtgtctattaggtccaattggtccagagctgagttcaaagtcctggatatccttgttaaccatctgtcttgttgatctgtctaatattgacagtggggtgttaaagtctcccattattattgtgtgggagtctaagtctctttgtaggtctctaaggattgttttgtgaatatggatgctcctgtattgggtgcatatatatttaagatagttagctcttcttgttttattgatccttttaccattatgtaatggccttctttgtcttttttgatctttactggtttaaagtgtgttttatcagagactaggattgcaacccctgtttttttttttttttttttttgctttccatttgcttggtagatcttcctctatttttaaattttgagcttatgtgtgtctctgcacgtaagatgggtctcctgaacacagcacactgatgggtcttgactctttatccaatttgccagtctgtgtcttttaattggggcatttagcccatttacatttaaggttaatattgttatgtgtgaatttaatcccgtcactatgatgttagctggttagtttgcccgttaattgatgcagtttcttcctaacatcgatggtctttacaatttggcatgtttttgcagtggctggtaccagttgttcctttccatgtttagtgcttccttcaggagctcttgtaaggcaagcttggtggtgacaaaatgtcttagcatttgcttgtctgtaaaggattttatttctccttcacttatgaagcttagtttggctggatatgaaattctgggttgaaaattcttttctttaagaatgttgaatattggccgccattctcttcgggcttatagggtttgtgccaagagatcagctgttagtctgatgggcttccctttgtgggtaacccaacctttctttctggctgcccttaaaattttttccttcatttcaaccttggtgaatctgacaattatgtgtcttgtggttgctcttcttgaggggtatctttgtggtgttctctgtatttccctgaatttgaatgttcacctaccttgctaggttggggaagttctcctggataatatcctgaagagtgttatccagcttggttccattctccacctcagtttcagggacaccaatcaaacgtagatttggtcttttcacatggtcccatatttcttggagattttgttcatttctttttactcttttttctctaaacttgtcttctcactttatttcattaatttgatcttcaatcagtggtaccctctcttccacttgatcgaatcagctactgaagcctgtacatgtgtcacgaagttttcgtgctatggttttcagctccattaggtcatttaaggtcttctctacactgtttgttctagttagccatccgactaaccttttttcaagatttttagcttccttgagatggattggaacatgcttcttagcttggagaagtttgttattactgaccttctgaagcctaattctgtgaactcatgaaagtcattctccatccagctttgttccattgccggtgaggagctgtgatcctttggaggagaagaggctctctggtttttagaattttcagtttttctgctctggtttctccccatctttgtggttttcatctacctttggtatttgatgttggtgacctacagatggagttttggtgtagatgtcctttttgttgatgttgatgctatttctttctgtttgttagttttccttctaccagtgaggtccctcagctgcaggtctgttggagtttgctggaggtccactccagaccctgtttgcctgggtatcaccagcggaggctgcagaatagcaaatattgctgcctgatcctttctctggaagcttcatcccagaggggcatctgcctatatgaggtgtctgttggcccttactgggaggtgtctcacatttaggctacacgggggtcagggacccacttgaggaggcagtctgtccattctccgagctcaaacactgtgctgggagaaccactgctctcttcagagctgtcagacagggacttttaagtgtgcagaagtttctgctgccttttgttcagctctgccctgtccacagaggtggagtctatagaggcagtgggccttgctgagctgcggtgggctccgaccagcttgagcttcccagccgctttgtttacctactcaagcctcagcaatggcagatgcccctcccccagccaggctgcagccttgcagttagaactcaaactgatgcgctagcagtgagcaaggctccatgggcggggaccctccaagccaggcacgagagggaatttcctggtctgccggttgtgaagactgtgggaaaggcacagtatttgggcaggagtgtactgttcctccaggtacagactgtcacagcttcccttggctaggaaagggaagtcctcagaccccctgtgcttcccccatgagtcaacgctccaccctgctttggttcaccctccatgggctacacccactgtccaaccagtcccaatgagatgaaccatgtacctcagctggaaatgcagaaatcacccatcttctgcgtcgatcacgctgggcgctgcagagcagagctcttcctatttggccatctttgaatggaaaacctggcattccttattttataaatgtttttcttgtcttgtcttttttttgtgtgtgcgtgatggagtcttgctctgtcacccaggctggagtgcagtggaaggatcttggcttactgcaacctttgcctcccaggttcaagcgattctcctgtctcagcctcccaagtagctgggattacaggcatgtgtagccatgcctggctagtttttgtatttttagtagagacaagctttcatcatgttggccaggctggttgctggtctcaaactcctgacctcaggcaatctgcacacctcggcctcccaaggtgctgggattacaggcatgagccactgtgcctggccaaatgtttttaatatatgttttataattagttttttaaaaaatattttagaaattcagcagtgaacccatcaggtccttggcttttctttgaatgaagacattttattactggatttaatttttaatcattatttgttcagattttctgattcaatcttgatatgttgtatatatctaggaatttatccatttcttctaggttatctagtttgttgatgtataattgtaattgttcatagcagtctcttatgattctttattcttgatatcagttgtaacatctcctctctcatttctgattttatttgattactctctatatcttggttttgctaaatgcttgacaattttatccttttagaaaaccaacttttagtttcgttgatctattgtatttttttggcctctattttattcatttctgctctgatctttattttttttctgcctgttaactttgggctttgttcttattctagttcctcgaggagcaacgttgtttatttgagatatttcttttttgatgtaggcatttattgctgtaaactttcttttttttttttttttttgagacggggtctcactctgttgccaaggctggagtgcagtggcatgatctcagctcactgcaaccttcacctactgggttcaagcaattctcctccctcagcctcccgagtagctgggattacaggcacccacgaccactcttggctaatttttgtatttttaatagggacggggtttcaccatcttggccaggctggtctagaactcctgacctcatgatccacccacctcggcctcccaaagtgctgggattacaggcgtgagccaccatgcccagcttcctattagttttggtatggattgtttttattttcatttgtctgaaggtacttaaaatttttttttaatttttaaaatgtgtacatacatatatatatgtttgtagtgacaggttcttgccatgttgcctagactaatctcaagaaagcttcctgcctgggcctcctgaaatgatgagattgcaggcatgagccacctctagatgcttttaaatttcccttttaagttattcattgacctgctgattgttcatgagcatggtgtttaatttccatgtatttgtgatttttccaaaattcttcctgttattgatttctagtttcataccattttggtcagaaaggatacttgatatgattttagttttttttaaatttcaaaattttaaaagctcaaggatcgcttgagcccaggagtttgagaccagcctaggcatcgtagcaagaccttgtctctaccagaaaaacaaacaaacaaacaaaaaacaaaaacaaacaaacaaacaaacaaaacatagcctggtgtggtagcctgcatctgtagttccagctccttgggaggctgagatgggagggttgcttgcatctgggaggttgaggctacagtgagctatgatagtgtcagtgtactccagcttgggtaacagagtgaggccctgttttttgttgttgttgttgttgtttgtttgttttaaagccccactttctaatactatcatctttgtggttaggatttcaacataggaattgtgggggaacacaaacattcagaccattagtacttactgattttctttttcatagatctattctgttttcaaagtggggtactgaagtctcctactattgttgtattgctgtttatttctcccttcagtcatgttgatacttggtttatattttaggtgatcttaagtagatatatatttacaactgttatatcctcttgatgaattgactcctttatcattatataatgcccttctttgtctctggtgacagtttttgacataaattctatttttttctgatataagtatacccaaccctgctctcttttggttgctatttgcatggaatgtattttttccatcccttcactttcagcctatgtgtgtccttaaagctaaagtgagtatcttgtaggaaggaaatagatttgttgttttatccattcagccagtttgtgtcttttggttggagaaattaatccattacagttaaattaattattgataagtaaggacttaactattgtcattttattagttgtttcctgaatgttttatagtttctttgctcttcccttcttgctgtcttcctttgtgacttgattttttttttatagtggtatggtttgatcccttcttctttattttgtgtgtatcagctataatattttgcctgtggttgccatgacagttatgtaagacatcttataccagtttatttatttatttattatttataattgctgttattttttgagatggagttttgctcttggtgcccaggctggagtgcaatgatgtgatatcggctcaccgcaacgtctgcctcctgggttcaagtaattctcctgcctcagcctcccgagtagctgggattacaggcttgcgccaccacgcccagctaattttgtatttttagtagagacgggggtttctccatgttggtcaggctggtctcgaactcctgacctcaggtgatctgcctgcctcggcctcccaaagtgctgggattacaggcgtgagccactgcgcctggccaccagtttattttaagctgataaaaacttaattatgatcacataaaaagctccacattttattccttcccctctacattttgttttttgatgtcacagtttacatcatattttgtattaatgaacaagttaatgtaactgtagttactttaaatacttttttctttgaattttaaacaaattgaacataagctgggcatggtggctcctggctgtaatcccagcactttgggagactgaggtaggtagaatgcctcagcccaggagttcaagaccagcctgggcaacatggcaaaacctcctctctacaaaaaaaaaaataataataataataaataaataaaagaatataacactttacatatgtatggggtccatgtaactgtttgttacgtatgtagaatgtgtaatgataaagtcggggtatttggggtatccatcaccttgagtatttatcatttctatatgttggaaacatttcaagtcttctcttctagctatctgaaattgttgcctgactctgctattgaacattagaacttattccttccaactatatatttgtaaccattaaccaacctccccttttctcccctctcccacccacacacctttcctagattctggtattatcattctattttctacctccatgagatccacatttttagctcccacttctgagtgagaacatatgatatttgtctttctatgcctggcttcacttaacataatgacctccagttccatccatgttattgcaaatgactgtatctcattcttcttctttttttttttttttccaagacagggtctcacgctggttgcccaggctggagtacagtgatgcagtcttggctcactgtggcctcaactttccgggctcagatgattctcccatctcagcctcccgagtagctgggaccacaggcgtgcaccaccacgcctggctaaatttttctatttttagtagagacagggtttcacaatgttgcccaggttggtctcgaactcctggactcaaacaatccacccacctcggccccccaaagtgctgggattacaggcatggatcttattctttttatggctgaatagtactctgttgtgtatatgtaccacattttcttcatccattcatctgttgatggacacttaggttgattacatattttttctattgtgaatagtgctgcaacaaacatgcaagtttaagtatccctttgatatactaatttcctttccttcagataaatacccagtagtgggattgctatatcatatatagttctattataagtttgttttttttttttctgagaaatctccacgctcttctccatagtgcttgtactaatttacattctcatcaacagtgcataagaattcccttttctctgcatccttgccaccatccattaacttttgtctttttaataataggcattctgactgggtggggtaagatgatattgcattgtggttttgatttgcatttccctcatgattagtgatattgaaaatttgttcatatacttgtttggccatttgtatgcctttttttttttgagacggagtctcgctctgtcacccaggttgcagtgcagtggcgtgatctcggctcactgcaaccttcacctcctgggttcaggcgattctcctgcctcagcctcctgagtagctgggatcacaggcgtgcatcaccacacccagctaatttttgtatttttagtagagatggggtttcaccgtgctgggcaggctggtctcaaactcctcgattacaggagtgagccaccgcacccagccttgtatgtcttcttttgaataatgtctgttcatgtcctttacctcactttttaatgagattttttttaattgttgaggtgtttgaatatgttgtatattccagatattagtcccttgtagaatgaatagtttgcaaatatttttgtcctattcaacaggttgtctctttaatttgttattgtttcttttgctgtgtagaagccttttaatttaatatggtaccatttgtctattcgtgtttttgttgtctttttgaggttgtagccatatcatctttgcctagaccaatgtcctgaagcattttccctatgttttcttctagtagttttatagttttaggtcttacatttaagtctttaatctatcttgggttgatttttgtatatggtgagagacaggggttcaatttttttctcctgcatatggatatctaattttcctagcaccatttattgaagagaccaatttatgttcttgattgctttgtcaaaaattagttggctgtaaatatgtggagttatttctggattatctgttttgttccattggtctatgtgttgtttttataccaatatcatgttgttttggttaatacaggtttgtaatatattttgagtcaggtaatatgatgctgccagctttgtttgttgttgttgttgttgtttttgctcaggattgctttggctattcaagttcttttttaggattattttttctaattctgtgaaaaatgacattggtattttgatagggattgcattaaatctgattactttggacagtttggtcactttaataatatacactcttctgacccatgaacatgggatatcttttttttaaatgtttcctttaaactctttcaccagtgctttttagttctacttgtagagaactttcacctccttgattaaatttattactaggcattttttgtagctgttttaaatggggtatttttcttgatttctttctcagctagttcattaatgttgtatagaaatgctgctgatttttgtatgttgattttgtattctgcaagtttaccaaagttatttattagatctaggagttttttatggagtcttgaggtttttctagacataagatcatatcatcagcaaggacttcctcttttccagttcggatgccttttatttttttcttttgcctgattgctctggctacaacttccagtactattttgaataggagtggtgatagtggacgttcttgttttgttccagttgttggaagaaaagcttccagttttttttttttttttatgatgttagctgtgggtttgtcaaatatggcctttatcacattgaggtacatttattctttgtagtttgtgcttcactcccacccgagccctggtgctgctgggccccaggacagtgcgcagtctgttgtgggctgggctttcaaaatgatatcttgctgtatctgctcctgatttaggagtgtgggacccagccaagttccctgtctggaacagtgctgttgtgtggtttctaggcagctctctatgttattttcagggcctacaagggtctaggggcgttcctgtggctaggattgcaagagtccacaatggggatgtggtccatttggggtctctcactctttctctgcattggggagtctctctctcagctcgcagccaatcttggccaagcaagctgcctcacctccgtctccttttttgctttaggtttttcctgtaacttctctgttgaatttcagtgttctctcttggatgatctattgaagtattattatgtactattttggttcttattagtggaggaggtgagtatgagatgcctttagttagccatcttgaagctccttatcttttaactttcatagtatagttaaaagtgatttatgtaccaccattacaatattagaatattgtgagtttgagtatattcttacctttatggtgagttttatacatttatatgttttcatattgtttgttagcatccttttcttttattaataacttgaggaactctcttcatcattttttgtgggacagtggtgatgaactcccacagctttttgtttgtctgggaaataatttcttctttatttttgaaacatagctttactgactatattacaatattcttctaggcagttttttttctttcagcatgtagaatgtatcattcccaaccccttttggcctgcaaggtttctgccgagaaatctggtgatagtcttatggatagtcttatggagattgccttttatataagtcacttttctcttattactttcatgattctccctttttttttgacttttattaatttggttatattatgtcttagtgaagatctctttacattaaatttatttggctttctttgggcttcatggtctggatgttctctttgttgtccagattgcggaagttttctgtcattcccttatttaactaagctgtctgaccctttctctttctatatcctttttatgaatcctcctgggattcctatagtgttttttttgttgttgttgttgcttgtttgttttcctttatggagtcccataaattccataggctttcttcactctttttcattctttttttgtccctctgattgggtaatttcaaatggcctgtctttgagtttgctgattattctgcttcagagagtcttctgttgaagctctctgtatggccgtttttagtttcatcattgtattgtcctgctccaaaatttctgtttcattcttttttatgtttcttgtttttgaacctcttcttattttgcttatatattttctggttttgtttagttgtctgtgttcgcttgtaattaactgagctcctttaaggtgattattttgaattctttttcaggcagtttatagatactcatttctttagaattggtgactggtgctttaatttattcctttggtggtgtcgtttccttgattattatttaaaaagaatttttttaaacaaggtctcactctgtcaccaggctgcagtgcagtgttgtgatcacgactcactgcagcctcaacctcctaggcccaaagaatcttcccacctcagcctcccatatctgctgggaccacaggtgtgcgtcaccatgcctgactaatttttaaatttttgtatagatggggcctccctaagttgcccaggctggtcttgaattcctgaactaaagtgatcctcccaccacagcctcccaaagtgctgggattataggtatgagccaccacacctggccttgattattttttatctttgtggccttgagttggtatctgcacatttaaacaaataggcacactttttcaatatttacagacttgcttcagcagggaaagccctttaccagtctgcctgtctagtgattctgggtgggtcatctcatgaagaccatgggcaaattttctgctggagttctcaggtatgctgacctagtgcctgtgtctgcatggccagcctggaatctgggtttgtgtggtccatcctggcactgaggcaggccatgaacttgggtaagaggccagcataaagcttcgtgccatgaggactgatctagcactgaggctaatgtggtcagtctcctgttgggataagcctagagcctggggctatgggggtgggtccataactgggacacgcctggaggctgggttcatgaggcaagcctggagctttgggcaataggagctaacttggcgctggggcaggcttgaagtctgggtccatagtggtgggcctaagacctcctattttctagttatggtaaattaaatgtagggaacagtcaaaatggaagagttccagacatagatacagtaaaaatatagtttaaaacttctttgcttattaaaaaagttatttgtggttgtcataaaatcttaagcatcacaaaaatatgtattatggattgtaaagtgagcatctattccatactcaaaaacagaatcattgaaatggatttggaagatttaaggagttttttttaagtttttttcaaaatagattgcatttaaaaaagattaatggaatgaagtaaagccaaagagtatacacaggaaaatttgtaattggtgatctcctgttatattagagacaatgagataaattggtaaaataacagaagacatttgaattggacaacatccaagagagttggataaaaccctgaagatgttctgtaaaaaataatataacattgaccataataaatgagatttaatgacattacttctttgacttataggttagagactaggtccttatgcttataaattcttgaagaagagagttctttgtaggttaacaaaaatgagagtatttctcaatgcagagaaagggagctctgtgctgcttttctcccaatagggatacaaccagatcatagttttttcagcatccttcttttatggttacagtttatattatctttttttaaacaaacacgtaaatttattgctgctagattttggggatgttagtaaacgattgtgtaggcagtatgttaggggaggagtaaatttttgagatccttttccagcaccatttaaaattatctatatactaatctgaaacctgtctctgttggtaagtaatgtgagttgctttctattggtcaggaatagttttttttcttgacggaatatctctgagtttggagggaagtgtgtctcttttctgcctgtataaaacttattgtatacctctttgagttaaaagaaaaacccagcaaaaaatatactgttgctttctaaattcatagtgcttaggtttggtaaacctagattacgtaatttctttttttttattttaaatttgtatttgtacataacaggtatacatcttttcagggaacatgtgataatttaatatatttatatactttgtaaaacatcaaatcaatgtaattgggatatatatccatgaacttaaatatttgtcttttttttcttttattattatactttaagttttagggtacatgtgcacattgtgcaggttagttacatatgtatacatgtgccatgctggtgcgctgcacccactaactcatcatctagcattaggtatatctcccaatgctatccctcccctctcccagattatgtaatttctatactgcatttaaaagaactattatatttaccctaaggatagtatttaaataggggatatgtttatttattattgttttgcctttactatatttaggtaggaatatatatcaccagaggtcttatattgagaaataaaggaaataacaaagaaattataaatgtatttacgtgcacaaatattgatgttccatcccacaaggccaaaggacgtttgtaccagttttaatgtacttaatgttcattcctttattttcccttctcttctcagcctgaggccctgagaatctgacattattaggcaatgtgatctaagggaaggtctcagagctggcagaaaatttgttaatgataaactgtgaccttgaatcactcagttaactactatgtaccacaatatcctcacctgaaaaataggtgcaatattatgtgtgtcacaggcatggaatgaggataacagaagaaatatagtagttctttgaaaagctaagggtttacatatacggtgataaaattattaactaaaaatcagcctatacaaggcttatttttaatggaaaggtaggtattagcaccatctagtggaaacataatgaattgtataatagcattttcaatacggaaaataatttaatatagataactctttagagctggaagaaatcttacagatcacctatttagtaatttagagattatgttctgtggtgtccttatattctaccagaagagcctcaggacctcctttaagagaaagaagagtcttttccacaattctcagattctcatgttgcttcaaatagagaagttaggctttaatcagttttttatatatgtccttgtaagattttgtttgaaaaaatgattcaccttcttagaaaatgtttgaaaatgactgatttagattaactcatctttgtacagataaggaaatctaaatttagggagcttgagacttgtttgagggcacatagttggaacaatagatctctagtcttttaggaatagtttttctctaaaggtcagtagtgatgtcctttcttttattcttgattgtagtaatttgagccttctctcttcttttcttggtcagtgttgctaaaggtgtccattttttgatatattgaaagcataaacttttgagtttgttgatttttctctattgttttttagtgatcaatttcatttatttccattgtaatctataatttcccccctctgtgcttgatttatgcttagtttgctcttccttttcccttttcctaaggtgaaaggttagcatattgatttgagatcttttaaaaattactgatgtttatagctatacattttcctttaactgttgctttagttgtacctcctaagttttggtgtgtgcattttcctttttgttcatctcaaggtattttctaattccccttgtaatttattctttgacccatttggttatgtagacgtgtgttgttagattttcacacttggtaatttcctcatttcttttttgttcttgatttctaatttaattcaatgtagacaaggaactgttaaatctactatggccttttatggcctaggatatgttctattctgaagaatgttctatgtgcaattaagaatttatagtctgctattattgggtggattgttgatatggtttggctctgtgtctccacccaactctcatctcgaattgtaatccccacatgtcaagagagagacctggtgggaggtgattggatcatggggctggtttcctccatgctgttctcatgatagtgagttctcatgagatctgatggttttatcaggggctcttccccctttgccctctctctcttgcctgctgccatgtaacatgtacctgcttctatttctgccatgactgtatgtttcccgaggcctccccagtcatgtggaactgtgagtcaattaaacctcttttctttataaattaccctgtcttagacagttctttatggcagtgtgaaaatggactaattcaagtgcgctaccgatgtctattaggtctagtagatttatagtgttcttcaagtcttatatatactttttgatgttctgtctagttgttccatctattattattaattattttggctagatattttatttatttttaatttttgtgggtacatattaggtatacatatttatgggatacatgagatgcttcaatacaggcatgcaatgtgaaataatcacatcatggaaaatgggctatctatgccttcgagcatttatcctttgtgttacaaacaatccaattatactattttagttattttaaaatgttcagttgagttcttcttgactatactctccctgttgcgctatcaaatagtaggttttattccttcttttaaactattttttataaccattaatcatcctcacctcccctcaccaaaccacccccaaaccctttccagcctctggtaaccatccttctactctctgtgtccatgtgttcaattgctttgatttttaggtcccacaaataagtgagaacatgtgatgtttgtctttccgtgcctggcttatttcacttaacataatgatctccagattcatttatgttgttgcaaatgacagaatctcactcttttttatggctaaataagactccactgtataaatgtaccacatttctttatccattcatctatccgtggatacttaggttgtttccaaatcttggctattgtgaacagtgctgcaacaaacataggagtgcagatatctcttcaatatactgatttcctttcttctgggtatataaccagcagtggggttgctggatcatatggtagctcaatttttagttttttgaggaaactccaaactgttctccatagtggttgtactaatttacatccctgccaacattgtgcaagggttcccttttctccaccccttttctccacaccctcaccagcatttgttattgcctgtcttttggatataagccattttaactgagtggagatgatatctcattgtagttttgatttgcattgttctgatgatcaatgacgttgagcatctttcatgtgtctgcctgccatttgtgtgtcttctgtgagaaatgtctaaatcgtttcctcattttttgattggatcatcagattttcccctgtagagttatttaagcttcttatatattctgctcattaaccccttattagatgggtaatttgcacacattttcttcagttctgtgggtcgtctcttcattttgtttattgcttcctttgctgtgcagaagattttaaacttgatgtgatcccagttgtccatttttgcttttgtgtcagtgcttgtggggtattacttaagaaatctttgcccagactgatgttatagagattttctccaatgttttcttgtagtagtttcatagtttgaggagttagatttaagtctttaatctatttttatttgatttttgtatatgatgagagataggggtctagtttcattcttctgcatattggattccccagcaccatttcttcaagactctttcttttctccagtgtatgtgcttgacactcaaaatgagttcactgttaggtgtgtggatttgtttctgggatctctattctgttccattggtctatgtgtctgttttcatgccagtaccatgctattttggttactatagctctttagtataattggtagtcaggtagtgtgattcctccagatttgttcttttcgcttaggatagctttgactattctgggtgttttgtggttccatatacatttcaggattttttttttctatttctatgaagaatgtcattggtattttgatagggattgcagcaaatctgtagattgctttgggtagtatggacatgttaacagtattggttcttccaattcattaacatgtaatatctttccactttttggtgtcctctttaatttctttctttctttctttttctgagatggagcttctttcttttttttttctttttttgagacagagtcttgctctgtcacccaggctggagtgtagtggcgcaatctcagctcactgcaacttctaccacctgggttcaagtgattcttctgccacagcctcccaagtagctgagattacaggcacgcaccaccatgcccagctaagttttatatttttagtagagccagggtttcaccatgttggccaggttgttctggaactcctgacttcaagtgatctgccttcctcagcctcccaaagtgctgggattacaggtgtgagacaccatgcccggtcctcttcaatttatttcatcagtgttttatagttgtcattatagggatctttcacttctttggttaattcatagatgtttaattttatttgtggctattgtaaataggattacttcttttatatctttttcacattgttcactcttggcttatagaaatgctactgatttttatatgttgattttgtatcctgcaactttactgaacttttaaatcagttttaatagtttttggtgtagtctttaggtttttccaaatgtgacattatatcttctgcaagcaaagataatttgacttctttttttccaaagtggatgttcgtcatttcttcttttctgattgctttagctaagacttccagtagtatgttgaataatagtgatgacagtgggcatccttgttgtgttccagatcttagaggaaaggctttcagttcttccccattccttatgatactagctgtgggtctgttatatatggcttttattatgttaagttatgttccttgtatccccagtttttttgagggtttatatcatgaagggatgttggattttctcaaatgctttttcagcatcaattgaaatgatcatatggtttttatccttcattctgttgatatgatgtatcacattgattgatttgtatatgttgaacgatgtttgcatcccaagggtggatcacacttggtcatgatgatctttttaatatattgggcttgttgttgttgttgttttgagacaaagtcttgctctgtcacccaggctggagtgctggagtgcagtggcatgatctccattcactgcaacctctgcttcctgagttcaagtgattctcgtgcctcagccacccgagtagctgggattacaggcttgtgccaccacgcccagctaatttctgtggttttagtagagatggggtttcaccatgttggccaggctagtctcgaactcctggccttaagtgattcgcctgcctcggcctcccaaactgctgggattacaggtgtgagccaccgcactcggccatatattgctgaatttgatttgctaatattttgtcgaggatttttgcatcaatattcatcagatatattggcctgtagttttctttttttgatgcatctttatctggttggtatcagggtaatactggcctcgtagaatgagtttggatatattccctcctcctctatttttcagaacagtttgagtaggattagtattagttctttaaatattttatagaattcagcagtaaagtcattgggtccccagcttttctttactgggagactttttattatagctttgatctcattacttgttgttggtgtgttcaggttttggatttctttatgcttcaaacttggtaggttgtttgcttctagaaattttttcatttctttaaatttttcaattaattggcatatagctgttcatagtggccactaattatcctttgaatttttgtggtatcagttgtgtctcctctttgatctgtgattttaatatttgtatcttctgtatttttttcttagatagtctggctaaagttttgtcaattttgtttaacttttcaaaaaaccgcatttttgtttcattgaacttatgtgttattttctttatttcaattttatttatttctgctctgacctgtattatttcttttcttctgctaattttgggtttggtttgttcttgcttttctagtccttaaaggtgtattgttaggttgtttatttgaaaattttcttcttttttgatgtagggagttatagctataaacttccctcttagcatttcttttgctgtattccatacattttggtatgtgatgtttccattatttgtttccagaaaattttcagctttcttcttaatttcttcattgacccacggtcactcaggagcatattgtttaattttcatgtatttgtatagtttccaaaattcttgttgttgttggtttctaattttattccattgtggtcagagatgcttggtattattttgaatttttgcgtgtttacaacttgttttgtgacctaacatttggtctgtctttgagaatgatccatgtgctgaggaaaagaatgtgtattctgcagctgttggatgaaatgttctgtaaatatccattagatccatatgttctatagtgcaaattaagtctgatgcttctttttgattttctgtctggaagatctgtccaatgccgaaagtggggtgttgacatctacagctattattgtatgaagtctatgtttctctttatctctgataatatttgctttatatatctgggtgctccagtgttgggtgcatatatatttaaaattgttatatcctcttgtggaattgttccctttatcgttatatagtgaccttctttgtctcttcttatagtttttgtcttgacacctattttgtgtgatataaatatcagcactcctgctcttttttggtgtccattggcatgagatatttctgccacccaccactataactattttttttaattttttattttatttcaatagttttttttttcgaacaggtagtttttggttacatgagcaagttctttagtgttttttctgagattttggcatacccgacacctaagcagtgtacactgtacccaatatgtaattttttatccctaagcccccttccatcttcctccatctgagtccccaaagtccatcatatcattcttatgtttttgcatcctcatagtttaactcccacttataagtgagaagatacgagacttggttttccattcctgagtcacttcacttagaataatggcctccaagtccatccaagttgctgcaaaggccattattttgttctgttttatggctgggtagtattctatggtgtatatacattttctttatccactcattggttgatggtcatttaggttggctccatattttttgctattgtgaattgtgctgctataaaaatgtgtatgtgttttttcgtatgatttattttcctttgggtatatacccagtagtgggattgctggatcgaatggtagttctaattttagatttttgttttgctttgttttttgttttgagacaaggtctggctctgtcttccaggctggagtgcagtggtacgatcttggctcactgcaacctgtgcctcccaggctcaagccatcctcccacctcagcctcctgagttgctgggagtacaggcacacaccaccacacttggctaatttttgtattttttgtagagatgggatttttccatgttgctcaggctggtctcggactcctgagctcaagtgatctgccccctcagcctcccaaagtgctgggattacaggcatgagccatcatgcctggccctcattttaattctttaaggcagcagtccccaacctttttggcaccagggaccagtttcgtggaagacagtttttccatggagcggcggtgggggatcgggggtggggaatggtttctggatgaaactctttcatctcagatcattaagtattagatccttataaggagtgtgcagcctagatcccttgcatgcgcagttcacaatagggttcgtgctcctatgataatctaatgctgctgctgatctgccagaaggtggagctcaggcaggaatgctcacttgccccgccactcatctcctgctgtgcagcccggttcctgctttaggagcttcgaccccctgcttttaaacgtttttttcctgtttatatcttattgtactgtctgtgtcttgaaaagttgttgtagttattatttttgattggttcgttatttagtctttctacttaagataaaagtagtttgcacaccacagttacagtgtcataatattctgtgtttttctgtgtacttatattaccagtgagttttgtatcttcaagtgattacttactgctcacgaacatccttttctttctgattgaagtactctcttcagcatttcttgcaggacaggtctggtgttcatgaaattcctcagcttttgtttgtctgggaaagttttcatttctccttcatgtttaaaggatatttttgctggatatactattttaggataaaagttcttttccttcaacagtttaaatacatcatgctactgtctcctggcctgtaaggtttccattgaaaagtctgcttgatgtattggagctccattgtatgttgtttttttcttttctcttactgcttttaagatcctttctttatcattgggctttaggagtttgatttttaaatacttgaggtagcgttctttgggttaaatctggtgttctataactgctttgtatttggatattgatatctccttctaggtttgggaagttctctattattatccctttgaataaactttctttctttttttattatgctttaagttctaagggtacatgtgaacaacatgcaggtttgttacataggtatacatatgccatgttggtttgctgcacccatcaactagtcatttacattaggtatttctcttaatgctattgtgtgatgttccccaccctgtgtccatgtgttctcattgatcaactcccacttatgagtgagaacatgcggtgtttggttttctgtccttgtgatagtttgctgagaatgatggtatccagcttcatccatgtccctacaaaggacatgaactcatccttttttatggctgcatagtgttccatggtgtatatgtgccacattttcttaatccagtctatcattgatggacatttgggttggttccaagtctttgctattgtaaatggtgccacaataaacatatgtgtgcatgtgtctttatagtagcgtgatttataatcctttgggtatatacccactaatgggatggctgggtcaaatggtatttctagttctagatccttgaggaatcgccacactgtcttccacaatggttgaactagtttacactcctagtaacagtgtaaaagcgttcctatttctccatatcctctccagcatctgttgtttcctgaccttttagtgatcaccattctaactggtgtgagatggcatctcattgtggtttcgatttgcatttctctgatggccagtgatgatgagcatgttttcatatgtctgttcgctgcataaatgttttcttttgagaagtgtctgttcatatcctttgcctactttttcatggggttgttgctgtttttcttgtaaatttgtttaagttctttgtagattctggacattagccctttgtcagatgggtagattgcaaaaattttctcccattctgtaggctgcctgttcactctgatgatagtatcttctgccgtgcagaagctctttagttcaattagatcccatttgtcaatttttgcttttgttgccattgcttttggtgttttagtcatgaagtctttgcgcatgcctatgtcctgaatggtattgcctaggttttcttctagggtttttatggttttaggtcttacgtttaagtctttaatccatcttgagttaatttttctataagctataaggaagggatccagtttcagctttctacatatggctagccagttttcccagcaccaattattaaatagggaatcctttccccattgcttgtttttgtcaggtttgtcaaagatcagatggttgtagatgtgtggtgtctgaagcctctgttctgttccattggtctatatctctgttttggtaccagtatcatgctgttttggttattgtggccttgtaatatagtttgaagtcaggtagcatgatgcctgcagctttgttctttttgcttaggattgtcttggtaatgtgggctcttttttggttccatataaactttaaagtagttttttccaattctgtgaagaaagtcattggtagcttgatggggatggcattgaatctataaattaccttggcagtatggctattttcatgatattgattattcctatccatgagcatggaatgttcttccatttgtttgtgtcctcttttatttccttgagcagtggtttgtagttctccttgaagaggtccttcacatcccttgttagttggattcttaggtattttattctctttgtagtaattgtgaatgggagttcactcatgatttggctctctgtttgtctgtacttggtgtataagaatgcttgtgatttttgcacattgattttatatcctgagacttggctgaagttgtttatcagtttaaggagatttagggctgagaggatggggttttctaaatatacaatcatgtcatctgcaaacagcgacaatttgacttcctcttttcctaattgaatactctttatttctttctcttgcctgattgtcctggccagaacttccaacattatgttgaataggagtggtgagagagggcatccttgtcttgtgccggttttcaaagggaatgcttccagtttttgcccattcaatatgatattggctgtgggttcgtcataaatagctcttattattttgagatatgttccatcaatacctagtttattgagaatttttagcatgaagggctgttgaattttgtcaaaggccttttctgcatttattgagataatcatatggtttttgttgttggttctgtttatgtgatggattacatttattgatttgcatgaaccagccttgcatcccaggggtgaagctgacttggtcctgattgataagctttttgatgtgctgctggatttggtttgccagtattttattgaggattttcgcatcgatgttcagcagggctattggtctaaaattctgtttttttgttgtgtccctgccaggctttggtgtcagtatgatgttggcctcataaaatgagttagggaggagtccctctttttctattgattggaatagtttcagagggaatggtaccagctcctctttgtacctctgatagaatttggctgtgagtccgtctggtcctggactttttttggttggtaggctatattaattattgcctcaattttggaacctgttattggtctattcagaaattcaacttcttcctggtttagtcttgggagggtttatgtgtccaggaatttatcatttcttctagattttctagtatatttgtgtagaggtgtttatagtattctctgatggtagtttgtatttctgtgggatcagtggtgatgtcccctttatcattttttattgtgtctatttgattcttctttcttttcttctttattagtcttgctagcagtctatctattttgttgattttcaagaaaccagctcctggattcattgattttttgaagggttttttgtgtctctgtttccttcagttctgctctgatcttagttatttcttgccttctgctagcttttgaatttgtttgcacttgcttctctagttctttcaattgtgatgttagggtgtcaattttagatctttcttgctttttcttgtgggcatttagtgctataaatttccctcttcacactgctttaaatgtgtcccagagattctggtgtattgtgtctttgtcttattggtttcaaagaacatctttatttctgccttcattttgttatttacccagtagtcattcaggagcaggttgttcagtttccatgtagttgtgtgttttgagtgagtttcttcatcctgagttctaatttgattgcactgtggtctgagagactgttgtgatttcttttcttttgtgtttgctgaagagtgttgtacttccaatgatgtggtcaattttagaataagtgcgatgtggtgctgagaagaatgtatattctgttgatttggggtggagagttctgtagatgtccattaggcctgtttggtccagagctgagttcaagtcccgaatatccttgttaactttctgtcatgttgatctgtctaatattgacagtgggttgttaaagtctcccattattattgtgtgggagtctaagtctctttgtaggtctctaaggacttgctttatgaatctgggtgctgctgtattgggtgcatatatatttaggatagttagctcttcttgttgaactgatccttttaccattatgtaatggccttatttgtctcttttgatctttgttggtttgaagtgtgttttatcagagactaggattgcaacccctgcttttttttctgctttccatttgcttggtaaatcttcctccatccctttattttgagcctatgtttgtctcagcacgtgagatgggtctcctgaatacagcacaatgatgggtcttgactctttatccaatttgccagtctgtgtcttttaattggggtattcagctcatttacatttaaggttcatattgttatgagtgaatttgatcctgtcattatgatgttagctggttattttgcctgttaattgatgcagttttttcctagcatagacggtctttacaatttggcatgtttttgcagtggctggtaccggttgttcctttccatgtttagtgcttccttcaggagctcttataagacaggcctggtggtgacaaaatgtctcagcatttacttgtctgtaaaagattttatttctccttcacttatgaagcttagtttggctggatatgaaattctgggttgaaaattcttctctttaaaaatgtttaatattggctgtcactgtcttctggcttgtagggtttgtgctgagagatccgctattagtctgatgggcttccctttgtgggtaacctgacctttctttctggctgcccttaatgtttttttccttcatttcaaccttggtgaatctgacaattgtgtgtcttggggttgctcttctcaacgagtatctttgtggtattctctgtatttcctgaatttgaatgttgacctgccttgctaggttggggaaggtctcctggataatatcctgaagagtgttttctaacttggatccattctccccgtcagtttcaggaacaccagtcaaacgtagatttggtcttttcacatagtcccatatttcttggagaatttgtccgtttcttttcactcttttctctctaactttgttttctcactttatttcattaatttgatcttcaatcactgttatcgttccttccacttgattgaatcagctatcaaagcttgtgcatgtgtaatgaagttttcgtgctgtggttttcagctccatcagctaatttaaggtcttctctacactgtttattctggttagccagttgtctaaccttttttcaaggcttttagcttccttgcgatgggttagaacatgctcctttagcttggagaaatttgttattaccaaccttctgaagcctacttctgtcaacttgtcaaactctttctccatccagttttgttcctttgctggtgagaagctccaatcctttggaggagaagaggcactctggtttttggaattttcagcttttctgctctggtttctccccatctttgtggttttatctacctttggtctttgatgttggtgacctacagatggggttttggcgtagatgtcctttttgttgatgttggtgctattcctttctgttagttttccttctaacagtcgagcccctcagctgcaggtctgttggagtttgctggaggtccactccagaccctgtttgcctgggatcaccagtggaggctgcagaatagcaaatattgctgcttgatccttcctctggaagctttgtcccagaggggcacccacctgtatgaggtgtctgttagcccctactgggaggtgtctcccagtcaggctacacagggatctgggacccacttgaggaggcagtctgcccgttctctgaacctgaacaccatgctgggagaaccactgctctcttcagagctgtcagacagggacgtttaggtctgccaaagctatctgctgccttttgttctgctatgccctgcccacaaaggtggaatctacagcaaggcagtaggccttgctgagctgcagtgggctccgcccagttcgagcttcctggcctctttgttttcacggtgagcacaaaaccgcctactcaagcctcagcaatggcaacacccctccccccgccaagctgctgagccgcaggttgatcttagatgctgcgctagcagtgagcaaggctccttgggcatgggacccgccgagccaagcacgggagggaacttcctggtctgccggttgtgaagactgtaggaaaagcacagtatttgggcaggagtataccattcctccaggtacagactgtcatggcttcccttggctaggaaaggaaagtccccagaccccttgtgcttcccggttgaggcgatgcactgccctgctttggttcgccctccgtgggctgcatccactgtccaaccagtctcaatgagataaaccaggtacctcagttggaaatgcagaaatcactcatcttctgcatcaatcttgctgggagctgcagactggagctgtttttactcagccatcttggaagcctccccactttgaataaactttctaatcttatctctttctctgcttcttctttaaggccaatgatacttagatttgcccttttgaggctattttctagatcttgtaggtctgcttcattgttttttattcttttctcttttgtctcctctgaccgtatattttcaaatagcccgtcttcaagctcactaattctttcttctacttgatcaattctgctatttaaagattctgatgcagtcttgttcattatgccaattgcagtttacaactccagaatttctgcacagctccagaatttctgctttattcttttaatttcaaataaatttgtctgttaaaacttaacaaaaacttgttaagtttatctgataggattctgaatcccttctctgtgttatcttgaatttcttcgagtttcctcaaaacagctattttcaattccctgtctgaaaggtcacatgtctctgtttctccaggattggtttctggtgcattttacttgatgtggccatgtattcccggattgtcttgatacttgtagatgttcttcagtgtctgggcattttagtgttaggtatttattttagacttcacagtcttggcttgtttgtatccacccttcttgggaaggctttccccatgttcagaaggacttgagtgttgtgatctgagctatatctgttttagggggcatcccaagcccactaatgctctggttcttgtagacatatagaggtactaccttgatggtcttgggcaaaatctgggagaattctctggattaccaagcagaggctcttgttttcttcccttactttctcctaaacagagtctctctctctctctctctttctctctttctctctttctctctctctctctctcctgagctacctgaaacttggggtttagtgacacaagcactaccactttgactgtgctgggtcatacttgaagccagcacagcactgggtctcacccaaggtttgctgtaaccactctctacctaccacctatgtttgctcaagactgtggggctctatagtcagtaggtagcaaagccagccaggcctgtgttcttcccttcagggcagtgagttcccccacaccacagaagagtacagaagtgccatttgggagccagggactagagtcagaaaccttagatatttacccagtgctctattatattttactgtgactgagctgtcagttaaaccacaagatgcaatccctcccactcttccctccccctttccaaaggcagaggaacctcaccttgtggcaactgccatcccaggccacaaggagtactgcctgactactgctgaccactgtttccttaaggcccaagggctcttcagtcagcttttggtgaatgctgcctggtctgggactcacccttcacagcacccggctcccttctcactcacggtccagaaatgccattcaagagccaatcctggaattggggaccctaagagcttgcttggtgctctacttccctgtggctgagctggtacctaagatgcaagacacagtcccctttacgtttccctctatttttctgaagcagaagggcctctccctgaagccaccacagctgggaatgtgctgagtctcacctgaagtcagcaagtctcagggtctcacccgaagtcctcgacgtaggacctgactatcactgctggttattcagggcccaagggctctttggttagcagatgatgaatgattctagaactaggtcctttccttcaagagagggttctcttctggcccagggtttgtgcagaaatgtccgggagctaggacctggagaggaggcctcacaaccctaacccttgtcctatcctgctgtggttgagctggtattcgaagtgcaagacacagtcccctttatttttccccctgtttttctcaagcaaaaggagtttcgcctcatatccaccacagctagtaatgcactgagtctcacctgaagccagccagtctgaggctcacttaatgcccttgatgtagtacctgggtgtcactgttggttattcagggcccaaggactctttgttagcaggtgatgaatgatgccagaactgggtccttcccttcaaggtagtgggttccctgctggcccaggatttgtttagaaaaatgttcaggagctaggatctgaaagggggcctcacaaccctgacccaggccctatcctactgtagctgagctggtatccaagatgcaagacaaagttctccccactcttcgattttctctccttaaatggaaggaaggggtctcttttggagtcttgttgagctgtgcagcctggggttaggagagaggtgatatcagcactctctagccaccctggctggtgtctcagtagtttgcacgccctccccgcccccctcgccgcccaccccccccacccaaattccggtgactctgggcttagttcagcactaggactctcttaggagttgcagtctttgtggcctaggctgcctttaaagttcatttaccgacccacagtactttagcccacggtggcggggcttgtgggatctcaaggtctgactgctaggatcagcaattccattctgactcgggctggtttaaacaccccctccacgggcaggcgtcagctgagattggtcctgcttttctttctgctataatggagcagcagtgagttcaatgcctcataattgttgtgctctccttcccccagcatacagcaatgctctttgcaccaccgccactgccaggggacgggaaaagggtggcttctgcgattcaagactgtttttctacctctttagtgcctcttttagcaatatgaagttaaaaccaggtactgtgagtttccacctgatttctggttcttaggaaggtgatttttttgtgtagatagttgttaaattggtgtctttgcagcaggagggacgattggtggagccttctattccatcatcttgttccacctctggaattgctgatcttaggtgaatattttatagtatactattttaatttttgtaacattttttggattacgttttcttgtctttttcttttctttttttttttttttttttttgagacagagtatcgctctgtcacccaggctgggatgcagtggtgccatctcggctcactgcaatctccgccccccgggttcaagcaattctcttgcctcagcctcccgaacagctgggattacaggcctgtgccaccacgcccggctaatttttgtatttttggtagagaaggggtttctccatgctggccaagctggtctccaactcctgacttcaggtgataaaagctttactacttcatagctttattctcttttcttttttggtgattattattatacttactatgtctatatatgtttaaaaactcaagtatgcatggttataattattgctttgcaaaatcttatgtattttaaagaagatgagacataaaacagaacacaaacatatttattgtgtttttaaattttcaaccttcttataacttttggttcacttcatttcttcttttagatttgaactaccatctggtgtaatttcctgaatttctttcccacccaatctgctcttttgtgttaatcgttatcgaatatattacaaatgttatgccccagtaatacaccttaagaatttttttacacagttgctttttaaataaattaagaaaggaaagtagaagacatatataatcatactttcttttataattacctccataattactagccctgtttattttttcatatgaattcaaattattctctagtgtcacttgctttcagcatgaagaacctccttttgtatttcttataagacagattggctaacaagaaattctctcactttttgcttacctgggaatgtatttatttactcttaattttgaaagatagcttttctagatataagattctaatttcacagatttttttttcttttttttgtttattatactttaagttttagggtacaagtgcacagcatgcaggttagttacatatgtatacatgtgccatgttggtgtgctgcacacagtaactcgtcatttaacattaggtatatctcctaatgctatccctcccccctccccccaccccacaacaggccctggtgtgtgatgctccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcgttttttatggttgcatagtattccatggtgtatatgtgccacattttcttaatccagtctatcattgttggacatttgggttggttccatatctttgctattgtgaatagtgccgcaataaacatacgtgtgcatgtgtctttttatagcagcatggtttataatcctttgggtatatacccagtaatgggagggctaggtcaaatggtatttctagttctagatccttgaggtatcgccacactgtcttccacaatggttgaactagtttacagtcccaccaacagtataaaagtgttcctatttctccacatcctctccagcacctgttgtgtcctgacttttatatatatatatatatatatatatatatatatttttttttttttattatactttaagttttaggatacatgtgcacattgtgcaggttagttacatatgtatacatgtgccatgctggtgcgctgcacccactaactcgtcatctagcattaggtatatctcccaatgctatccctcccccctacccccaccccacagcagtgcccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaaaccagtctatcattgttggacatttgggttggttccaagtctttgctattgtgaataatgccgcaataaacatacgtatgcgtgtctttatagcagcatgatttatagtcctttggctatatacccagtaatgggatggctgggtcaaatggtatttccagttctagatccctgaggaatcaccacactgacttccacaatggttgaactagtttacagtcccaccaacagtgtagaagcgttcctatttctccacatcctctccagcacctgttgtttcctgactttttaatgattgccattctaactggtgtgagatggtatctcattgtggttttgatttgcatttctctgatggccagtgatgatgagcattttttcacgtatcttttggctgcataaatgtcttcttttgagaagtgtctgttcatgtccttcgcccactttttgatggggttgtttgtttttttcttgtaaatttgcttgagttctttgtagattctggatattagccctttgtcatatgagtaggttgcgaaaattttctcccattttgtaggttgcctgttcactctgatggtagtttcttttgctgtgcagaagctctttagtttaattagatcccatttgataccaaagccaggcagagacacaacaaaaaaagagaattttagacccatatccttgatgaacattgatgcaaaaatcctcgataaaatactggcaaaacaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaacactggaagcattccctttgaaaactggcacaagacagggatgccctctctcaccactcctattcaacatggtgttggaagttctggccagggcaattaggcaggagaaggaaataaaaggtgttcaattaggaaaagaggaagtcaaattttccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattgaaaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcgatatcgtgaaaatggccatactgcccaaggtaatttacagattcaatgccatccccatcaagctaccaatgcctttcttcacagatttggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattacctatttaataaatggtgctgggaaaactggctagccatatgtagaaagctgaaactggatcccttccttacaccttatacaaaaatcaattcaagatggattaaagacttaaatgttagacctaaaaccataaaaaccctaaagaaaacctaggcattaccattcaggacataggcatgggcaaggacttcatgtctaaaacaccaaaagcaatggcaacaaatttcacagatgtttgaatacatcctttttgccttctttactccatgaactctgaggggtgtcagctgttaatcttattgttactcccctttatgtgatgagtcatttttctcttactgttttcaagattttctcttcatctttgatgttcaataattttcgctcatcatgtgtctggatgtagcttttttaatgcttatcctgttgaatttcattgagcttcttggatgtgtcgattattgtttttcatcaaatttggagagttttaagaccatcatttctttgaatatttatttgtccttttctttcttttcttctggtactcccattatgtatatgttggtgtgcttaatggtgtcttacatttttctgagcccatgttcatttttcttcatttttttttctgtttgttcctcagatttgtatcgtttctattgctcttcaggttagtttattgtttcttttgcctgctccaatctgctgaatttttcatttcagttattgtacttttcaactccagaatttccatttgtttcttttttaaaaaataataagcattaggagatatacctaatgtaaataacgagttagtgggtgcagcacaccaacatggcacatgtatacatttgtaacaaacctgcaggttgtgcacatgtaccctagaacttaaagtataataaaaaatatataaaaaaataataatttctatctcttaactgatacactcatattctccatatgatgagtcattgttatcagaccttcctttaatttttaaacacgattttaaaaaattctttggacgtaattataaaagttgctttgaagtctttttctattaagtgcaacattggggcctcctcaaaggaagtttcttttgctttttttcttctgtgtaggtcacactttttaattgtatgtcttacaatgttttgttaaacactagacattttggaaaatatattgtagcaagtctagatacagtttctcctctttctggggcttattgtttttattgtttgtttagtcatttatttgttcagtcacttggctggactaatttggtggaatttattttccacacactgtgtggcctctaatattcctgctcagaatttttccccttgtttttatcttttcatgacttcttatggagtcacccctgcatccacatagttcacttactggctaaaggttgtgctgaagctcacttagccagttagattttttcatcctttcctggatgtatgtttgtttagagactgcttttatagttctgggagagactaattcagtcggggactaatagcttgtagattctttatctgctcatacccaagaaagcagtcttgagcatgtgcacagtctcccagatccctcagtatgaggtcgatttgatttttaagctgggttccctggatcttagcttacctttcagttggtgtttggtcagacgatctgcttaagccccttgagccaatgaggctcaaggtactttgctgatagatctgtttatgccttgggtaatgcttttcagtttgccccaacactttctctgattgtgcgtgagtgggtgcagaatggcacatgggcacagtcttctggacccctagagataagtgtgaccccagaggttttcttcttggctgtttccctgattctctggtaaccttctggttggtctgctgtttcccttattgctaccattatcatggagctaccagctccctcttaattgctcactatcaagatctccattgttttcagcagtgtccttagacatgatcttctccatgctctgttttaaatacatcattcccctcaggaagagatgcagagttcttcctctttgcttctgttctttctttctggtcagaacctctgtgccacacgactagagctgggctcatggcatgcttctcttgaaatggcacccctaccatattagtaaattagtaaattctggcggtatggtagcccttggtcttcttagtgtgcccttttgacatgaaacctctgcctgatgagccagctggagtaaagatgatcaggatctcagtattcttgacctgtcacatttggggtagaatccttaccctaagagtgagagctgagtgggcaaagaaaagccagtcctctccatcgtacttgcccagaacacttccatgacacaggcctgagaatggcaagatagtctggcagcctgcttctctgcaggtgaaaccatagcctaggattttaggagctggcgggagagggaattcctatcttcttggctgcacccatctggagcagcttccatcacatggagccagtatagatgggagcagtttatagttcaaatgccatagactctcactggttatactgagatttagtttattttcatgaataaatgttttccattttctgtgtgcccttaggacaatttcaattttcagagactaagtggttgttttaatgaattttccagatgagtggttgtttcgctggggagagtgtctaaagagctccttatatcaccattgcagaagttccacccctcactggttatttaaaaaagtggaagtataaggttaatgtactaaaggagacctctatgaaatagggcttacaatgactaagccagcattatatctttgttagcaatctgaaaactcagtttggtagttctgggtcatttatagtttatgtttatttatatttatttatttatttcgagacacagtttcactctgtcgcccaggctggagtgcagtggcacagtattggctcactgcgacctccacctcctaggtttaagcgataatcatgcctcagtctcccaagtagctgagattacaggcatgtgccatcactccggctaatttttgtattattagtagagacggggtttcaccatgttggccaagcttgtctcaaactcctgacctcaagtgatccaaccgcctcaggatcccaaagtgctggaattacaggtgtgagccactgtcattggcctagagtttttttttttttaaggaatatttcaaagtattgtcttcaagttagttcagttcaccaacattttattgacatactcccttggaatactaattttatggtgaataatctttgatttgctttgtaggtattaggttttgaaaccttgaaactagtattaatatattatttgtggttactggaatgtcccatagataatatggtttgataattaaagcagagaactgaaaatcaaatttctctgctccccaacccctcaccctcattttcgataccaatctaggaaatatcagaaataattttatttctatattggtttagtcagccgcaaaatggagctaatagtgcttcagaagggtggtgtgagacttaatgaatattgctaaagcgtttgtttctgtgaaaacaactgtatttgttttattttaaatatatatttatacttattcggggtcgggcccaacactttgggaggctgaggctggtggatcacttgagctccggagttcgagaccaacctggccaacatggtgaaaccctatctctactaaaaatacaaaaaaaaaaaaaaattagccacgcatggtgatgagttcctataatcctagctacttgggaggctgaggcaggagaatcgcttgaacttgggagatggaggttgcaatgagtcaagatcgtgccactgcactccagcctgggtgacagaatgagactccatctcgaaaataactaagtaaatcattaataaataaatatatatttatattccttcaactttaaatggccaactaagagcttgtatacacttgtaaagtattttaatgcagtatgtattataataatttaatgcagtaaattatatatatttaatgtagcatattaagttatatatatttaaggcagtatattaaattatacctatttagtgcagtatatattatatatattcaatgctatatatatagccaaatggaaaaaggcatcaatataattgtagtgttgatttattgggtatctcctaaggaaattgttttctacagttagaaagtattgctttatatcattatatcatatggataataatctgttgtagtgcaaaacagaaaagttggaataaagtatgcttataccatgtcttcttagtaatatataatcttgaaaattatatataatttgaaatggatatatgtttatatatatatatatattttttttcctttttaatgatagccaaagctatgatattgggaagatggataagaaatctactgggccagaaatgctggtaaggatcatgttaaatattgtagaaataggttgaataacctgctttattttattgttataaaattataatagcgtactccccatttatgagtagattagctattgggcacaacatttaacatctcagtgtatttgtttttgtatatttatataataatataatctaactcataggcatgtacccatgaattaatatatgtagagtgctttgaacaatgtttgggtatgtaaattttaactttcttttctgtgtgtgtgtgtgtgtgtgtgtgtgtgtgtgtgtgtgtgtgttttgagatagagtctcgctctgttgcccaggctggaatgcagtggtgggatcactgcaacctctgcctcccaggttcaagcgattctggtgcctcagcctcccaagtagctaggactacaggcatgagccaccacacctggataatttttgtgtttttagcagagacggggttctgccatgttggccaggctggtctggaactcctgacctcaggtgatttgcccaccttggcctctcaaagtgctgggattacaggagtgagctaccgtgcctggcctagttttaacttttcttattgcatattttgaagttgcagatttttccccaactgcccagacagaacgtgcttggatatggaaattaatcttaatatgtaatcaagcaaaatgtgattgtgtaaataaatgtgatgtaaaattactacattctatagcaaaatggaatcttttgaatatccatttgattcttactattacagcatattaatcaaaatgtaactggatacctttttaatgtatttaccactgtaatatatggggaataaaagagaagcataaaatgtagcttctgcccttaaggaacttatgattaaaggataaaactagtacaagtgactacaatgaaatattatcctggcttaataaagaaagaaatctgacacatgctacaacatgggttaactgtgaggagactacgctgagtgaaacaagccagtcacaaaaagacagataatgtatggttccacttatgtgaggtatgtagagtagtcaaattcatagagacagaaagtaaaatggtggttttagggggtagggagaggggagaattgggaactattgtttagtgggtatagagtttcagttttgcaaggtaagagagttctcgagatggatgctggtaatgattgcacaagagtgtgaatatacttaatactactgaactgtacacttaaaaatgtttaagatggtcatggagccgggtgcagtggtgtgtacctgtagtcccagctactcaggaggctaagccaggaggattgcatgaaaccaggagtttgaggctgcaatgagctgtgatcatgcctgtgaatagccactgcattccatctgggcaacatagtaagactccatctccaaaaaaaatttttttttgagacagggtcttgtcacccaggctggagggcagtggtgtgatcagctcactgtaaccttcaaactcctgggctcaagcagtcctcccttcttaacctactgagtagctgggactacaggtacactccaccacatctggccaatttttaattttttatagagacgggggtctcactttgttgcctgggctggtctcaaacacctggcctcaagtgatcctcccaccttggcctcccaaggttctaggattacaggcatgagccactgcacctggcctaagattttaaaaaaagtttaagatggtcaattttatgttatgtgtattttaccacaattaaataaattatttatatataaatatataatatttatatttatatatagtgacattgtcacttattatataacagtgagactcaattaactataataattgcaacgatatggatgttctcacctataatattgaacaaatgaagcaagatacaaagtagtacttactgtatgattccataaatgtaaatgccaagaacagtcaaaatgaatatatggtgttggacatcagggaattggttacccctatttgaaacagggtctgaaaagaagcatgagtgggcttgttgctgttaatgttctgtttcttaacttttttgttgttaacatacatgtgtttactttgggaaaattcgtagagcctagaattcataagagcatagagctcttgagatttttatacttttctgtaagtcttttatacttcaatgaagaaaaatagaatttaaaaaacactactagaagtgaaacaatttgggaagataatgataaactttgtggtactgacctgaagtatgcagaagggcatatagaaaaggagattatcaagattagctagagtagttgtaggagccttttggtaggagacaggcctttttggggtccacacagttaaaagggaggaagaaaatgactccaggcaagggatctagatgggagatgtctaagaaggaaataaggatggaagataggatacaagcttgattaaaatggaatattcatattccatattgtaagtttagtgaggtaatactatgcagtaattttttatttcatgccagcagtcatttatttgaggtgtaatttatatacagtaaacttcacaagtctcaagtgtacagcttgatgagttttaatatatagtagtcttgtatattacaccatacagatcaagatacaaaaacttcccaacacccccaaaagttcccttggccccattctagttaatacccacctctacttccaagaacaaaaaaacaccattctgacttttactactctagattatttttgactgtttttgagctttgtataaatggaatcatacagttgtcctgttttatgtctggcttttttaaaacatacattgtgagattcgttcattttgttacgtcttttggatgatttgacactttcactgttatgaaatagctacagtatttctcagaaatgccatatttactccataaaagtcatttgggggagcttataaattcttagagttgttccacgataataatgtggtggtaagctgattaaatgaaatattgctctgcctcagtttccttattttaaaaggggggatgataaaatacgttaaatactgttaagaaaataattatattaacataattatattaaatgtaaataagccaggaatatagccattactgtaacattcttagacaatattttatatgggtagcataatgatgagacatattccaagactgtggtcgcttaaggaaatgctatttcataaagatgacttatgtttgagaagatgcctgtcactgtgggagtgctagtcagctgttgtattgaagtttaaccatcagatatgtgctttttttctttttttttttcttacaggctaaagttctacggctattagccacgaattatttggattgggatgacaccaaatattatgataaggctctcaatgctgtaaacctagcaaacaaggtatggggcttgtatttttgaatactaacttaatgtattttttgaagtcttgatcacattttgaaatccagtttagacatttgcttcagcatttactctcacagattgttataatctcttctatagcacagaaaggaaaaataaaatattgctataatctgaatgtttgtgtccccgcaaattcctatgttgaaatcttaacccccaaagtgatgatattaagaggtggggactttttggtgtagaatggacgtaaaaataaaaaaggtggggactttgggagatgataaagtcattgggcaaacccctcttgaatggtattactgcccttataaaagaggtccacaggagtttgttcaccccttttatcatgtgaggacatgagaaggcactgtctttgagtaagcaggccctcaccagacaccgaatctgcgagcaccttgatgttggagttcccagccttcagaactgtgagaaatcaatatctgttgtttgtaaagtatctagtttatggtattttgttatagcagcatgaacagactaaaacaaatatacttctttgaacaccagagatttttgagaaaattttcttttctgtgaaacagaaagggatgtctctactgtgagtttttaggatgaagaagtaaatgataaaatacgcagaataatgggatttaattttaaaaacaactccagtggttgactttcagctcatgttcacacatacctaaaaacatgaatacaaagcgggcgtggtgacacatgcctgtatttccagttgctcaggaggccaatgtgggagatttgcttgaggccaggagttcaaggctgcagtgcactatgattgcatctatgaatagtcactgcacttcagcctgggcaacataatagcaagaccccatctctaaaacaaacaaaacaaaatgtgtatatatctacactcctggacaaggaacactgaaaggctggtgaccctttaaaaatagattcaggctgggtgcggtggctcatgcctgtaatcccagcactttgggaggctgaggcaggcagatcacaaggtcaagagatcgaaaccatcctggtcaacatggtgaaaccccatctttactaaaaatacaaaagttagccaggtgtggtggcatgtgcctgcagtcccagctactcgggaggctgaggcaggagaatcgcttgaacccaggaggcagaggttgcagtgagccgagatcgcaccactgcattccagcctggtgacagagcaagtctccgtctcaaaaaaaaaaaaaaaaagaaatgaaataaaataagagagattcaattaggatcaatgtgttttacttaataaggcaattaaatatactgatacactttagaaaggtttttttcaacagagtggaagcatgaaaatgaatagctcgatcaaccagaatgttaaatttgtcaaacagagcatttacttgaactatattttcctgaaatttatgttatgtggatggggttatttaatgctgaaaaacttgttcaacattaaaattaaaaaattaatgtagaaatatttatagacaggaatattttctttttttaaattttactttaagttctaggatacatgtgcagaatgtgcaggtttgttacataggtatacatgtgccatggtggtttgctgcacctatcaacccgtcacctaggttttaagcccttgcctgcattaggtatttgtcctaatcctctccctccccgtgcctcccaccccctaacaggccctagtgtgtggatgttcccctccctgtgtccatgtgttctcattgttctactcccacttatgagtgagaacatgtggtgtttggttttctgttcctgtgttagtttgctgagaatgatggtttccagcttcatccatgtccctgcaaaggacatgaactcattcttttttatggctgcatagtattccatgctgtatatgtgccacattttctttatccagtctatcattgatgggtatttgggttggttccaagtccttgctattgtaaatagtgctgcaataaatatacgtgtacctgtgtctttacagcagaatgacttataatccttcgggtatatacccagtaatgggattgctgggacaaatggtatttctggttctagatccttgaggaatcaccacactgtcttttacaatggttgaactaatttacactaccaccaaaagtgtaagagcgttcctatttctccacaaccttaccagcatctgttgtttcctgactttttaataattgtcattttaactgtcgtgagatgttatctcattgtggttttgatttgcatttctttaatgaccagtgatgatgagctttttttcatgtttgttggccgcataaatgtcttcttttgagaagtgtctgtttatatcctttgcccactttttgatggggttgtttgtttttttcttataaatttgtttaagttccttgtagattctggatattaaacttttgttagatgggtagattgtaaaaattttctcccattctgtagattgcctgttcactctgaagataatttcttttgccctgcagaagctctttagtttaattagatcccatttgtcaattttggcttttgttggaattgcttttggtgttttagacatgaagtctttgcctatgcctatgtcctgaatggtattgcctaagttttcttctagggtttttattgttttggttttacatttaagtctttaatccattttgagttaatttttgtataaagtgtaaggaaggggtccagtttctgttttctgcatatcagccatactatttttcttagcaactgtatcattttaaattcccatctatagtgcacaagggttgcaatttcttcacgtcttcagcagcacttgttatcttctattttttaataatagacatcattatgagtgttaggttcacctttgttttttgaatgatattttttccaggtatagaatttaaaccagacagctttttttggggggggggtattttaaatatttcattccactgtattctcattctgttgtttctgttgagaaatatggtgccattcttatgtttgttcttttttatatagcgtgtcttcttttctgaataagttttggattttttatcattggttttgagcaacttgatgttatgcttttaagtaattttatttacgtttctcgtgcttggggctctttgtgattttttggatgtctaggagcataattttcattatgtttgaaaagttccagtatttcttcaaattttttttctgctttcccccaagtactctaattaaccatgtattaggctgcctgaagttgtgccatagtttgcttatactcttttcacttaaaacataatttgttatttttgtttcattttggactgttttgtattgctattacttttaagttcattaatctttcttctgcaatgtctaatcatctgttaatctcatcccatatatttttcatttcagactttgtagtttttatctctaaaagtttgatttggtttatttttatatcttccaagtctctagttaaatttttgagcatacgaaatacagttatacttactcttttaatgtctttctttgataattctaatatctatgtcacttctagattagtttccatctattatctccccattattgattgtttttgcctgctctgtctttcactgggtgccaactattttacatcgttggctgctggatatttttgtaatactataaatcttattgagctttattatgggaaacaggcaagttatttggaaacgatttgatcccgctgttcatgtgaactcctgactcttgcttagtatgaaatatttccttctttgttttgtaattatggatatgttaatttatgttcagtgagtgttaagtttttagaatcctattcaacctggattgagagcatggccctgcagagaaactttttattggcatcagccagatgtaaaagagttaccactcttttggttacttttattttactttctcagattggaggtttttggaccacatgagtaatgtaaatttgaactctgtatctacatgaaggcagagcccattaaaaaattatccaaaccaaaaaacttatctacacaaactttttttttttttttgcctcactcagagcttagctagaagacaaacttcctatgccattagataaaagaaaaaaactcaggaaacttaccacctccatatggttcacttctccaagttttgttgcctcactacaatctttgtttttgtttacttttaagagtcctcaggttgttgctttttatatcttgttcagagttcttagttgtaattagtagaaggtataggcttagttgtcttgcttcatatctgctggaactgaatctgatagtaaatttttaaaggagaaattaaaatttggtatgcctatgttgtttcacaaaattacctttgaaaatgtattagtgcaatgaaataaatataaaaggcataggtgcttagatactacaccaaaagcacaagcaaaaaagaacaattaggtaaaattaagtctcattaaaattaatttttttgcttcaaaggaaatcatcaagaaaatgaagacacaatccataggatcctcccaacagaatgggagaacatatttgcaaatcatatatctgttgtctattaaccataatataaaaaagaactcttactattcaataagaagacaaacaacccaattgaaaatgggctaaggaggcaaaggagctcaatagacattctccaaataatacgtaccagtggccaataagtacacaaaaagatactcaatatcattagttatcagggaatgcaaattagaagcacaatgagaaaccactttacatccactggtatggccctccgacttgtttttatttcagaattgttttggctcttctgaatctcttgcattttcatattttggaatcagcttgttgatttctgcaaagaagacagctgggaatttggtagggaatttgttgaatctgcagatcaatttgggaattattgctatcttaacaatattaagttttcaaatccaggaacatttattcattgttttgtagttttcaataaataagttttgtccttcttttgttaaatttattgcttctttatgcttttataaatggaattattttcttgacttttggattgttcattgctagtatatagaaatgccattaattgaaaaaatactgatattatatcctacaatcttcctgtacttgttcttttagctttaatagttttttaatggattacttaggattttctgtatacaagatcatattttctggccggacgctgtggctcacacctgtaatcccagtactttgggaggctgaggtgggtggatcacttgaggtcaggagttcgagaccaacccggccaacatggtgaaaccccatctctactaaaaatacaaaattaaccagacatggtggtgcatgcctgtaatcccagctatttgggaagctgaggcaggagaatcacttgaatccagaagggagaggttgcagtgagccaagattgtgccattgcactccagcctggacaacaagagcaaaactccgtctcaaaaaaaaaaaatcatattttttgtaaataaagatagttttacttcttgctttccaatctgcgtgccttttgtctctttttcttttctaatttttctagcaagaacattcattactatgttaaatagaattggcaagagcagtatctttccctaatcttagagagctttcagtattttgccattaagtatggtgttagctgtgggtttagtatagatgccctttgtcaggttgaggaagctcccttcattcctagttttttgagaattgtacaaccacgttaaaaaacagtttgaagttacttgataaaataaaatttgatcatactggaccacccagcaacttcactcctaggtagtgaagcgctagcatttgtatacaaggagaggtatacagaatgctgattccaggattgttcataatagcaattgcgttggaaacagcttaaatatccaaagtagaatgtgcaaataaagtgtgaattattcataaaacagagtactatacaacagttgttcttaatatttagcttgtgtaagtattacctagagtgtctgttaaacacagtttgctcatttgttaccttactaaacagataatagaatttatgttgaattggaaactttccataatgcaaatcaataataattattttacacattttcccccacacatgcacatacaatttgctaggcaatactcccagagtttctcatttagtaggttttggatggggcttgaatttctttttttttctttttttttaaattatactttaagttttagggtacatgtgcacgacgtgcaggtatgttacatatgtatacttgtgccatgttggtgtgctacacccattaactcgtcatttaacattaggtatatctcctaatgctatccctccccactccccccaacccacaacaggccctggttgtgatgttccccttcctgtgtccatgtgttctcattgttcaattcccacctatgagtgagaacatgcggtgtttggttttttgtccttgcgatagtttgctgagaatgatggtttccagcttcatccatgtccccacaagggacatgaactcatcattttttatggctgcatagtattccatggtgtgtatgtgccactttttcttaatccagtctatcactgttggacatttgggttggttccaagtctttgctattgtgaatagtgccgcaataaacatacgtgtgcgtatgtctttatagcagcatgatttatagtcctttgggtatatacccagtaatgggatggctgggtcaaatggtatttctagttctagatccctgaggaatcgccacactgacttccacaatggttgaactagtttacagtccgaccagtagtgtaaaagtgttcctattttttcacatcctcaccagcacctgttgtttcctgactttttaatgatgccattctaactggtgtgagatggtatctcactgtggttttgatttgcatttctctgatggccaatgatgatgagcattttttcatgtgttttttttggctgtataaatgtcttcttttgagaagtgtctgttcatatccttcaccaacttgttgatggggttgtttgttttcttcctgtaaatttgtttcagttcattgtagattctggatattagccctttgtcagatgagtagattgcaaaaattttctcccattttgtaggtcgcctgttcaccctcatgatagtttcttttgctgtgcagaagctctttagtttaattagatcccatttgtcaattttgtcttttgttgccattgcttttggtgttttagacatgaagtccttgcccatgcctatgtcctgaatggtattgcctaagttttcttctagggtttttatggttttaggtctaacatttaagtctttaatccatcttcaattaattttagtataaagtgtaaggaagggatccagtttcagctttctacatatggctagccagttttcccagcaccatttattaaattgggaatcctttccccattgcttgtttttgtcagatttgtcaaaggtcagatagttgtagatgtgtggcattatttctgagggctctgttctgttccatttgtctgtatctctgttttggtaccagtactatgctgttttggttactgtagccttgtagtatagtttgaagtcaggtagcgtgatgcttccagctttgttcttttggcttaggattgtcttagcaatgcaggccctattttggttccataggaactttaaagtagttttttccaattctgtgaagaaagtcattggtagcttgatggggatggcattgaatctataaattaccttgagcagtatggccattttcatgatattgattcttcctacccatgagcatggaatgttcttccatttgtttgtatcctcttttatttcattgagcagtggtttgtacttcttcttgaagaggtccttcatgtcttttgtaagttggattcctaggtattttattctctttgaagcaactgtgaatgggagttcactcatgatttggctctctgtttgactgtttttggtgtataagaatgcttgtgatttttgctcattgactttgtgtcctgagactttgctgaagttgcttatcagcttaaggagattttgggctgagacgatggggttttctagatatacaatcatgtcatctgcaaacagggacaatttgacttcctcttttcctaattgaataccctttatttccttctgcctgattgccccggccagaacttccaacactatgttgaataggagtggtgagagagggcatccctgtcttgtgccagttttcaaagggaatgcttccagtttttgcccattcagtatgatataggctgtgggtttgtcatagatagctcttattattttgagatacatcccatcaatacctaatttattcagagtttttagcatgaagggttgttgaattttgtcaaaggccttttctgcatctattgagataatcatgtggtttttgtcattggttctgtttatatgctggattacatttattgatttgcacatgttgaaccagcctcgcatcccagggatgaagtccacttgatcatggtggataagctttttgatgtgctgctgaattcaatttgccagtattttattgaggttttttgcatcaatgttcatcagggatattggtctaaaattctcttttttggttgtgtctctgcccggctttggtatcaggatgatgctggcctcataaaatgagttagggaggattctctctttttctatgattggaatagtttcagaaggaatggtaccagctcctccttgtacctctggtagaattcggctgtgaatccatctggtcctggactttttttggttggtaagctattgattattgcctcaattttagagcctgttattggtctattcagaggttcaacttcttcctggtttagtcttgggagggtgtatgtatcgaggaatttatccatttcttctagattttctagtttatttgcgtggaggtgtttatagtattctctgatggtagtttgtatttctgtgggatcagtggtgatatcccctttatcattttttattgcgtctatttgattcttctctcttttcttctttattagtcttgctagcggtctatcaattttgttgatcttttcaaaaaaccagctcctggattcattgagtttttgaaggcttttttgtgtctctatttccttcagttctgctctgatcttagttatttcttgccttctgttagcttttgcatgtgtttgctcttgcttctgtaattcttttaattgtgatgctagggtgtcaattttggatctttcctgctttctcttgtgggcatttagtgctataaatttccctctacacactgctttgaatgtgtcccagagattctggtatgttgcgtctttgttctcattggtttcagagaacgtctttatttctgtctttattttgttatgtacccagtagtcattcaggagcaggttgttcagtttccatgtagttgagcggttttgagtgagtttcttaatcctgagttctagtttgattgcactgtggtctgagagactgtttgttataatttctgttgttttacatttgctgaggagtgctttacttccaagtatgtggtcaattttggaataggtgtggtgtggtgcagaaaagaatgtatattctgttgatttgggttggagagttctgtagatgtctattaggtccgcttggtgcagagctgagttcagttcctggatatccttgttaactttctgtcgtgttgatctgtctaatgttgacagtggggtgttaaagtctcccattattattgtgtgggagtctacgtctctttgtaggtctctaaggacttgctttatgaatctgggtgcttctgtattgggtgcatatatatttaggatagttagctcttcttgttgaactgatccttttaccattatgtaatggccttctttgtctcttttgatctttgttggtttaaagtctgtattatcagagagtaagattgcaacccctgcctttgtttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcgcattaacatgtaaggttaatgttgttatgcgtgaatttgatcctgtcattgtgatgttagctggttattttgcccgttagttgatgcagttcagccttgatggtctttacaatttggcatgtttttgcagtgtcttgtaccggttgttcctttccatgtttagtgcttctttcaggagctcttttagggcaggcctggtggtgacagaatctctcagcatttgcttatctgtaaaggattttatttctccttcacttatgaagcttagtttggctggacgtgaaatttgggttgaaaattcttttctttaagaatgttgaatattggcccccactctcttctggcttgtagagtttctgccgagagatcagctgttagtctgatggacttccccttgtgggtaacccgacctttctgtctggctgcccgtaacattttttccttcatttcaactttggtgaatctgacaattatgtgtcttggagttgctcttctcgaggcatatctttgtggcgttctctgtatttcctgaatctgaatgctggcctgccttgctagattggggaagttctcctggatagtatcctgcagagtgttttgcaacttggttccattctccctgtcactttcaggtacaccaatcagacgcagatttggtcttttcacatagtcccatatttcttggaggcttttttcatttctttttattcttttttctctaaacttctcttctcgcttcatttcattcatttgatcttccatcactgatacccttttttccagttgatcgaatccgctactgaagcttgtgcattcatcacgtagttcttgtgctgtggttttcagctccatcaggtcctttaaggacttctctgtattggttattctagttagccattcgtctaattttttttcaaggtttttaacttctttgccgtgggttcgaacttcctcctttagcttggcgtagtttaatcgtctgaagccttctctcaactcgtcaaagtcattctccatccagctttgttctgttgctggtaaggagctgcgctcctttggaagaggagaggtgctctgatttttagaatttccagtttttctgctctgttttttccccatctttgtggttttatctacctttggtctttgatgatggtgacaaacagatggggttttggtgtgcatgtcctttctgtttgttagttttccttctaacagtcaggaccctcagctgcaggtgcattggagtttgccagaggtccactccagaccctgtttgcctgggtatcagagcggaggctgcagaacagcggatattggtgaacagcaaatgttgctgcctgatcgttcctctggaagttttgtctcagaggagtacccggccgtgtgaggtgtcagtctgcccctcctggggggtgcctcccagttaggctactcgggggtcagggacccacttcaggaggcagtctgtccattctcagatctcaagctgcgtgctgggagaaccactactgtcttcaaagctgtcagacagggacagttaagtctgcagaagtttttgctgccttttgtttggctatgccctgcccccagaggtggagtctacagaggcaggcaggcctccttgagctgcagtgggctccacccagttcgagcttcccagcctctttgtttacctactcaggcctcggcaatggtgggcgcccctcccccagcctcgctgctgccttgcagtttgatctcagactgctgtgctagcaatgagcgaggctctgtgggcgtaggaccctccaagccaggggtgggatttaatttcctggtgttttgtttgctaagaccgttggaagtgcgcagtattatggtgggagtgacctgattttccaggtgccatctgtcactcctttctttgactaggaaagggaattccctgaccccttgtgcttccctggtgaggcgatgcctcgccctgcttcggctcaggctcagtgcactgcacccactgtcctgcacccactatccaacactccccagtgagatgcacccagtacctcagttggaaatgcagaaatcacctgtcttctgtgttgctcacactgggagctgtagactggagctgttcctattcagccatcttggctccaacccatggcttgcatttcttacaagttcccagatggtgctgattcagggaccaccctttgacagccatgctgtatagtaatgaaaacaaataagtttcacatatctacatggttgaatctgaaaaaacatgatttgaatgaaaggaatcacagaagaacttagatacattatgattctgtttaagtgaagttcaaatgtaggcaaaactaaataattgtgttggctagcttgagctgttataactaaatactataaactgggtggcttaagcaacagaactttatgtctcacacttctagggactgagatgtccaagatcaaaataccagcctttttggttcctggtgggggcctttgtcttggtttgaagatggccaccttctttctatatcttcatttggcagagaaagagagagagagagagatcatctctcatctctctcatgtcttttcttataagggcacttatcccattcatgagggctcagccctcatgaccaaattacctcccaaagcccccacctcaaaataccatcacattggggattagatattcaatatatgaattttagaaagacacaaacattcggtccatagcaactgtatattgtgtatatataaagaaaagcaagggaattactgcacaaaattcaggatggtgtttacctctgtgaggtgaggaggatgcctatgggtaaggatacatttgaggctttttatgtggcaataatctgtttcttaaccttggtagtgaggacaccggtgtttgttttattattattctgtaaactatacatatacattgcatatacatatgtttatatactcatgtgtgtgtatgtgtgtatgtgtatgatacacttcacactagaaatgagtacattatctttagagcttgcaaaatatccagatagtgtagtaatgcctgccatgatagacagagcttcaagggaggcagcatattgtaatggaaagattatgtcctttagagtcagagagatctgaattcaaatttcagctctactacttaccagttgtgtgaccatgggtaagttacttaactttatctggccctgcaaaacaagattcacaatacttatcttgtatgtttgttgtacctggagcctgtttctcagtaactggtgaaaagaaaaaaatcagcaaacaaaaatctaaggaagggagccaggcatggtagttcatgcctataatcccagcacattgggaggctgagacaggaggattgcttgagcccaggaagtggaggctgcagtgagccgtgtttgtaccactgcactccagcctgggagacagagtgagactctgtctcaaataatgaaaaaaaaaaagcagccaggcctggtggctcatgcctgtaatccctgcactttgggaggctgaggcaggtggatcacttgaggtcaggagttcgagaacagtctggccaacatggtgaaacctcgtctctactaaaaatacaaaaatgagccagatgtggtagagtgtacctgtaatcccagctactcgggaggctgaggcaggagaattgcttgaacctgggagacggaggttgcagtgagccgagattgtgccactacactccagcctgggcgatagagtgagactccatcatgaataaataaataaacaaacaaacaaagctatgaagaatgagaaataacagtgggaaaagttacagagaagacaaggattttgatagtagggagaaagctgatggatttagcaggcaatcttcatgacttctggaagtgtagttttaagagacaataaggatggacaatatacggtgcaaatgtttacagaagtgaagacatgatgataacagaagtaaaatgtccattatctggggttgtttggtaatgaaatcagtgaaaatcatatctggaattgtttggtagaaaaaaaccagaatgttaaatttgtgtgagaatagcagactcaaggaaaacagatgttgccaagatctggaagacctctatgtctctgaagataaaagggaattgaatccaacacatacttcaacaaacctacaggaaagatggtaatgcaataaatcaaaattggcaacttcagtttattctttgtactagtgtcatctatatttgcaagcccttttaataccagtgcttactttctccaactttctatttttaagacatctcacatatgaatacctgtaattatgtgcagagtatggagctaatcagtacggtgttcatgtaggggttaattggctttgtagagagaaaagttctgttctgtgggcctagactgtacttttagtcttagaaagttgtttaaagatgtaccctgtcaggcgaaagtggaaccgggaagatcacagatggcttagggccaactaacaatgatttagaaataacgttgttattaatggtaaacacgacaggcatatcttatggaaaagacaatacattttctattttattccgccattgtttgcaaaggaccttagtcaataaatctcaaaagaaaataaaactagccggtttgtggttttgcttacaaagaatatggcctgagatttgtacagtttaagtattaatcttgtcattaaatgtttgtcactcattggaaatatttacatgttcttttccatatattatttcatttagattgaaaaaatattgggaaatatcctcagggatagaacaaatgttatgatatggtcttctgtaatttcgatttcctttgattatgagttatcccaaggtggttgaataaagcaggcaattacttgaaaattgtcttttacattccacaattttaatatcattgtgatttctttgtttaaaataggaacatttaagttctcctgggcttttcttaaaaatgaaaatcctcttgaaaggcgaaacatctaatgaagaactccttgaaggtatgatctctgtatgtgaagagcacaccattttgaaacatcactacaatttgttaaatataagatcttttgtagtatactaacaataggtgtaatttgatggtggctgagaaggaaaatgatcacccaggaaagggaaaatattgtcacccaggaagaaagagagaaagaagaaaaaatagtagcaaatttaaaaggtgtttttttttttaaaaaaagctgaataaaagcaatcagttttcttttagtccagcagagaactgtagctacccaacccttctgaagttgtctaccaccatgaagaaagaaagattacctattaatgggaaaagcctttgtaatgctgtgatttttataattacttgtttataaacattgctatttatttttcataattctccaaggaccagaatgtacactgcacaaaagttggtcattgggcaagtcacttaactttgctttgtttcttcatttagcaaaagagatattattattatctacctcatcatgttgttttgagaatcttgtgagaaaatgtgtataaagcatttaacaccatacctggtgcatagtgtgcaatatatgttacctattactgtagttattattattactgttattactactatatagatgcattacatgaagcaaaactatgcacactagcccttaacatttcagttttgtttagtcataaaaattatttactctaattcttttaatgttgtacatgcttttcagtaatctttaagagctgcattatttgtactatacaaaattatatgttagtatagttactgattatccaataaataataacaatttgttatagttagaactaaaattcaatttggcagtagccctaaatttagtactactgaatctttcggcggcctctagaattttagccaatcacttaagagacctcagaagctcaaatgtattggggattctgcatctctaggcaacagtatcacctcagcatacacagattgaaaaatgttagaaaccaggaagacaactctacttttttgcattgggggaataaacaaaccaactaaccaactaaaataatacacttactccaactaagacaacataggaagaccagagagatgattggagtcaccaagttgaagtacattagtttgggatgataattccttatgacagtgtttatccaaatgtaggtaagaagcagagtttaaaatgaaattgttctttattcacagattgcttttacttaactcaatctagatactcccgaagttgcaatgtcagtcatagtttgattacagattaggaggctaacccaaatccaagttttttatatttaaaaatactagattttgcattgaaagaatatatgaaacttgcatttttatattctgtttgttgctttgctggtgaaaatactttactcttaaaatggtcagcctaactgctggcattattgcactgatattttttgtagtagaaagattgaaatttaaaaataaacatttttcattgtgaaaggatagcacataataatttaagacatttttggaaaatactaaaaattctcatggtcctaccatccactagaagctccttgacagcaggaatatttgttatgttttatccactgctaggttctcagcacaaagcacaatgcctggtacagataatatgctcattaaatatttgtcaaataaatagaatctaaacacaatcacttttagaaatttgatcacttattttcagtattttttctcttagtttattttgcttttattacagaattgtaactatatagtacataaaagtttgctttctaatttttcacttactaatcttatacatttttcatattagtgtatattcattttttccactttatttcatactcaacagttttaatggttgcacaatagtttattgctaccctgtaatagacatacagtgtatacttcttttctattattattataatctacactgcttttaatatttttgttcataaactttccccatatttattccaggtgacttttcagaagcacaatttcttaaagggaataataatagcagctgccatttattaaatgcttactaagtgctaggttctttgctatataatttccatacattatctcaggtaatcctctcaacaaccctgagaaattggtggtatattctccattttacaggtgacaaaactaaggtatagagagcataacttgcctatggccatacaagtagcaagtggtttcaaatttagatctgtctgacttcagataccaagctctctaccccagtgttcttagcgtatagtattgccaagttgctttttgaaaggattgcaccagattactttgctatctgtgcaagagtgcttgtgtcatgacactctccagcactggatgttaatactttaaaagaagattttgataaatttttaggcaaaacatggtatatggcaaacatttagtaagtagattttgaatagaggaaaattattgaaaataactaagcttcctcaaaaattaaactgataattatttcattttttcatcttgttagctgtcatggaaatactacatcttgacatgcccttagacttctgtctgaacattgctaaactgctgatggatcatgaaaggtacagaattgatttccctttctctaaagactgacagtttttggctaggcaccagtggctcacacctagaatcccagcacttggagaggctgaggcgggaggatcccttgagcccaggagcttgagaccaaccttggcaatatagcaagaccccatctctacaaaatattttttaaaaaattggctggtatggtggcatgtgcctgtagtcatagctactcgggaggctgaggcgggaggatcacttgagcccagcagttcaaggttacagtgaactatgatagtgccactgcattccagcatgggcaacagagcaggactctctcaaaaataattttaaaaatttagtccctccttcacactagccatgtatcaaatccaaatagctgcatgtagctaatggctgccttattggacattacagattaaaaaaatttccattgtcacagggaagttctattgggcagcactgttttagaccctgtatttcttttaatgcagacaacatttaaaatagttcttttctggcagctacatcatatggttaatttcctggacttatgaaactatatgcctcatatcctccacttttatggttaagaacccattaaccatactttataaactattaaatttcagcctgattgttacagcctattttttcagttcttctgatctttgtgaatttcacttctatcatgcagtgtattaactattcctcccagtttgtgtcatcttcaaatttggtattgccacctgtcttcatctaattcaggggtctgcaaacttttcttacaggttaagatataagtatacattttgggcttgtgggccacacagtctctgtcacaactagtcaactctgccgtcgtggtgcaaaagtagccgtagactaatcataaacaaatgtgtgtggcttttattccagtaaaactttattcataaaaacaagcagagcagctggactgcaggccatagttttctaactccagataatttgacaaacagcaaaactgaggccagaaccttcgtggcagcatagattaatctccaggttaacagcaatccattaattgatactttttagtgtacaatcattgaacctgttataaatccacctaattatagagctagatgacctaatttccttcatgttgttcacaaaaatttcatggaacttaatttttattttttaaagttttggttgcttttatccttccttcttccaaaaagaatttgaaacttcttatattcaagtgtataataaagctctgaaaattgaaatagacaatcaaaaccctgaaaaggaggaagcaaacacaccaaacacaatggctaatatagttgctgtggtagagcattcaatttaatggtaagctttcttgcagccagggagaaggggcaatgtgatattttatacaattttcattattaaataacaaaagctaacatttactgatacttgctttttactaggcactattctaaattccttacattataaattatgaagtacctctaacgtaatttgattaaccccattttgcaggtgagaaaaatgagggttagatagaaaaagtaatttgcccacaattgcatagctaggaaggagcagagctggaatttaaatatgtttgcagagctcacactttttattactgtagtagaaggaatacattcaatactacattccaaatcaattaatcactagaaaaagtttacaaagtggtggactatgggctgggtgtggcgagagatgtgttgcatatagttgaattagttgccaacattaaacattcaggaaatttcacataaaaatatggttttcatatatatatatatattatatatatgtatataatatatacatagaaaatctgtgtaatgaaaaataattcaagaaaaggactgaaatttcaactgggtttattttggaaagtgaataaaataagcaatcctgttgtaaaatgcagttatgtagttatatattaagggaaaagattgcccaggcattagctctcttacagatgacaactttacaaaaaagtgtctactgagtcacacaacatattcttttttttttagtaccttctttttttattatactttaagttctagggtacatgtgcacaacatgcaggtttgttacttatgtatacatgtgccatgttggtgtgctgcacccattaactcctcatttacattaggtatatctcctaatgctatccctacccccttctcccaccccatgaaaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacataggacagggactcatcctttttatggctgcataatattccatggtgtatatatgccacattttcttaatccagtctatcattgttggacatttgggttggttccaagtctttcctattgtgaatagtgccacaatgaacatacgtgtgcatgtgtctttatagcagcatgatttataatcctttgggtatatacccagtaatgggatggctgggtcaaatggtatttctagttctagacccttgaggaattgccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtatcttttggctgcataaatgtcttcttttgagaagtgtctgttcatatcctttgcccactttttgatggggttgtttgttttttcttgtaaatttgtttgagttctttgtagattctggatattagctctttgtcagatgagtagattgcaaaaattttctcccattctgtaggttgcctgttcactctgatggtagtttcttttgctgtgcagaagctctttagtttaactggatcccatttgtcaattttggcttttgttgccattgtttttggtgttttctgttgcatagacataaataataatgcccagtgaagcatatttatttgtggtgtcaatgagaattttgatatgatagaacttttgaacatagtgcctgtgtcttaagtttaatgtagactggtcaaaataacttaagtatgactacagaagatatttctgcaatggttaacacaagacttgatatgaaacttaaatccaaagtggcagtgtttttaaagataaaaaacttcagtgtattaattgtataattcaccaggaaacactgtcctaaaaagataaaaaatgaaacgtgtatataataacaatatatgtataccagatattattctgtggcctcaaccgagattattgctttttttggatgaattggatgcacaatacagtagttgcttctgcttcttgtagattagggggcttagttgtatgtggtgttgtcacaggttgggttgccctggaagcaaattttgagatggaggttaacgtgaagataatttattaaagggttctttcaggatcaacacctgtgaagggaaggggatgcagctggactaatgggagaagttggcctagatatagtcagaaggcctcagccttacttattgggagctctgaagctgggatggtccctccaaattgtcctcagctaaggtcagagggccggtccttatagcccaatgttgactagtctctgtatgccagttaccctgggaaaggagaatgaccttgggtgtggtagcttttttcagcctagcgaattcctaaagagcaactggggaataaatacttcagttctgaaggggagtttcgggatgtagtgcagcatttatgtcaggtgctgaagatatattttttgaactgttgaaagaattcaacttgttcatgtcatccaagggaaaatccctgactcagttcagtgactgacctttttggtgaatatgataatccatataaacactctgaatctttctcgcgaaagtgctcataagtagttacacaaatgtaaaatttaattcacatgttcttagtgaagtcattttttggggaaatgcttttggcaaggaataatccggcttacttttctgtgctgaaattggtgtccagagatggaagtgattacttaaactacgtattcacaattgcaggtttaaagagtgaattccaaaaaggaagttttctgatttccaacattgtggcaattaaaaatattgcctattttgtctttttcaattaattttactaatgtcagtaaagaactacaaattgaagaaattgaactgcactgtagtgtggtactgaatcctaattagacaactttggaatatcagtatgtagtagacatttgctgcttttggccatccatcattttattcattccactttcctcttgatacggtacccgaatttccacttaagtatctacttttccctatcagcccatgtggacactgacatattggtgtagaagaaaggattttagctttctatttacaagtcaacaaagtaatcaatttcaaaggaaaatttgataaattatttatatttttagatttcaaatttaaaatatagctgctcttttcctacctgttcatactatttgttaatgtgcttataccatcgttcggttaatgataaagtttaattacatatctggcagtggatttttttacagtctgcttcactcatttatgttacatatttggcttctgtagacagtgtaggaagttgcattatataatggacaatgcttttagtaattttatagcaagagcataagtatattttacacagtaaagtttttttttttaagcaatgaaagctaagcatgcagaacattaactgttagaaagtgaatgaagtggccaggcgtggtggcttacgcctgtaatttcaacactttgagaagctgaggaagatggattgcctgaggtcaggagttcaagaccagcctggtcaacatggcaaacccctgtctctactgaaaacacaaaaatgagcgggctgtggtggcacatgcctctaatcccagctactcaggaggctgaggcatgagaattgcttgaacccaggagacggaggttgcagtgagccaagatcgcgccattgcactccagcctgggcgacagagcaagactccatctcaaaaaaaaaaaaaagaaaagaaagtgaatgaagttctgtaatggactaagctaatgtagttcagacctagttttctgatgatccatcttgatgcaaggataaaattttgaatatatagaatggatggaaatactatgtctcttaagcgatctttttttttttttgaaatttcaccttttacagtcaagcttcattaggagacagagagcagacaattccaggttatatacttattagatcctagtaatatccagtactatttaagggaagagcataggctttggattctagaaaagcaggtgaatggcttgatactgttattgaatcatttttctgaatttgttagattatatctatttactctctgacattaacatttaagtaaacttgcaaaagataagattaattggaggtggagccaagatggctgaataggaacagctccagtctacagctcccagcgtgagcgacgcagaagacgaatgatttctgcatttccaactgaggtaccgggtgcatctcactggggagtgttggatagtgggtgcaggacagtgggtgcagtgcactgagcctgagctgaagcagggcgaggcatggcctcacccggaaagtacaaggggtcagggaattccctttcctaggggtgatggatggcacctggaaaatttggtcactcccaccataatactgcgcttttccaatggtattagcaaatggcacaccaggagattatatcccgcgaatggtttggagggtcctacgcccacagagcctcgctcattgctagcacagcagtctgagatcaaactgcaaggcagcagcgaggctgggggaggggcgcccaccattgccgaggcttgagtaggtaaacaaagaggctgggaagctcgaactgggtggagcccactgcagctcaaggaggcctgcctgcctctgtagactccacctctgggggcagggcatagccaaacaaaaggcagcaaaaacttctgcagacttaactgtccctgtctgacagctttgaagacagtagtggttctcccagcacgcagcttgagatctgagaatggacagactgcctcctgaagtgggtccctgacccccgagtagcctaactgggaggcaccccccaggaggggcagactgacacctcacacggccgggtactcctctgagacaaaacttccagaggaacgatcaggcagcaacatttgctgttcaccaatatccgctgttctgcagcctccgctctgatacccaggcaaacagggtctggagtggacctctggcaaactccaatgcacctgcagctgagggtcctgactgttagaaggaaaactaacaaacagaaaggacatccacaccaaaaccccatctgtttgtcaccatcatcaaagaccaaaggtagataaaaccacaaagatggggaaaaaacagagcagaaaaactggaaactctaaaaatcagagcacctcttctcttccaaaggagtgcagctcctcaccagcaatggaacaaagctggacagagaatgactttgacaagtggagagaagaaggcttcagacgatcaaactactccaagttaaaggaggaagttcaaaccgaagacaaagaagataaaaaccttgaaaaaagattagacaaatggctaactagaataaccaatgcagagaagtccttaaaggacctgatggagctgaaaaccatggcacgagaactgcgtgacaaatgcacaagcctcagtagccgatgctatcaactggaagaaagggtatcagtagtggaagatcaaatgaatgaaatgaagtgagaagagaagtttagagaaaaaagaatacaaagaaatgaaaaaagcctccaagaaatatgggactatatgaaaagaccaaatctacgtctgattggtgtacctgaaagtgacggggagaatggaaccaagttggaaaacactgcaggatattatccaggagaacttccccaatctagcaaggcaggccagcattcagattcaggaaatacagagaacgccacaaagatacacctcgagaagagcaactccaagacacataattgtcagattcaccaaagttgaaatgaaggaaaaaatgttaagtgaagccagagagaaaggtcgggttgcccacaaagggaagcccatcagactaacagctgatctctcagcagaaactctacaagccagaagagtgtgggggccaatattcaacattcttaaagaaaagaattttcaacccagaatttcatgtccagccaaactaagcttcataagtgaaggagaaataaaatcctttacagataagcaaatgctgagagattttgtcaccaccaggcctgccctaaaagagctcctgaaggaagcactaaacatagaaaggaacaaccggtacaagccactgcaaaaacatgccaaattgtaaagaccatcaaggctaggaagaaactgcctcaactaacgagcaaaataaccagctaacatcacaatgacagggtcaaattcacatataacaatattaaccttaaatgtaaatggactaaatgctccaattaaaagacacagactggcaaattggataaagagtcaagacccatcagtgtgctgtattcaggaaacccatctcacgtgcagagacacacataggctcaaaataaagggatagaggaagatctaccaagcaaatggaaaacaaacaaaggcaggggttgcaatcctagtctctgataatacagactttaaaccaacaaagatcaaaagagacaaagaaggccattacataatggtaaagggatcaatacaaaaagaagagctaactatcctaaatatatatgcacccaatacaggagcacccagattcataaagcaagtccttggagacctacaaagagacttagactcccacacaataataatgggagactttaacaccccactgtcaacattagacagatcaacacgacagaaagttaacaaggatatccaggaactgaactcagctctgcaccaagcagacctaatagacatctacagaactctccatcccaaatcaacagaatatacattcttttcagcaccacaccacacctattccaaaattgaccacatacttggaagtaaagcactcctcagcaaatgtaaaagaacagaaattataacaaactgtctctcagaccacagtgcaatgaaactagaactcaggattaagaaactcactcaaaaccgctcaactacacagaaactgaacaacctgctcctgaatgactactgggtacataacaaaataaagacagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacattacaattaaaagaactagagaagcaagagcaaacacatgcaaaagctaacagaaggcaagaaataactaagatcagagcagaactgaaggaaatagagacacaaaaaagccttcaaaaactcaatgaatccaggagctggttttttgaaaagatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctacacaaacaaactagaaaatctagaagaaatggataaattccttgacacttacactctcccaagactaaaccaggaagaagttgaatctctgaatagaccaataacaggctctgccattgaggcaataatcaatagcttaccaaccaaaaaaagtccaggaccagatggattcacagccgaattctaccaaaggtacaaggaggagctggtaccattccttctgaaactattccaatcaatagaaaaagagggaatcctccgtaactcactttatgaggccagcatcatcctgataccaaagcctggtagaggcacaacaaaaaaagagaattttagaccaatattcctgatgaacatcgatgcaaaaatcctcaataaaatactggcaaaccgaatccagcagcacatcaaaaagcttctccaccatgatcaagtgggcttcatccctgggatgcgaggctggttcaacatatgcaaatcaataaacgtaatccagcatataaacagaaccaatgacaaaaaccacatgattatctcaatagatgcagaaaaggcctttgacaaaattcaacaactcttcatgctaaaaactctcaataaattaggtattgatgggatgtatctcaaaataataagagctatctatgacaaacccacagcctatatcatactgaatgggcaaacactggaagcattccctttgaaaaccggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaggcattcttatacaccaataacagacaaacagagagccaaatcatgagtgaactcccattcacagttgcttcaaagagaataaaatacctaggaatccaactttcaagggatatgaaggacctcttcaaggagaactacaaaccactgctcaatgaaataaaagaggataaaaacaaatggaagaacattccatgctcatgggtaggaagaatcaatatcatgaaaatggccatactgcccaaggtaatttatagattcaatgcaatccccatcaagctaccagtgactttcttcacagaattggaaaaagctactttaaagttcatatggaaccaaaaaagagcccacattgccaagtgaatcctcagccaaaagaacaaaactggaggcatcactcttcctgacttcaaactatactacaaggctacagtaaccaaaacagcatagtactggtaccaaaacagagatacagaccaatggaaaagaacagagccctcagaaataatgccacatatctacaactatctgatctttgacaaacctgacaaaaacaagaaatggggaaaggattcccaatttaataaatggtgctgggaaaactggctagccatatgtagaaagctgaaattggatcccttccttacaccttatactaaaattaattcaagatggtttaaagatttgaatgttagacctaaaaccataaaaaccctagaagaaaacctaggcaataccattcaggacataggcatgggcaaggacttcatgtctaaaacagcaaaagcaatggcaacaaaagccaaaagtgacaaatgggatctaattaaactaaagagcttctgcacagcaaaagaaactaccatcagagtgaacaggcaacctacaaaatgggagaaaatttttgcaatctactcatctgacaaagggctaatatccagaatctacaaagaactcaaacaaatttacaagaaaaaaacaaagaaccccatcaacaagttggcaaaggatatgaatggacacttctcaaaagaagacatttgtgcagccaaaagacacgtgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacctaaaggattataaatcatgctgctctaaagacacatgtacacgtatgtttattgcggcactattcacaatagcaaagacttggaaccaacccaaatgtccatcaatgatagactggattaagaaaatgtggcacatatacaccatggaatactatgcaggcataaaaaaggatgagttcatgtcccttgtagggacatggatgaagctggaaaccatcattctcagcaaactatcgcaaggacaaaaaaccaaacaccacatgttctcactcttaggtgggaattgaacaatgagaacacatggacacaggaagaggaacatcacacactggggcctgttgtggggtggggggagtggggagggatagcattaggagatatacctaatgttaaatgacgagttaatgggtgcggcacaccaacatggcacatgtatacatatgtaacaaacctgcacaatgtgcacatgtaccctaaaacttaaagtataaaaaaaattaatttgctatatctttctcagtgaatccttgttgctttatgttagtgcttctcaaactttaatgtgtatatgattggctagatcagctgaagatcatgttaagatgcagattctgatttggtgggtctggaatgggacctgatctgcatttcttagaagctcgcaggtgatgtcaatgctgttggtctgtggctcattctcagagtagtatggtttgggaatccactgcctcctaaaaaaaaaaaaaaatgagaacttttcctgtccccagtcttcatcacccctccatttatccgtaattcctgaaagacttctttaatgtataagtctcatctacaaattatcttagtcctagatgtaaatttatttgatccaggggtcctgaacacttttatggcaactaagttacttttactcctaaccttggactttaatcctcttttagaattttgtatctatttaaaaaattctacaaacatgctatgactgtaatgaaaaatttaaaacaaaaaagatcacatctaatattattatcctaacaatctgcttttagttttttctttcctttaattccttatgcgtattggtgcataatttttcctagttacaatgttaacatttgtcatttatgttgttattggtgaaaggcgtcaggcccccctttttttttgatgctgattaggtaagcttaatcagttactgtttattccagtgacaagaatactaaatcaaataaacaaagggatcttgaattgcagttagactaccaagacagaatcagaaacctagagatagtgatctaggaaagtcaatgcaccaaataaaaatacagaacaagaatgtgggagatcagattgacattgccaaactaaaatgaagaagagaggagagcagcagcaggcttgtgaagtcaagatcagaatccttggaagtcacataagagatacagggaagcaatttgttcaggctcatcaagtaaaaagaaagaccagaaagccttgcatcttaaccattttattcccagctttcctgttgcataaagcctgatattgtttattaatataatagtttttgaacacactgttgaatgttataataaaatatttcagagctatctagattctacacattaaatgagttcctgaaaagttctgttcagagaaaatttgatatggtattatttttccataaacttacactatacaaataaaatgatttacctccaaaaaatgtttggctctaagatatgataaaattatacttaagaatgtagcagaattttacaattatatgtttaaatgaaatacattcttatgataatgtaataatacgtacttgaggtgagttgcagaaatggcatgctagctgagtgagaatatcctgataatatagaaaaagagataggtacaatattgaagacctcatactcaataataattcctttctgggatagatctaaaaggttatcagccactgagaaataaaagcaaacatcaactgacccttgagattttaattaatcatgtttattcagatattcccatgtaacagccactatctgagctcagtattggtgattggtatcaccctagatctttctcttctcctgcttcaggttgaatatccctgtaatgtattttgtaggacattcgtattttttgttgtaatgaacattacattatgagtttattttcaggaatcatagttccagtctgtaggaagtgaaggtggtacagaatacacactcagttcctgaatcttcagtatagataagttttgttgaaatagataagtttgtaggttttttccctagagggattggttttagggttcttgagatgggaaaaggagttttttttttttttaattatttcaacttttattttagatacaagggacacatatgcagcctagttacatgggtatattgtaccctagtagtgagcatagtacccaataggtagtttttcaacccacatgcccttcacctctcccccctctactagtccgttgtctattattcccatgtttatgtccatgtgtgctcaatgtttagctcccatttataagtgagaacatgtggtatttggttttctgttcctgttttaatttgcttaggattatggcctccagttacatccatgttgctgcaaagaacatgacttcattctttttatgactgcatagtattccatggtatatatgtaccacatcttctttatccaatccaccattgagggacacctatgttgattccttgtctttgctattgtgaatagcacagtgatgaacatatgagtgcatgtgaggttttttttgtataatctgttttcctttgggtatatacccagtaatgggattgctgggtctaatggtagctctgttttaagttctctgaggaatctccaaactgctttccacagtggctgaactaatttacatttccattaatagtgtataaatgttcccttttcttgcagcctctccagcatctgttgttttctgactttttaataatagccattctgactggtgtgagatagtatctcattgtggttttgatttgcatttttcttgtgattagtgctgatgagcattttttcacatgtttgttggcagcttgtatatcttcttttgagaagcgtctgttcatgtcctttgcccattttttaatgaggctatttgttttttgcttgttgatttttttaaaaaatcacctttctgacaagcttgttgatttttttaaagttccttatagattctgggatattatacctttgttagatccatagtttgtgaatattttaatattcttttgatagattttttttatgctgtgcagaagctctttagtgtaattaagtctcacttgtcaatttttggttttgttgcaattgcttttggggacttaaccaaaaattatttgccaaggctaatgtcaagaagggtgtttcctaggtttttaaaggttggttgctcctggagaaagagttcaattttccttacctcattgtgtgcactgacattcattttatcaacaaaaattgtgcctagtgcaacatgttgtctagggtctggttgtagatacaagaaatataacaaacacacatttccctagtgaatttatagcctactataataaattaagcatatatatgcttgatcagttgagtaacaataaaattcagaatatgagaaatgtatggtataggcaaaaacagtatatgaattcagagagagtgaaagatcactgttagctctattagtcagggaatgcttgatggaggaggtggggtcttagaaatggataagatttgcataggtgaaggagtaggaattactagcaggaagatcagagtgagcacaaggcaggtgtggggacaataatttagtccaataaagtatttagtatcgtttatgcaaagggtaccatgtggaaaacataggcaccacttgcaaagaatttacaagtcttactggaaagagagtatatgtaaagataataatataagacagcacatggaaaatggggataagtgacaaattggtataggaattcagaagaagcctagaccatcatggactaggaacatccgaaagtcttatttgaaggtgaggtttgagctggcctttgatggtagggtaggatttagaatagtggaaaggaagagttaggacacctgtggtagggactatagcataagtagatatggggacaacatggtctatttagaatatgatgactaatgaatccgagaggatttagcataagttttatataaggagtataatgaaatataaagttagagaagtaaattggagtcatttattaaattccttgatactgggttaaaggactatatgatataggcaaatggggacccactgaaggtttccaaataggatagtgacatgctaatagcaataatatgcaagaatttgagagatagggagattaattgagttgttgtaagtagctcaaatatgaagtaataagagcctgaaactaggttgatagcagtggaaattcattctttcacgtttgagttcctacaatgtaccagtcattttgttgctaggcattgaagatgcagagataaaataatatgcatgtccctggtggtctcaaggatatcactacttaatggggaagataagctcaaaattatgaaacaaatacaatcacagaatatttttataccataaaagggggggttagaggataatttatgaagacaaaactattctacttcttgcctacctatttggcattagaattaatacagttttgactgacttgccagctgcacactatccttaggacctatctttttttatatatactttaagttctagggtacatatgcacaaagtgcaggtttgttacatatgtatacatgcgccatgatggtgtgctgcacccattaactcgtcatttacattaggtatatctcctaatgctatccctccccctcctcccaccccacaacaggccccagtgtgtgatgttccccttcctgtgtccaagtgttctcattgttcaattcccacctatgagtgagaatatgcagtgtttgattttttgaccttgcaatagtttgctgagaatgatggtttccagcttcatctttgtccctacaaaggacatgaacccatccttttttatggctgcatagtattccatggtgtatatgtgccacattttcttaatccagtctatcattgatggacatttgggttggttccaagtctttcctattgtgaatagtgccgcaataaacatatgtgtgcatgtgtctttatagcagcatgatttataatcctttgggtatatacccggtaatgggatggctgggtcaaatggtatttctagttctagatccttgaggaatcaccacactgtcttccacaatggttgaactagtttagagtcccaccagcagtgtaaaagtgttcctattttttcacatcctcaccagcacctgttgtttcctgactttttaatgatgccattctaactggtgtgagatggtatctcattgtggttttgatttgtatttctctgatggccagtgatgatgagcatttttcatgtgtcttttggctgcataaatgtcttcttttgagaagtgtctgctcatatcctttgcccactttttgatggggttgtttgtttttttcttgtaaatttgtttgagttctttgtagattctggatattagccctttgtcagatgagtagattgcaaatattttctcccattctgtaggttgcctgttcactctgatggtagtttcttttgctgtgcagaagctctttagtttaattagatcccatttgtcacttttggcttttgttgccattgcttttgcataggaagaatcaatattgtgaaaatagccatactgcccaaggtaatttatagattcaatgccatccccatcaagctaccagtgactttcttcacagaattggaaaaaactactttaaagttcatatggaaccaaaaaagggcctgcattgccaagacaatcctaagccaaaagaacaaagctggaggcatcacgctacctgacttcaaactatactacaaggctatagtaaccaaaacagcatggtactggtaccaaaacagagatatagaccaatggaacagaacagaggcctcagaaataataccacacatctacagccatctgatctttgacaaacctgacaaaaacaagcaatggagaaaggattccctatttaataaatggtgctgggaaaactggctagccatatgtagaaagctgaaactggatcccttccttacaccttatactaaaattaattcaagatgtattaaagacttaaatgttagacctaaaaccataaaaaccctagaagaaaacctaggcaataccattcaggacataggcatgggcaaggacttcatgtctaaaggacctatcttttttttttaaacatttcctagtaaagccataagtcatacaaattagcacttgtcataaacgataaaagtaaggaatgtttctctcagattccagaataggaaatggaaagaagtgatggaagtgaaagacattatgatggaagaataaagaagatatgtaactgggtataggaggtggggaacagggagacagaagaggatagatagatggcaacagactcaagatgatgcagtgtcctggaggagctggtataaatagtatagaatgtatgtatacaatgtacttgaacagtaaagaatgaagattgagaaaaagaataatgatttcgagtactggactcagtagtaacttcaaacatctttataatagctatcattcactgaattcttactttgtaccagacactattctaagggcttttaatttaatatattatttaacctttcacaaatacactgtgaggtaggtactattagcatcttccacattatacagatggggagtatattagtccattctcgcactgctataaagaaatacttgaggctgggtaatttataaagaaaagaggcttaattggctcacggttccacagactgtacaggaagtgtggcagcatccgtttctggggagacctcagggaacttttactcatggcagaaggcaaagcaaaagcaggcatcttacatggcagaacaggagagagagagagagagagagacagagacagagagggagagagagagagagagagagataccacacactttgaaatgaccagatctcgtgagaactccatcatgagaatagcaccaaagggatggtgctaaaccattcatgaaggatccacctccatgattcaatcacctcccactaggcccgacctccaacactggagactacaatcgaacgtgagatttgggtgaggacacatgtccaaaccataccagggaagttaagaaacttgaccaaggtcacagagctagtaagtagtggagcaaggatccaaacccaggctggcaagtttcagaacctgtactcttaattgcagtgcgatacatatggcctatctaaagcaaatgtagaacagacaggagaaatgcgagagataaatgagatgttaggaattagagatagctgtagtagatcacctatctgtttggaatattttggcagtaaattggaaagaaaggataaaaatggtagagggacaaatgggaaaatccaaccccactaacaccagtataggggagattgtgcatgtccaaggcagaggaaaagtatcctatatggagggaggtatccagagggctaaaaagaaggtgtaattgagaaagttcaagctcctaatatataacggaagtagtatactgatagggagagggcactagctctaggatcagtaggcctggtttcaaatcctagcaattctctttactagctggcaggttgcttgtgcctcactttcctcatctgcagttttcttatatgtaacatgagatatgatattataacactttctagggttgttgtcagattacaagagattatgtacataaaatatgtagaagttataaactatgataggtattcactaattattaacttttttgattattatttgttgagaggcaatattgtgtagtggtcatgagtatgctgcttagatctgaatccttgttccaccattagccagctgtatgactttaggtaagtttttaacttctttgtgcctcagtttcctcattttaaaaatagagatatcaaagtacctacttcataaggttgctgtgaggactaaatgtattaatatctgcaaagtgttagaattgtgcctgatgcataataagcactatataaagtttgccactatataaagtttgctactactatgatttggggagcccttcatacgtagtggacaataaaccttgtctgttatatgtattgcaaatatcttcccctttctgtcttttaccctacagaggtcttaaaatttggtgaggatgttgagtgaaaaaaaaggccaatctcaaaaggtgacattacaggaatctatgtaacattcttgaaacaacaaaattatagagatggacgacagattaatggttgccaggaattagggatggtggggagaaggagagaagtagatgtgactgtaacagggtagcatgagggatatctttgtggtgataagacagttcttgtttgccatggtagttgcatgaatcttcatgtgtgacaaaatgacatagaactatatgcaggcaaacatctcagagatatgcatttggttccagaacactgcaataaagcaagtattgcaataaagtgagtcacacaattttttttatttctcagtgcatgtaaaagttaggttactatatactgtagtctattaagtatgcaatagcataatgtcttaaaaaccaaatgtgcatactttaattttaaaatacgttattgctaaaaaaaaataataatctgagccttcagtgagttgtaatctttgtgctaatgaagggtcttgtcttgatgttgttggctgcggactgatcaggatgatggttgctgaagttggggtggctatggcaattgcttaaaataagtcaacagtgaagtttaccacattgattgactcttcctttaatcaaatatttctgtgcagcatgttgtgctgtttgttagcatttcacccacagtagaacttcttgcaaaattggagtcaattccctcaaaccctgccactgctttatcaactaaatattataatatactaaatcctgtgttgtctttcaacaatgtacacggcatcttcaccagaagtagattctatctcaagaaaccactttctttattcatccataagaagcaacttctcatccattcaagtcttatcatgagattacagcaattcaatcatatcttcaggccccagttctaattctatttctcttgctatttccgccacatctgcagttacttcctccactgaagtcttgaacccctccaagtcatccttgacgactggagtcaacttcttccaaactcctgttaaatgttgatattttgaccttcttccatcaatcacaagtgtttctaatggcatctagaatggtgaatactttccagaatgttttcaatgtactttgtccagatccatgagaggaataactatctatgcagctatagccttgcaaaatgtatttcttaaataacaagacttgaaagtctaaattactccttgatccatggatgttgtattagcaggcatgaaaacaacattaatctccctctgcatctcccttagaactcttgggtgaccagatgcattgtcaacgagcagtaatcttttcttctgagcaatggttctcaacagagggtttaaactattcagtgagccatgctgttaacagatgtgctatcatccaggctttgttgttccatttatagagcacaggcagagaagatttagcataattcttaagggccctgggatttttggaatggtaaataagcattggtttcaacttaaagccaccagctgcattagtctctaacaagagagtgagcctgacctttcaagctttgaagccaggtattgacttctctctagctataaagttctagatggcatcttcttccaatgtaagaatgtttcatctatgttgaaaatttattatttagtgtagccaccttcatcagtgatcttagatcttctggataacttgccgcagcttcttcatcagaacttgctgctttgcattgtgcttttatgttacggagacagcttctttccttaaaccacaagaacgaacctctggtagcttcaaattttgcttctgaagcttcctcacctctctaggccttcatagaatgaagagagttaggacgttgctctggattaggctttggctcaagaacgtgctgtggctggggttgatcttctatccagaccactaaaactttgtccatattagcaataaggctgttttgcttttttatcatttttgtgttcactggagtagtacttttaattgccttcaagaactttttgtttgcagtcgcaatttggctgtttggcacaagaggcctagctttcggcctagcttggctttcaacatgccttcctcaccaagcttaatcatcactggcttttgatttaaaatgagagatatgtgaatattccttgtacttgaacacttagaggccattgtagggttattaattggcctagtttcagtattgctgtgtctcagggaataggggtgcccaaggaaagggagagagatggggaataattagtcaatgaagcagttagaacacacacatttgggcttagtttatggtaccccaaaacaattacaatgttgacatcaaagatcactggttacagttataataataatgaaaaaaattgaaatattgcgagaattacttaaatgtgacagagagacacaaatagagtgcatgctgttggaaaaatggtacctgtagacttgacttgcttgattcagggttgccacacatcttcaatttgtaaaacaaacaaacagaacagtatctggtggcacgtgcttatagttctaactactcgggaggctgagactactcaggaggcttgagccaggagatcaagacggcagtgagctatgatcacagcacttcactccagcctgggtgacagagtgagaccctgtttcaaaaacaaacaaacaaacaaacaaaaaactagtaactgtaaagtacaataaagagaagtgcaataaaatgaagtatgcctgttcacacatcgtaccaatgctgtttcctgctttgatattgttctatagttatataagatttaactataggaggaaactgggtgagggtacatgggatttccttatacattttttttttgcaatttcctgtggatctatagttatttcaaaggtaaaagttaacaaagttttgatgaaattaaattgtcagccttctttttttatgacttgtggattttgtgtcatgcctagaaaggccttttgtaaaccaagatgataaaaggtatctcaagcaacaatctattagaaaatgatgatgatgatgatgatgatgatgaccataaacagatccagtgcatggtgacaaacagtttaaaggcttttatcgtttgttttctacatttactttctttcctcatgggtcactttgttcattttggtgcttctctttaaggttgttcattttcttcaaatgtctagtttcttcagatgatcttgattctcttcatatttttaaaagaaaagatctgctaccaatagtttgtggtttgatcctttgacatcctttggaataacttcccacatgagtgttccggctagccgcgggtgtctccactctgtcatgtagacaggtgggatttcgttgggtctttgggttatctattgttgtgtagcaaaccaccctaagatttagcagtttgaatcactagtttattattatctcatggtgctgtgggttgattgggctcaacttaggtggttattgcctggagtcttacatggttgcagtcagatagtggctggtgttagagtcatctaaattttagattctaaaggcttggatgggctgaacactctatgttttcttcactcatgtgtctgttgtctaggctggaagtcactggatgctacccagacatctctgtctctttcttcatgtgtctaggttagaattcctcccagtgttacatcctcagggtagttggacttcttactgatgattagcttcatccaaagttccaagagaccaggcagatactgcaaggcttatgtcttattagaagtcatgcattgttaaaagcaagtcacagagccagtctagattcaaggggagaggactacaagggcatgaatactaggaagcataatttattgggagtacatctttagagactagttattacagtgggctagagacactagcccccacctccatcttgatatgcaaagtaggaaattagttctcttgccatataaggattttcactactgtgctgattgattttcctctttactccttttctcatatctacagtcttcctgtcccttatgctcaagctgggaggttcccataactgatcccttaaatcatttagaaggtttgacagcagagcctggggtcaaacatcaatggcctctactccttgcatgcacaacagagaattggaatagtttctgcagttcctctaggatcatcacaaatttttcctgtcccctactaattaatttctaattttgtggagtttcctagggtgttttttttttttgctggggggaacctatctatttcttcaatggcctcctttttggcttctgttgggtttcaggattctcacctcttgatttttccatcagtctgattgcttttaattatagaaattctttaaagtttcttaccaaagacaatatattttcctgctctctggctctactatagatttattcttacattcattctatttttttgaggtaaataactgtactcaatctgctgttttaaactgaaggttagatagatggaataaaatctagcattcagtagcacaatagggtgactatagttagtaataatttattgtatatttcaaaacaactaaaagtgaaattgggacattcacaacaaaaagaaatgataaatgcttgaggtggtgggtatcccaattaccctgaattgatcattacacactgtatgcttgtgtcaaactattgtatgtaccccataagtgtgtacatactatgtacttataaaaatgtacatattatttacttataataataaaaaataaaaataaaatgtaaatctaaacaagcttcttcagaaataaataaataaaaattaactattcatccagtatagaataattttaaaatgtggactttggcgtcagattacatgttttcaagttcttgttcctccactttgcagatgcttaaccttatgcaaattatttaaactatatatgcttcagtttactattcatgaatagtacttacctgttggggttttctgaagattaaataaggaatgtaaaattcctggcatatgataagcattcaacactttagctgttatcatttctggaaaagtattagaactaatacaataaacataatatttcattccaagttgagctgtatgtctgtggaatagaattcaaatccatcattttacataaggttagtattcctggacaagatcatgctgcatttagcttctttagcagttttatcagcacttgtgagctatgtctaagagtaaattgcaagacagttttactaacactgagcccatttacaggcattaaagtgatgattgctaaaacaccatttagcatgagcagtgagtatatgttagcaagaggtgacatgtggtatattggaacgagtccttgctactaactaaatgaccatgcgacctcagacaagtcatttagcttctcagggccagtgacaagcagaataatgtccccaaaggggcttccatgccctaatctctggggctgtgagtatgttaccttacatggcaaaattgattctgaatatgtaattaaagtcactaaccagttgaatttaaaatagggagatcatcctggattatctaggtagccccagtataaccacacaagctcttaaaagcagaagaggaatacagaaaaagtagtcagatagattcaaagcacaagaagtatttagcacaccattactggctctgaagagagaatgaaccataagccaaggaatacaagtggcctctaggagctgacacaaatcccagccaacagccagcaaggaaatgggacctcagccctagaatctcacagaactgaatttcgtcaatagcctgaatgagcctagaaatgtattctcccccaaagcctccatataagagcccaggatggccagtatcttgcctttggccttgtgtgagcctaagcctgaatggatttctgagctacaaaattgggaaataataagtgagtattttggggtttttttgttgtttgtttgtttgttcgtttgtttttgagatagagtcttgctctggcacctaggctggagtgcagtggcgtgatctctgctcactgcagccttgacttcctgggctcaggtgacccttccacctcagccttctgagtagctgggactacaggcgcacaccaccatacctagctattttttaattttttttgtagagacagggtctcactgtgttgcccaggctggtcttgagctcctgggctcaagcgatcctcctgtcttggcctcccaaattgttagaattacagacatgagccatccacctggtgagttttgttttaaatcactaagtttgtggcaatgttttacaacagcaatagaaaactaatatgaggccttagttccttttgtaaatgatggggtaggaggcagtgtggaggaagtcagaataaatgaactttaaggttccttctagctctaaattctgtgattgcaagattcttattcagctgctagtttgtgagctaaagtccagcaaccataagtagtatggacacacacacacgtacacacacatatatacgtgagcactttcaaggatacatatgaatatggcaaagctaaagttttaggggactccatagtggcagatcaaccagatagatattggagtgggttttgcaactgcaaagcaaatggttgcaaccagggttaaggtttttcaggtagatcctgaaactaagaatcaatgaaaaagtgactttatatgtgcacagttttcataccctgaaatggaaaaatgatcattattattaaactagaaggtcagtggtgtctgtatttgcgttataacaatttacagttcttattcttttaaagaatcaattatgtaccccatatttctaatacatagtgaattctcacaatttgctatatttggcaaacatactctttgttttctatgaaactaactccaaggagctgagattccagtaaaacctggaaatgaatagtatattccttagagatgtaaacctctttagagcaatctccagggttctctatgcaagttgacactaaatttataatgataattctagctggccttcccacccacctctagcaattatgcaaagaaatgcccaattttatgttatattgttgttttttaaaacagctttatgaaggtgtaatcaacctacagttaaatgcatatatttggaataagtgtacaataagctttgattacacatacatacttatgaacccattatcgcaatcaggataataaacatatttaccacccccaaaaggttccttgtggtcttttgtaatctctccctacctctccttcatcagacagccattgatcactgaatgtcactatagcttcatttgtattttctagatttttatataaatgaaattgagtatactttttagtctggcttctttaactcagtatgattccctgaggtccacctatgttgttgcatatatctgtatagtttatacttttttattgctgagtagtagtctgttgtatggatagcctacaatttgtttatctattcagctgttcatagacattttgattgttttcagttttaggacattacaaataaagctgctgtgagcattcacgtgtgtctctttgtatggacatttgctttcatttcttttggtaaatacatagaagtgaaaagtctggtttggatggtaggtagtgctatggtttggatatggtttgtccccagcaaaattcatgtttaaatttgttctccaatgtggcagtgttaggacttgggaggtgtttgggtcatggaggtcatgaataacttggggctgttcttgcagtagtgagtgagttctcgtttcaagaggctggatgagtccttacagggatgaatcagttctgaggagagtgggttgttataaagccaggatatcacttgggttttgcctctttgctcctatccgcttcccctttgaactttctccaccaagttatgatgtagcacaaaagccctcattagaagtcagggccacgctatcatactaaaactgtgagctaaataaacttttctttataaattacacagtcttaggtattctgttacagcaacacaaaatagactaatacagtgctatgtatttaaattttcaagaaattgccaagcttttccaaagtagttacaacattcatttaacattcctaccagcagtgtttgagagtttcagtttctccacatcctgacccacatttggtatagtcagccttttaaataggtatgatgtctcattgtggctttaatttgcacttttataatgactaataatgttgagcatttttttcatttgcttttcatgtgtgtatccctttttgtgaaatgcctgttaaaatcttttgccctgttttgtttgtttgttttgttttgttttgttttaagtattgagttagaaactcctttcaggccaggcacggtggctcacgcttgtaatagcagcactttgggaggccaacgtgggcagatcacgaggtcaagaggttgagaccatcctggccaacgtggtgaaacctcgtctgtactaaaaatacaaaaattagctgggcatggtggtgtgcgccagtagtcccagctactcaggaggctgaggcaggagaatcacttgaacccgggaggtggaggttgcagtgagccaagatcgcaccactgcactccagcctggcaacagagtgagactccatctcacaaaaaagaaaagaaaagaaaaatgaagctcctttcaatatttggggttttttttaacttttattttaggttcagaagtacatgtgcaggtttgttatacaggaaaacttcctttcaatattttgtaaacaagatcctttttcaactttattgaagtataattgaaaaattgtatacagtcaaggtgaacaatatattttgatatatgcatacattgtgaaatgattaccacaatgaggctaattaacatatccatcacctcacatagttacttctttgtgtggtaagaatacttaagatccactctcttagcaaatttcagtacataatatattattgttaactatagtcaccatgctgtacattaggtcaccagaacctattcatcttgcataactgcaagtttgtaccctttaactaaaatcttcctacccacccctcaccccagccctgccactactgcccttggtgaccaccattctaccttgtttcaatgagtctgactttttgagagaccacatataagtgaaatcatgcagtatttgttgttctgtgtctggcttatttaacttaacataacatccctacaagttcatccatgtttttgtaaatgagggaatttctttctttttaaggatgaataatattccattgtatataaatatataccacattttttaaaccattaaccactaatcatcaaggaaatacaaatcaaaaccacatgagatatcacctcacacctattaggatagatactttttttaagaaaagataacaagtgttggcaaggatgtagaaaagttggaatttttttttttgagatggagttttgctcttgttgcccaggctggagtgcaatggtgcaatctctgctcactgcaatctccttctcctgggttcaagtgattctcctgcctcagcctcccaagtagctgggattacaggcgtgcaccaccatgcccagctaatttttttgtatttagtagatacggggtttcaccatgttattcaggctggtcttgaactcctgacctcaggtaatccacctcggcctcccaaagtgctgggattacaggcgtgtgccactgcaccctgccagaagttggaatttttgtacagtgctggtgggaatgtaaaatggtagaacccctgtggaaaacagtatggcagtttctcaaaaaattaaagatagaactaccatatgatccaggaattctacttttgggtatataccccaaagaactgaaagtaggatctgaaagagatatcttcactcccatgttgattacagcattattcatattcactaaaatgtggaaggcaacccaagtgtctattagtggatgaatgggtaagcaaaatgtgatatatatatatatacatatatatatacacacacgcaaacgtatacagatacatatatatgatggaatgttattcaaccttaaaaagaaggaaatcccactatttgtgacagcatggatgaaccttgaggacattttgttaagtgaaataagctagtcacaagacaaatactgtgtgattccacttctgtgaggtatctaaaatagtaaaactaatagaaacagaatagaatggtggttactaggggctgggaggtgggggagagggggtattgttgctcaatacgtataaagtttcagttacacgatatgaaaaagttctagagatctgtacaatgtagtgcctgcagctaacaataaagtattgtgcactcaaaattgtgttaagagggtagatatcatgttaagaattcttacaccaaaaaacaaaagaaaaaaagcacagagacccaagggagcttttggaggtgacggatatatttattacattgattgtggtgatatcttgagtgtgcacatatgtcaaactcatcaaattgtatacattaaacatgtgcagtgtttattgtatattaactataccacaataaaaataaaaaatatagccactcctacttttgattaatggtttcatggtatatttttttccaaacttttattttcaaccctcctatatcagtttttttgaagtaagtttcttgtacacactctacagttaggacatgtttgggactttcccctacctttttgagatataattgacaattaaaaattgtgtatatttaatgtgatgttttgatatacctacatattgtgaaatgattaccacaaccaagctaattaacatatccacttcatggttacctttttttatagagaggatacttgagatctgttcttagcaaatttcaagtatataatacattattattaactatagtcgccatgctgtacattaagtctccagaacttaatcaatttttaacttaaagtgtatatcctttgaccagcatctcccccattcccccacccaatgaaactctggtaaccaccattctattatctattactatgagtttaaacttttttttagccttcacatattagtgagatcatgtagtatttgtttttccgtgtctgacatatttcacttagcatagtgtcctccgcgtttattcactttgttgcacatcacaggcttctttcatttgaaggctgaataatattccattgtatgtatatacatcacattttacttatccattcatctgtcaatggacacttgggttacttccacattttagcacatgtgaataatgctatgaatatgagtgcacaaatatctgttcgagaccctgctttcaattattttggatatgtacccagaagtgatattgctgtgtcatatggtagttctatttttaattttttttgagaaactgccatattattttccatagtggctgtaccattttacattcccaccagcagtgcacaagagttccaatttcttcacatcctcaccaacacttatcttttgactttttcacaatagccatcctaacaggtagttttcatttgcatctccctgatggttggtgattttgagcatctttttaatatcttttggctatttgtatgttttctttgggaaaatgtctgtacaagttctttgcagatttttaaatcaggttgtttgatttttttccccttgagttaaatgagttccttacaattttagatattagcctcttattggatatatggtttgcaaatattttcttccattctgtaagttgccttttgattttgctgattgttttcttggtgtatttttttttagtctatgctgccaatttctttcttttaattggcatatttagaccatttacattatttgtaattattgatgtgttacagcttaagcttgccacttaaatttttattttctgatctatatacacttttaaaacctttttaaaaatatttatttattagagacagggcctcactcttagcacccaggctggagtgcaattgtagctcactgtaacctcagactcctggactcaagtgatcttcctgcctcagcctcctgagtagccaggaccctaggcacacaccaccacactcagctaattttctttttctttttaatttttttgtagagacagggtgtcttactatgttgcccaggctcgtcccgaacttctggcctcaactgatcctcctgtcttggcctcccaaggcacggaaattacaggcgtgaaccattatacctaacctctgctttatattttagtttacttttagttttacagaaaaattgggaagatagtacaaagagttgccatatacactctacacagtttcccctagtattgccatcttatatagtacctttgtcataagtaatggaccaatattgatacatcattattattaacctaaaatcaatggttaattccaatttcctttgttgttacctaatatcctttttctattccagaatcttacctgtgatatcacattacatttagttgtcatatctccttggacttcatttggccatagtagtttcttagatatatttttctttttgatgattttgacagtcttgagactacccatcaagtattttgtaggatacctatgtattagattttttctgatatttttctcatgattagactggggttatgggtttggggaggaagatcactcagataaagtaccattttcattacatcgttatcaagggtatatactgtcaatatgatttatgtatgttgatattagccttgattagttggctgagtattcatcaagtgtttacaccttgaagttatccatttttcctttttacatactatattctttgcagttgtggagttatgctcccctgcttaaaggcatacttatctagataaattattttgaattcttctacatgggaaatttgtctcttctccctaattcgttaatttgttcaaccatttttatatcaatacggacttgggaatatgtattttattctttaggttataattcaatactacatttttgttgttcagattgttttagctttggccattgggagctcttttaattgactcctgcacccttttgacataccccaatcagtgtgggtggttttgttttttataagcaattcctttctttctgacaacacagaatgttctaggttcatcttgcacatttcttgccccaatcctggaatcaaccatttctcctaggaggtctagttcctctcactggcaaagtatattagtaaccaagatctgaatgttagttgtgcttgttgctactggggtgtcatttcttctaggccttattagttgacggagcaaagaaaatatatgtgtgtatactaatctgagtatatagacatatatatataaatattttggtatgtaaacatctgtatctatattaagttaaacgtaagttattactgatgtttcctattctaattcattagcacttagatcattctagccttgcttgcagattacccttgcttatctgttcccaatccaacagtgggaaacctggctcttaccatccatcattcatttacttaattttttaattgttcaattttagtatacatgtaaagcagtatcagaattgttcacctgtaccctcatgagaaacaactttgtcaactagagtacagtgcttatgtgcagttctttttgcctttattcttacagactctacttatttccagagttacttaggtcagtatctagtcctcctatttcctttagtgaagttgttccacacatttgttagagtctcttgtcacagtctctattatatctgaggattcccccaacctcccaaattatatatatatatataaaatatcaaattatatataatatatataatacctagttatatataactatatatataatttgtatgcattgagattgacttgttgtgtggtaaagtcctgtggattttgacatgcataatgacacgtatctgctattatagtatcacacgtagtattttcaccatcctaaaaatcctctgtgcctcatctcttcatcttcctgagatgctggcaaccacatcttttcactctctatttttcttactggctcttctttttgcttttgtgccatttctgcaatgtcacataattggaatcattcagtatgtagtctttttagattggcttcttccacttagcaatatgaatttcaggttcctctatgtcttttttgtgactgatagctcatctctttgtttatctatttacctattggaggacatcttggttgcttcctgtgtttggtgattatcaataaagttgctgtaaacattcacgggaagatttttgagtagatctaagttttcaaatcaagtgggtaaattcctagcagtgaaatggctcctgtaggtaaggtatcatttctctttctgtgcattcaagatttttttctttgtcttaggatggaatttgactatgacatgtcttaggatggaatttctttggatttatcatgtttggagtttgcaccgctctttgaatctctaggtttatgttttttcccaaatatttgagacattatttctttgaatatttatttgttctgccctacctttcttctcctcttccagggttctgatgacataatgtacattttttgttgtcttacacgtcgctgaggctccatgcagtttttttttcagtctgttttctctctgttgttcagatgaggtaatttctacttttttatttttccttctccttccttccttccttccttttctttctttttcttcctttctttcctttctttcttttctttgaaacaaggtctcactctgttgcccaggctggagtgcagtggtataatcatagctcactgcagcctcaaacacatggactcaagcagtcctcccacttcagcctgccaaatagctgggattacaggcaccaaccactgcacataactctactttatttcaaattcacttattctttcctttgtcctctccattctgctgtaagctcatctgttgagttatttttaagattttggttattgtatatactagttttctgagtattgtaacaaattaccacagatgggatgacttaaaacaacagaaatttattctctcacaattttggaggccagaagtccaaaatcaaggtatttgttggctttttttttttagattaaaaagacttagatattttaatcaattgaaatgtatgaatcttattcagatcctgagtcaaacacttaaaatcaataatgtatgagacagttacataaatgtgaacagtaattaaatacttaagaatattgaggatatcttgttaagttttaaactgtaatgatagtattatgtttatgatttttacaaaaaatagtttctatctttaagagatagataattaaaatacttggaagtggattaataggatgtcttgaatttacttcaaaagcatgagtgtgtgtgtgtgtctgtgtgtgtgtctctgtgtgtgaatgaggtggaaagatgggttaaataaaattggctttgatgttgttacagcctgataataatgatgtgtaggttcattacattattttctccactttggtatatatttgaaatttgtgtagcagagagttaaggaaatacttattgattcaaagtaaaccgatctaatcataacccttgcaaatggatgtctacctatgtataaataaggtacttctttttttaaaactatgggtctctttttattaaggcgagatctcttgcaactggtgtttcatgaatagagttgccagataaaatacaagactcggttaatttgaaatttcagataaacaatgtctagtattttagaataagcacatcccagctattgcactggacacactaatactaaaaaaataatttttgtttatctgaaattctaattttactggggcattctgtattttttttttttttttactttaagttctggatacatgtgcagaacgtgcaggtttgttacataggtatatgtgtgccatggtggtttgctgcacctatcaacctgtcacctaggttttaagccccacatgcattagctatttgtcttgatgctctccttcccctcaccctcacctcccgacaggctccagagtgtgttgttcctttccctgtctccatatgttctcattgttcaactcccacttatgagtgagaacatgtggtgtttggttttctgttcctgtgttagtttgctgagatgatggcttgcagcttaatccatgtccctgcaaaagacatgatctcattcatttttatggctgcgtagtattccatggtgtatatgtaccacattttctttatccagtctatcattgatgggcatttgggttggttccatgtctttgctgttgtgaatagtgctgcaataaacatacgtgtgcatatatctttataatagaatgatttatattccttgggtatatacccagtaatgggattgctgggtcaaatggtatttctgattttagatccttgaagaatcaccacactgtcttccacaatggttgaacaaaagctgaaattgacaaatggggtataattaaactgaagagcttctgcacagcaaaagaaactatcatcagagtgagcaggcaacctacagaatgagaaaaaatttttgcaatctacccatctgacaaaggtctaatatccagaatttacaaagaatttaaatttacaagaaaaaaaaaaccttgtcaaaaagtgggcaatgaatatgaacagacacttctgaaaagaagacatttatgtggccaacaaacatatggaaaaaagctcagcattactgatcattagagaaatgcaaatcaaaaccacaattagataccatctcacaccagtcagaatggcaattattaaaaagtcaaaaaacaacagatgctggcgaggctatggagaaataggaacacttacactgttgatgggaatgtaaattagtttgacttttcattttattgaagttttctttgcagtgcagaagctttttagtttgacatagtcccatttgtttgtttttgctttaaaaattttttttgcctttgcttttggtgttctatacaaaaaaatccttaccaaggccaatttcaaagagcttcttccctatttttttcttttaggagttctacagtttcaagtattacatttaagtttttaatgcactttctgttgatttgtgtgtgtgctgtaggatgtgttcaatttattcttttgcaggtggatgtccagttgtccaaacacatttttttttgagacagagtctcactccaacacccaagctagagtgtggtggcatgatcttggctcactgcaacctgtgtctcctgggttcaagtgattcttgtgcctcagccctccccgcatagctggaattacaggcatgtgccaccacatccagctaatttttgtatttttagtagagatggggttttgccacattggccaggctggtctcaaactcctggcctcaagcgatccaccaacctcggccttctgaagtgctgggattacaggagtgagccactgcacccagcccaagcacaaaagagactgtgctttttccattgtgtattttgggcacctttgtcaaatactagttggctatatatacttggttttttggggtttttttctgggctctcgattctgttccattggtctatgtgtctgtttttatgccagtaccatactgctttgattactatagctttgtagtataatttgaaatcagaaagcgtgatgcctccaattttgtttttgtttttaaggttgctttggcacagagtcttttgtggttccatacaaattttaatattagcttttctatttctgtgaaaaatgccattggacttaagatagggatttccttgcatttgtagatcactttgagtagtgtggacattttaataatactaattctttcaatcaatgaacacaggatatctattttatttttgttttcttcaatttcatcaatgttttttagttttcagtgtacagatgtttcacctacttggttacttttattcatatatatttgagatggagtctcactcactctgtcacccaggctggagatctcggctcactgcaacctccacctcctgggttcaagtgattctcctgcctcagcctcctgagtagctgagattacaggcatgcaccaccatgcccagttaatttttgcatttttagcagagacagggtttcaccatgttggccagtctggtctcgaactcctgacctcaagtgatccaccctcctcagcctctcaaagtgctggaattacaggcatgagccactgtgcccaactattttatatatttttgatgctattgtaaataggattgttttcttgatttcctttttggatattttattgttggcacaaagaaacgcttctgggttttgtatgttgattttgtaacctgcaactttactgaagtaatttattagttcttagagttctttggtggagtctttagagtcttccgtatataggatcacttggtcccatggaaacagttttttagctcttccatttgggtctttgatccattttgaattaatttttgtatatgatatgagataagaatccaatttcattcatttgcatgtggaaatcccgttttcctagcaccatttgctgaaaggactgtcctatcaccatttgctgaaaggactgtcctatcaccattaaatggtcctggcacctttgtcacaaataatttgatgatatataacaagatttatttctgcgttctctattccattccattggtctatatgtctatctttatgccagttccacacattttcattactatggctttgtaataagttttgaaatcagaaagtacaaatcctctaattttgctctttgttttcaagtttgtttagggcttttggggtcccttgagcaaagtccatattaattttaggatggattttttccatttctgcaaaacacatcattgggattttggggtttttttcagacagggcctcagtctgtcgcccaggctggagtgcagtagcccgatcacagcccactgcagccttgacctcccagggtcaggcagtcctcccacttcagccttgctagtagctgagactacaagcatgcgccatcacagctgccaattttttgtagagacaggcttttgccatcttgcccaagctagtctcaaactcctaggctcaagcagtctgcccacctcagcctctcaaagtgctgggattacaggcgtgaaccaccacacctggcctgggattttaatagggataaatatctgcaaatctgtagatcactttgggaatatcaacacattaacaatatttagtcttccaacccgtgaactgtttacatttttaaatagaagatactagtgtattatttgtgtaatcaaacataaacaagtttttagaaagaggttttggccgaggaactagtaaatttctcatgtcttttcatgtaacttcactggatctcggtaaccaatttttaaagcttgcaatcagttctgggaaaaacataaattagatattaggagagaaatgattatctgactataggtgttaatagaaaatgtttatggcttaataaactgaaattaaattaaatcatgtaatattgacaaattaagcttatttagacatttaataacattacctgagttcagatatgcttttatctggcttattttgctcacactgaaatacattttagtcccattgatcaataaccagtttttctgttcgcattgcttaaaattgtgtctcattgtacagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttaggtcagtaggattttcgcaagtgttttagaaacgtattaatttgtgtataattcttagatgtcagagtaatagcaaaatcctcaagtcaatggatttcttccacttcctttttttcttcctccctaatggtcttttaacagtaacacctcacctgtccacatcccacaaattgggcaagtggaatgagaaactaagcaaaaataagaaaccatcattgaaaacagacaaacttctgagcttaaagctcacatgtggtggaatattgtgaggttacaagcctaatttaatatctctagtttgatctcaatttagctgtgtacctttgaacaagtcaaaggaccttgatttttttttcaactataaaatgatgattgtgaactaaactcctggtttctaacttcttttcagcagcagcatccttttgtgatgcaatcttatatgaaccccaccctgaatgaaatagattagagtttttctggttaaagcagagatgtagagccaaatctgctcagcattcccctaatcctctgcctccctgcagaacttctgtaccctgaagaacacagatagtaagatccctttcttagaaaattctcttcaccacttcgtccttccaactaagtgcatgtagagatataattggagtgatagtcactaaatgttaactctggggtttattctgaatggtggcattttaggtgacgtgttgctttcttctaaatactctaccatattgtttgaatttttataagcacaattcatgtttctataaaaacaaagtcattaattttttaaaggaagtcatctgagtagatgatctctaagagccatattttactgataacaccctccctccaggcatttaccaattatttttagacccagttttgataaacttggttatccggttttcctactcttaacattttgatggtagcactttgcaaatagagaaaaggtttaaagggaagtatacagatagcctgaccatagggaggaaaaaaaactctaccaattttataaaacagattcaaatttttaatacaacaatctgtactgtataacaactcccaaaggcatcactgtgatatattaatagtacaataaaataaaatagttgttaatgttgacctcaagtggtcaagaaaaagttgaattatgcttaagaaaactaggaagtttgtttactttttagaaaatttaagaactttcatgaaaatattcagactttttaaattcagaagtgatttttatttaaagaaagtaaactgccagttgaccagaaaacttgattacacagaattactcattttcctaaaattccacttagactgttctattatgacatctaagttacacttacactctcaaagtattataatatttcaagtagatacatttagtagctgtttactctcatgtgagtatttttaagtaagtcatggaacaaactacatttgctgactgggctagagggtcagagattcctaatgttctagtcaagacttttgtggaaattgatagtttatgccaaagggcagaagaggaggtgcagaattctattatagtttagactttaccttaatgtgctaatgtatttgaactctgtaaatgtctagaccagaaacaatcaacgcaagttaagatttaaagtaataaagtttatgtgtaagcatggtcttaaagtattttacaaaggctttaaggcataattggcctttcttgtgaacttgatctgatctatttagcacataatagtataagcacttcttattaatgatttctggcattgctgtctgctcattcacaataaccttattaaggcaccagatgatgatctaatttggaatgtggaaaatcagttaaaaagagagtaggctggaaaactatcacagattgatgggagaattactgtgattctagcaaactctgattgcattatattatcaattatggtagtaaacctaaaattgatgatgaaaacctgtctgaatttttttgtgtgtagccattacttaaagattataggttctgagtatagttagctctctttacttaatgtaatagaccgagattctttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccacctttcccccctttctattccacaaaaccgccactgtcatcatggcccgttctcaatgagctgttgggtacacctcccagacggggtggtggccgggcagaggggctcctcagttcccagtaggggcggccgggcagaggcgcccctcacctcccggacggggcggctggccgggcggggggctgaccccccccacctccctcccggacggggcggctggccgggcagaggggctcctcacttcccagtaggggcggccgggcagaggcgcccctcacctcccggacggggcggctggccgggcggggggctgacccctcccacctccctcccggacggggcggctggccgggcggggggctgacccccccacctccctcccggacgggcggctggccgggcggggggctgacccccccacctccctgcctgacgaggtggctgccgggcagagacgctcctcacttcccagacggggtggctgctgggcggaggggcttctcacttctcagacagcgcggctgccgggcggaggggctcctcacttctcagacggggcggttgccaggcagagggtctcctcacttctcagacggggcggccgggcagagacgctcctcacttcccagatgggatggcggccgggaagaggcgctcctcacttcctagatgggatggcggccgggcagagacgctcctcactttccagactgcgcagccaggcagaggggctcctcacatcccagacgatgggcggccgggcagagacgctcctcacttcccagacggggtggtggccgggcagaggctgcaatctcggcactttgggaggccaaggcaggcggctgggaggtgaaggttgtagcgagccgagatcacgccactgcactccagcctgggcaccattgagcacggagtgaatgagactccgtctgcaatcccggcacctcaggatgccgaggctggcggatcactcgcggttaggagctggagaccagcccagccaacacagcgaaacctcgtctccaccaaaaaaatacgaaaaccagtcaggcgtggcggcgcgcgcctgcaatcgcaggcagtcggcaggctgaggcaggagaatcaggcagcagtaccgtccagcttcagctcggcatcagagggagaccgtggagagagggagagggagaccgtggggagagggagagggagagggagagggagagggagacaatagaccgagattcttattttcagagctttttttttttttcagctcaccaaacaggaagacaactgacagcagaatcaatgaactggttacacaacattctgtggagacaagctgccagtagttttgaggtttgagaataatctctttttcattctttatttctccactgcaacaaaaaatagtgcattcactataaaaataaaagagcatcaaatacttcaataatctctgtctgtttagataccatatatttattaaatattcacaatatagagtgttaatgagcattgtgcaagagtttattaaaaataataagacatgattcctctccattgagagcttacagtgtagggaaatgtcatcgctgatattaagatataagaatgtaatttttttaacatgagggctgagaaagagttttattccctttaaaaacttaatggtgtaataaaaaatggaaaaaaaaacctttacaagacaactcaggtttcctgtaaacctaaagataagtttttttaaagcaaagaacaatcatttataattttggtatatttccttctaatctttgtgtattatacatttgtgtccctgtgtatataaatcagatgggacgtaccattaaaaaaaaagttgtgtttgcttccacttgcaattaatatgtagtaacagggactgttttatgtcccttcttgaacaacaagcccctctccacaaaggacaagacaaaatagacgaaaagaaaaaaaaaggcttttatgaccctgaacatcaggcaatgaaggagaatggtccctgggagataagaaataaagcgagcattggccgggcgtggtggctcacgcctgtaatcccagcaatttgggaggctgaggtgggcagatcacaaggtcaggagatcgagaacatcctggctaacatggtgaaagcccatctctactaaaatacaaaaaattagctgggcatggtagcacacgcctgtagtgtccgctactcaggaggctgaggcaggggaatcgcttgaacccgggaggcagaggttgcagtgagccgagatcgcgccactgcactccagcctggcgacagagcaagactccatctcaaaaaaaaaaaaaaaaaaaaaaggaaagaaaagaaagaaagaaagtgagcattacaattgtgcagcttactgctttgagtttccagggtatagcacaagaaggggatctgaagcagagcctggcaagcgtcctgatttgagatgcagctgagtctgaggagaccaaggcagccagaatttataagacaaagtactgaagaggaccacatagcgtagattaggcattgtaaaagaaaagattgataaacttgaagtcagagcaaagaagctattcaaaattaaacacactgaataaaagacttaaaagagcttcagtgagatgagggtcctcttccaatgtttaacagagttctgatcaggacatacatgaagcaaaattacctgaagctaggagaataaccatctaaaaatattagcgggaacagtgcctagcactcacatggggttgagaataaggcctgttcttatcacccagtctggaaaacctctaattcatggggcattgggaagaaaactcagaagggtcttgtctcagaagaggggaataattagtcctacactaagtcctgctccagaactaccttaaaaattataaacctatggtgtgaaaggatcaaattgatcccaaggaacttaattgcttcccagagcagagttcaagaatatttataggaatataaaactgtacagcacccaacaggataaagtttacaatgtctggcatccagcaaaaaaattactgagcatgtgaagaggcatgaaaatgcaacctataatgaggagaataagcaatcaatcgatactgacccagaactgacatagaagttagcattaacagaggacatctcttataattgtatttcatgcattcaaaaagttaagtggaggcatggaagatacgtaaagacccaaatcaaacttataaagatgaaaactctgtttaggatgagaagcacattggacagtattaacatcatattagacattgtagaagaaaagactgatgaatttgaagttatagcaaagaagctattgaaaatgaaatacacagggaaaaaacccttaaaaaaattaaaagagttcagtgaggttagggacaattttaggtagcttaatatacgggtaactgggattcccaaatgaggatggagataataaatatttgaagaaataaaactttcaaaacttaatgaaaactctaaatgcacagatagatagaaaaatcttaacaaaccccaaacacaagaaacacaaaacgacaccaacgcacgtaatcaaaattctcaaaaccagtgataaagagaatgtcctaaaagcagccagataaaagtgacaccttatatacagaggaataaattaaagagaacgtcagatttcttgttggaagtaatgcaagcaagaactcagtggagcagcatctttaaaataatgaaagaaaattaaaacctgtcagccaaaatttctgtatccagcacaagtattgtttaaaatgaaagtagttggtacaaatgtaaaatagtgtagccactatggaaaacagtatggcagctcttcaaacaattaaaaatgttattaacatatgatgcagcattttcacttttgcttgtatatccaaaagaattaaaagcaagatatttgcacacccatgtttatagcagccaaaaggtggaagcaacccaagttccatcaacaaatgagtggataaataaaatggggtatactcaaacaatgaaatattacttagccttaaaaagcaaggacttctgatacatgctataacatggatgagccttgaggacattatgctaagtgacataagcctgtcacaaaaaacaatactgtgtggttccacttacatgaggtacctagagtagtcaaatccgtggagaatgaaagtagaatgggccggatgcggtggctcacacctgcaatcctagcactttgggaggccaaggcgggtggatcacttaaggtcaggagttcgagaccagcctggccaacatggtgaaaccccgtctctactaaaaatacaaaaattagccaagtgtggtggtgcacgcatgtagttccagctactcaggaggctgaggcaggagaatcacttgaacccaggaggcagatgttgcaatgagccaagtttgtgccactgcactccagcctgggcaacagagcgagactctgagaaaaagaaaagaaaagaaacagaaaggaagaggggaagagaagagaagagaaacgagaagagaaagaagagagagagagagaggaaaagaaaagaaaaagaaaaagaaaagaaagaaaggtggtttccaggggctaggaggaggggaaaatgtggagttgtttaatgagtatagagtttcagttttactagatgaaaaagttctggagattggttgcagagtagtcaattttatgctatgtgttttttaccataataaaaatatgtttttaaaaaatgaaagcaaaatagtcttccagacatttaaaagctgaaataactaatcactcaaagatctacattacaaggaagtcctctgagcagaaggaaacttacaccagatggaaatatgaatctatacaaatgaataaagaataccagaaatggtaattatatgagtaattgataagatttttttcgtattattacaatctctttaaaagatagtttattgcttaaacaaaaataataacattgtattctgcagtttataacctgtaaaagtaagatgcatgacaagaacatataggccaagaagagagaaatggaagtataccataagtgaggtggtataacatcacttgaagatagactatgataagttaaacatgtatactatgtaccctaaaacaaccattaaaatagcaaaacaaagagttttttttaaaaatgagataaaatcaaatcataaaaatattcaaataatctaaaataaggcagaaaaaggaaagacggatcaaaaaagatggcacaaatagaagacaaatagcaagatgatagatttacatctaagcatatgaaaaaaaaatcacattaagtgaaaatgacctcaagaccccagtgaaaaggcagagattgtcaaactggataaaagagcaagacccaagtttatgtactgcttaaaagaaatgtactttaaacataaagatacaaattggttataaacaaaagcatcagaaaaatatagagagacaagattgttctaaaatttatatataaaacaatggaatgaaaatagccaagatacattattaaaaagtcaaaaaataatagatgctggcaaggttgtagagaaaaaggaacacttatatactgttggtgggagtgtaaattagttcaaccactgtggaaagcagtatggctatttctgaaagaactaaaagcagaataccatttggcccagcaatcccattactggatatatacccagaggaataaaaatcattctatcataaagacacatacatgcaaatgttcattgcagcactattcacaataggaaagacatggactcaacctaaatgcccatcaatgacagactgaataaagaaaatgtggtacatatacaccatagaatattatgcagccataaaaaagaaaagatcatgtcttttgcgggaacattgatggagctggaagctatcgtcctgagaaaactaacacaggatcagaaagccaaataatgcatgttttcacttataagtgggagttaaatgataagaacttatgaacacaaagaaggaaacaacagacactggtgtctacttgagggtggaggatgagagaagggagaggagcagaaaagataactattgggtactaggcttaatatctgggtgatgcaataatatgtacaacaaacccctgtgacatgtgtttacctatgtaacaaaccttcacctgtacccctaaacctaaaataaaaattataaaaagaaaatagccaaaacaacctgagagagaatagaacagaaagaattaccctattcaatttcaacactttttatatagctacagtaatctagactgtgtggtatcattagagacatagatccatagatcaatggaacagaatggaaaaccaaaaaataatcccacacaaatatgctcaactgatttttgagaaagcacaaaagtaattcaatggaaaaagatggtgttttcaactaatggtgctggagaaattggacatccatagaaaaaaaaaaacccttgaccttaacttcacattttatacaaaaattaaatagattataaaattagatgtaaaatgtgcaataaaaatacataggagaaaatcttcaggatctaggccaggtcatgtgcagcctattccctgcatgaactgcacttgatatgtgactaaagacaaggatgttaagaagtttatcattcaaaatatggtagaaagccaagtgtggtggctcctgcctgtaatcccagtgctttgagaggctgaggcgggaggattgctcgagcctaggagtttgggaccaaccagcctgggcaatataaaggagcaccatctatacaaaaataaaaaatttagcctggtgtggtagcatgcacctgtagtcccagctactcaggaggctgaagcagaaggatcctttgagcccaggagtttaaggctgcagtgagctgtgatcatgccacttcactccagcctgggtcacagagcaagatcctgtctcaaaagctaaaaacaaagaaaacaacaaaacatagtagaggccacagctatcagggacatagctgaagccagtgtctttgatgtctatgtgcttcccaagctgtttgtgaagctacattactgcatgagttgcaccattcacagcaaggtagtccagaatcaatctcgtgaagccggtaaggaccaaacaccccaaccctgatttagacctgtgggtgctgcccaccaacctccaccaaagcctacatatggagctgagtccttaaggactgaaaaaaaagctatcctctgaagaaaataaagtgaaaattatactttaaaaaaaagagatcctgttgaatagatgaaaaaagctagagactgggagaaaaattttcagaccatgtatacaataatgggctagtagctaaaacatagaaagaactctctaaactcaatgtacaaagaaaaacaattcaaaaattagcaaaggatatgaacagacatttcaccaaaaagggatatatgcatgaaaataagcacccaaaaaagatgacttatgagtcattagggaaatgcaaacgaaaaccccaaggagataccaatacataattcttagaatagccaaaatggaaaagattaaccataccaaatgctgacgaagatgttgaggaactggaacttcatggtggaaatataagatagtacagacggtttggaaaatagtttggcagttttctaaaatgttaaacttgcccctatcatgtgatccagccatttcaatcctatgtatgtactcaagagaaaaggaattatttatccatacaaaaacttgcatgtaaaagctgatagcagctttatttataatagttaaaaactggaaacagccaaatgtccatcaacaagtgagtggataaacaaactggtatgtccttcaatgaaatactactcagcaatgaaaaggaatgaactattgatagatgcaataatggggataaatctagaaactgttttgctgagcgaaaggggccaggcaaaaaagtattaatacatattagatgattccattgtataaaagcctataaaataaaaattaatagttatagaaagttatagaaagcacatccataactgcttggggtatgagagaccagaatgaactggattgagggattacaaagaaaaaatggttgtgatggatgtgttcactccgttgactgtgttgatggttttagctatgtgtgtgtgtatatatatatatatatatatatatatatatcaaaacaattgtacagtttaaatattcatagtgtttcatatgtcaattgtacctcaataaaactgttttccaaaaaatgttatggtaggttttgtaggagaaagatgtgaagagaaaaaagggaacaaaatctgagaaacaaagaattagacccaagagaaggaaagagaatcccttataggagcatgtagaaacctaggtcttatggttaggtaccacaagatagaatgatattcgtattctcttttagaaggcctttatttatttttttactgaataggtgaagaactacttcagaattcccattcttctattgattctttttctttcctctcattttccagtcttgctgaataattttcttaaaacatccacttccaacactggagaggaatgtaatcttatttctaattgactatttctaatatgacatatttctaatctactatgactaatgtaatagtcaaaggcagtgttttacctatttagcataattgtttctagttgaagagggtgttttattccttgaaggtcctaatggctcctattcttaattgaaaaatatgaagcttcttgatagggtacaagggaatcatttaccttaccttggtttataagcagtctcagttttcttagattaagaaataattatccaggttattcctatcagattttccctagctagcttcttaccattgaaaattttaaatttactcaagagaaaaatgtatttttatatacaaatacagcagcatcaattacaatagtaaaaaccctgcaaattcactaaatagctaacattaagaaaatcattatatacttgattaaatgttatgtatctcctaaaattgattactgtgaagactacatagcaacatagattaatatgtacaaaacaaaattaaatggaaagaatagaacatgaaattctatataagctacgattacaactaggtaaatatacaaaagaatacagttaaaattgaacatagataaatgaaaatagctgcattagcatggtgaattatgggtgttctcttttaaaatttttgtcgttgttgttttaataacttttaaaatagattttaagttttctggggtggtttactacactcttagactcttcatcctatgtgtgaaatttctaatgtgtaggaaaaagaaagaatactgattgccaccttatctaaaacttatgttgaccaagactgataataaaatgcacttagaaccctatataaaggatattgtgttttgattgcctaaaaaagaaaccaacagcatcttttatttgtttctagaggtgacttgggaaagatagggtagcgacatcgctgtgattttgttgtttctttttaaactttaggtacaaaattacactgatgccctacaatggtactattattctctgaggttttattcaactgatgaaatggatctggacttcaccaagctgcagaggaacatggcttgctgttacctgaatttgcaacaacttgataaggtcctttgatttatctattttcagaggtagcaaatgttcttatgtgcagtggcagagagatagatgccatgctgtgacttcctggctgttagtttaggatgtctgagagttccctcatatagaacaaggtcaaattgacattttcttgatttgcacactgtaaacatagagtgaaacttcccaaagaaagagagaatttggaataccattaattctattacttaccctttatttttcacacctattctgaaaggtaatatatcattggaactcctgaacaaagttatctgctactaaccatctgtaatattgtcctttgcagcaagctaaattttgaagtacacacttttgtcaagcattcattgagaccaaatacttgaatgaagtggccattctttcactttctaggttgttatctcttgcctttccaaccaccctagaaaatgttctttaactgatttcttatcaggacaaaattctagaaggtaaagaagataaaagcttgtttaaagatagaacggaaatactttccaaagcaattaggacatttcttcctttggttatcatatggtatgcacgtaatgaggggtattggctcttagaaggacaaagaactagaaggacaagtgtgaacccaaatgaaatatgaaggtttttgttgcctttcaagttttaatgacaggtctaacctttgttcacctaggtgattaagggtaatgattccagatgttttctttgaaggtttatttttgaagagttgtttatctgacttaaatactttagattttctttcaagaaaatatttgctatttagtttatatgttataaagtcacagccctggaagagaacttgaaatgttacttaattcatcataatgttgtacaggctagcatttaactgtttcagaaaatagttacctacagtttaagatctaaaaggaagatgatcatgtagattttgttacctaattctgcacaggacagcactatttcagaaaggtagttgcctactgtttacttaaagactaataaagaaggcaatcacagagcctttataacttccatgatttatgacacagtgagctaggcagcttgggaaggacctatatctggatgtagacatgctagttggggaatggatgcatttgcaggccaagggaggatatctaatcagccagtcaggaaagaaagaaagaacacagtaccagacattatgctaggctctgaggttacagagatgaacaaagtatagttgccttcaactcactcaagcagctgacatcatggtatcctaatgggcagataagcagagcatggcaatgagagaaatctaaatgttggaaatagtccgtaagtcaggcacacaggtggttggcatcacataaacataacagcagggaacagggtttcaatcacagatatttggactctgagacagtacacaaatctttgaggaataggagtgtgtgcagacatactagaaagagcaaagtagatctccacaactaaaggggccaggatatgaggctgtttttaagagcagatcccctgcatagggagccaaactgggaagcaatgaccagaagaggaatacaagttgactagatacagttttctgagacttaagcaatgctacttacatctcttctaatgtcaagtttggtcctagagcctagtatagcactgactttataattggaaattcaaatggtattaatagtgaggttaggaagaataggagaacagtaaaccaggtgtattttaatggtgcgtactcaatatgtaactgtatcatttatggccagattagtggtgaaaccaaaggatattttgaatatattcaaggtaactttgttggttactgttagtatatttctccatttcatccttgtcttgaatttagcagacattgattggataccctccatatacaatgaatatcctcttatgcactaggacagacagaaaggtgaaaaaaatacacaatccatcatattttaataatcccacctcgccagtgtctaacctttgttagctttcattgtctttcttcactccttcctttgagttgcttgagcattgttgggaaaatttatgaaaccatgtttattgggtttgctaaaatttcatggtttttcagctaggtagtcaataatactgactcttgttgagtttttatcacattccccacagtgataattccaaaacattttttttctgtccttaagcacccatgctttctcctttgttgtagcaaaagatcttatcgtgtgatttgctgagcttgtagccactgacatgaacttcatcaatttctcacctcttcacccatcctttcttttctcttacctacgagaaagaagtaactttgtctggggaccttactctacagatctcaaccctagctgtttaatcattctctactgtttcttttttattttttttttttgagacagagtctcactcttgttgcccaggctggagtgcaatggtgctatctcagctcactgcaacctccgcctcctgagctcaagcaattctcctgtctcagcctcctgagtagctgggattacaggcatgggccaccacgcctgggtaattttttatatttttagtagagacagggtttcacctttttggccaggctggtctcgaactcctgacctcatgatctgcccgcctcggcctcccaaagtgctgggattacaggcgtgagccaccgcgcccggcctactgtttctttctcctgtcactataattaccttgaagtcttctttatccaaaaaccttccttcaactttgtaatcctcctcaaacttcagttctgtgtccttctttttgttgccaaactttctaatccaattttttagtgttcattcattcaaaaatatttatttattgtctcctatgtgttaagtactgttctaggcattggggatatagtaatgaacaaaatatataaaaacctttatccacatggacaaatactgctgtccccattattttccactaggagaggcaaacaataaaaagataaataagtattatgttatattataggggtcaacaaactttctgtaaagaaccacagtaaatattttaggttttgcaggccatacagtctgtgctgaaactaatcaactctgttgttgtgccttgaaaatagccatagacagtatgtaatcaaattggtgtggctgtgttccaataaaactatgttttggaatactgaaatttgaatttcatgtaatttttgtgtgtcataaaatatgattcttttgatttatttcaggcacttaaaatgtaaaattgttctaacttatgaactgtacaaaaaatatggtgagccagattttgcccaaaggctatagtttgttgactcctggtatattaaatattgataagtgctaaggagaaaactaagcaggaaagggtgatattaaatgtttcagaggcggatgaatggttgaacttttagatagggtggtcagggaagtcctcactgagaagattgtttttaagtagagacctgaggaaaaagagcattccagatggagggaataacaactgcaaaggccctagggtatttaaagaatggcaaagagacctttgtggctggagctgagggaacattaggagaattaggagatgtgatcagggaagtagtggtgtcttagtctgtttcgtgttggtataacagaatacctaagactgagtaattaataaagaaaataggtttatttaagctcatgattctgcaggctgggaagttcaagggccatggtgctggcatttgcttggcttctggtgagggcttttgtgctagatcaaaacatagcagaaagtcaaagggaagtagactcatgccaggagacataatccaaggggctttctggctttataacaacctactttcatggaaactgtttctgttttatttccttgtatactatgtttgtcctcaactggagtacttgctgcttcctagccatgatctatgttttctacctcagtatcttttttcatgcttcttcattgcaaattacctctttcctgcatccctaaaattcccttttcaaagcctagcttaaaattccctttttcaaagcctaactcttaatgacattcttagcttcctgaggaaatttccttgtcttgcctttcctccaagactttgtaacagttctgtttatccctagatacttgttttctcattatattttagttatttctatacctgccttagtcatctattggactgtcagtcacctccttgaggacagagaccatatcttatctttatttgcccttgtacccagcatagtgcctaatgcatagtagatgctcattacattaaaaatagttataaagactcaataaatacctgtcaatcaacttcttctgatataggaattccatttcctcatgctatttctgtccttgctactatgcataatttggaaattaatagtgattaagatctgtgagtgctctttgattatcagaactgaatgagattatattattaaaaatcatcccactataactttctccagctcagctcttttctcttttgagggtgagaacgcattttattttgatttaaaatgaaatattgaatcataggtcagaagttaatttgggcaggccaatggagttgagaaatagactcccttgaactttttagtagattaggttacagattcattagctcgcacacttggcaacctctttttgagataacaatgccaattatagatcatttctttggtttgttttctaaattgtataaataaaaattttttaattgctattatccattcagatatcttcagtactttgcatgagacaatattaaacaatgttgtttcatagatatcaactctgcctttgaggtgtttgtagtgccttaagcctggtatcctgattttgctatattatttttgaggatttaaaaatatttggtttgtgcaagtcataggtttgaatggattaaggatgaaggaaatgagcttgggttctaaatacagaagcagtttatcacaccttgatataatgggattttgctgcaaaccataataaaaccttaatgttagttgacagatggataatgacttgttttggtgatagtctgtgtaagttaatgggaatgcacaattgggtactctttaactcagtacagaagtcccatcctcagcttgcaactgcagtttaggtacatgaatgtcattagcactactatagtttgataaaactgaaccacactctcaaaccacagaatggctgtaagacttacaacagacacaaagatgagactattcatagaatatttatgtgacctaaagtgaagacagttatgtctcatgtgctggttatatattgtttctctttaccatataaagttcgaaaaatgagcttgggaccagcagacataaactagtgatattcactagatggcactgtggcctctgtacttcatcagcttgtgcttgactgattctgagggtttttttttttttttttgtaattcttaggtagatgtacctttcccacaaatgcatctatatggatgcaaaaaaaaaaaaccactaaagaaacataagatgaaggtcagctgtgactcatttgatacagctatactgtaaaaataccctgactgagattccaactcaacaaatattaaatgcctaatctgtgccaagcactatagaataagtagaagacatgatctattctgtaagtgagcctaaaatattaatgcagaaacaatatttacatatataaaataattagaaaataataaaaggctgttcaatcacacatcattgtgtggtatgtaccatatgaacttagaataggaatatatagatgaggacgtttgtgaatattgattgaatgtacatatgatgtgaagctgaaaagggtaactgatttgttagaagatagagtcagatctgaagggaccttaataggttgaaatgatgagcctattctagcaagacgaagacaaacaggaaacaacaaaacatcctataattggatcccaaaaccaattgtacaagaacaaagtagataaaatatggctctaaaagcagcatatgtgagtcacttggtacattttattgactataagcactgcataagccaaaaatactaagaaagtttactcaaattaggttgaatcaatagagatttaatgtatagaaggagaaaaagtggcaatcaccctctattctgctctggttagaatatatctgaagtacagattcaatcaaacgcagactgaaaatattcagaaaaaagcaatttagaaaatagcaatacaacatagaaaataatgcaaatataaaacaatacagtgtaactactatttacagaacatttacgttgcattaggtgtaagtaatctagagattatttaaagtatacaaaaggatgtgtgtaggttatatgcaactactataaggaacttgagcatctgcagattgtgatatccgagggtgtcctggaaccaatcctctaaagatacgagggaacaactgtatagacagcccttgacttacaagggttcgatttaggatttatcaatcttatgatagtatgaaagcaatactcattcaataagctcctcaagttaccatggggttatgtctggataaatccgtcataggttgaaaatgcactttctatttaggatattttcagtttaccatgggtttatcaggatgtaaccccatcattagttgaggagcatctgtattgtattggattgaggggcaccacttataaaggaggatattgacaaacccaagtgtgccaagaggaaggcactgaggatggtgagagcactaaaaatcatctaatttgaagaataaaggaagtgtggatgttaaacttgggaaatggaagatttacgagaaacacgatagctttcttccaatatttgaatggctgtcagggagtaaagaaattaaatttatttcatgagtgtttccatgggtgagacctacaaggagtgagattttggattatcataaggaaaccctttcttaattatttgacctaccaaaacaatgaaatggattttcttaaaatagagtgaattctgtcttcttgaatatatttaagtaaagactgaatgacttggtataaatgttatagaggagattcaagcatcagaagaattttttgactaagagaactttgaggtatcttctgcccacatttttctgaaatatcagtataacctgataaaatgtattatagtcaaagaggattttgtgggggactaggctcattaatcactgaatttgaaaactaaaggaacccttgcaagtcattactaatttattttaaaatgaatttataaaaatataatttacatacaaaaatgcattcattttaggtatagttcaataattttgacaactttataccccaaatttacccactaccatggtctagatatagaagacttccattatcctgagagatttccttgtgttccttcccagtcaatcctcacctccactcccagccccaggcaatgactggtatgctttctatcactataggttagatttatctttcctagagtttcatataaatggaattacacggtatgtactttaccttttttttaaatctggcttctttcactcaattttagaattttagagaatctcttctggcttgtagagtttctgccgagagatcagctgttagtctgatgggcttccctttgtgggtaacccgacctttctctctggctgcacttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaatttggttgcattctccccgtcactttcaggtacaccaatcagacatagatttggtcttttcacatagtcccatatttcttggaggcttttttcatttctttttattcttttttctctaaacttctcttctcgcttcatttcattcatttgatcttccatcgctgataccctttcttccagttgatcgaatcggctactgaggcttgtgcattctccacgtagttctcgtaccatggttttcagctccatcaggtccttgaaggacttctctgcattggttattctagttagccatttgtctaatcttttttcaaggttttttacttatttgccatgggtttgaatgtcctcctttagctcggagtagtttgatcgtctgaagccttctctcaactcgtcaaagtcattctctatccagctttgttccgttgctgatgaggagctgcattcctttggaggaggagaggcaatctgatttttagaattttcagtttttctgctctgttttttccccatctttgtggttttatctacctttggtctttgatgatggtaatgtacagatgaggttttggtgtggatgtcctttctgtttgttagttttccttctaacagacaggaccctcagctgcaggtctgctggagtttgctggaggtccactccagaccctgtttgcctgggtatcagagcggaggctgcagaacagtggatatcaggcaaatgttgctgcctgatcattcctctggaagttttgtctcagaggagtacccggctgtgtgaggtgtcagtctgcccctactggggggtgcctcccagttaggctacttgggggtcagggacccacttcaggaggcagtctgtctattctcagatctccagctgcatgctaggagaaccactactctcttccaagctgtcagacagggacagttaagtctgcagaggtttctgctgccttttgtttggctatgccctgcccccagaggtggagtctacagaggcaggcaggcctccttgagctgcggtgggctccacccagttcgagcttccgggctgctttgtttacctactcaagcctgggcaatggcgggcgcccctcccccagctttgctgccgccttgcagtttgatctcagactgctgtgctagcaatgagcgaggctctgtgggcgtaggaccctctgagccaggcgtgggatacagtctcctggtgtgccgtttgctaagacccttggaaaagtgcagtattatggtgggagtgacctgattttccaagtgccgtctgtcacccctttccttggctaggaaagggaattccctgacccccttgcacttcccgggtgaggcaatgcctcgccctgcttcagctcacgctcggtgtgctgcacccactgtcctgcacccactgtccaacaatcctcagtgagatgcacccagtacctcagttggaaatgcagaaatcatttgtcttctgtgtcgctcacactgggagctgtagactggagctgtttctattcggccatcttggttccatccctaatttttgtatttttaatagagacgggatttcaccaagttggccaggctggtcttgaactcctgacctcaggtgatccacccaccttgacctcccaaagtgttgggattacaggcgtgagccacctcgcccagccttttattgctattttagagtatataaaacaaaattataaaacaaaattaactgtaaaacagcctcagacaggtccttcaggaagtattccagaagaaggcattatcatagtaagtgacagctccatgcatgttattgcccctgaggactttccagtgggacaagatgtggaggtggaagacagtgatactgatgatcccgagcctgtgtaggtctaggctaatgtgtttgctcatgtcttagtttttaacaaaaagtttgaaaagtcaaaaaagattttaaagtgttaaaaatcaaaaatcttgtagaataaggatataaaaaggaaatttttgtacaactgtacaatgtttgtattttaagctcggtgttattacaaaatacttaaaaagttttttaaatattaaaaagtttataaagttaaaaagttacagtaaactccattattgaagaaagaaaaatatccttttataaattgagtgtagcctaagtatacactgtttataaagtctacagtagtatacagtaatatcctaggccttcacattcactcagcactcactgactacccagagcaacttccagtcctacaagctccatttatgtaagtaccctatacaagtgtaccattttttatgttttataccctatatttactgtattttttctaggtttagatatgtttagatatataaatacttaccattaaaattgcctacagtattcagtacagtcacatgctgtagagatttgtagcctaggagcaatgggctataccatatagtcatgtatagtaggctataccatctaagtttgtgtaagtacactatggtgttcacacaaagatgaaattgcctaatggcacatttctcagaatgtacccctgttgttaagtgacacatgactgtaccacattttgtttatcctttcatctattcattggacacttgggttgctttgacattttggctattatgaataaatacttctatgaacatagatattacaagtatctttttgagttcctgctttcagtttttttgagtatttacctaataatataatcattggatcatgtggtaattctgtatttaacattttgaacaatcatcctacttttttccacaatggttgtaccattttacattcccaccagtaatgcacaagtgttccaatttctccacatcctggtcaacactcactgtttttaagttttttgataaaagccatcctaatgggtttgaagtgttctcttattgtgtttttgatttgcatttccctaatgaccagtgatgttgaacatattttcatgtgcttattggccatttgtgtatcttctttggagaaacatctgttgaagtcctttacccatttttaattgggatttgtattttatagtggttgaattgtaggaattatttatatatttcagatattaaccccttaccaaaatatgattagcaaatatgttttcccattctgtgggttgtctttttcttagtgtcttttgaagaacagtagattttaaaaaatttttgatgaggcccatttatctgatttttcttttgttgactgtgctttgggtgtcatatccaagaagtcatttgcaaatccgatgtcatgaagattttcgcatgtgttttcttctaagacttgtatagttttagctcttatgtttacacctttaatccatgttgagttaatttttatgtgtgatataaggtaaagatccagcttctttcttttgcatgtggatatcctggtttcccagcaccatttgttgaaaagactgtccttttcccattgaatagtttgggaacccttgtcaaaaaccatttcaccatatatgtgagggttcatttctgggctctctattatatgccattggtctatatgtcagtccttatctcagtactatactgttttgattactatatcttcatagctaagtcttgaaatcaggatcccttgaaacttcatatgaattttaggatgggtttttttatttatgaaaaaaaaatgcccttggaattgtcatagggattacattgaatctgtagatcactttgggtatcttcatttttcagtgtttatcttttactgtggtaaaatatacattatcttcattccttcttaacttcaaattttttcttgtttttgacttttagtctcttttggcattattggctgtatttatttacttttgactttcttcttgttagtcttcatttctgaaatgacttcttttacttctaatattttccttagctctaccacctcatttctgagtttttctaattattactatgggtttttttgtttgtttgtttgtttttttgagactgagtctcgctctgtcgcccaggctggagagcagttgtgctatctcggctcactgcaacctccgcctcccaggttcaagcaattctcctccctcagcctcccgagtagctgggattacaggcacccgccatcgtgcccggctaatttttgtatttttgtagagatgaggtttcaccatgttggccaggctggccaggcggaactcctgacctcaggtgatccgcccttctcagcctcccaaagtgctgagattgcagatgtgagtcacgacgccccaccgctaattcttatttaggttgatctttcatatcttgtatcattttttaaatttttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtacctacaaaggacatgaactcatccttttttatggctgcatagtattccatggtgtatatgtgccacattttcttaatccagtctatcattgttggacatttgggtttgttccaagtctttgctattgtgaatagtgccaaaataaacatacgtgtgcatgtgtctttatagcagcatgatttatttttaaatgtgtttagctcatttttaaatagtcggttatgattttgacctgttttttgagcacatttttctgacatgctttcattttctgtggggatactttgctgctgctgatgctgctgctgcttttttttttttaattttttacaactttttagggtatttaccttaaagctttactgtttctcattttgatgtgaaattagttttccttaacttataaaaaggtagacatttagaaagtgttactacttcacagagctcccttttttgtttttggtttggtttggtttgttagtgtttaaaaataaggcagcttttattctgagatttcctggctctgcttctctctgtcttttggtgtacacccacactgtccaatatgatagcaatgaggcatgtgtggctatgtacgtttaagtttaaattaattaaaattaaataaagttataaaaatttatttcttcaattgcagtagccacatttcaagtgctaaatagccatgtgtggctaatgactactctattgaatagcacaaatatagaatatttccatcatcacagaactctattggacaacactgatctatactttttctttcatctttgttgtcactgtcctgttcagttttttattgtactctcagcagtttctccttagtgtggagcctctcagaggggagctctagtgggtaagctttaagggttcatagggcctagactactatcgcttctttagtacatctttgatatgaggtccttgcactcactcaataatggagaaagcaaattatctcccaatttcaactgctgttctccagtttccccatcatgctattcagttgatttctacaagccaattttggggtcctccttttctatatagtccattagacgcttccctattacttccttttttttcttcatcctgtacagatgctgacataatgcaggtcttgtagctgttgttgctttttctccacccacttgtgtttcttaatgcctcgggatattttgtcactcagttttgttataaacgctgtctgtggtttttggttttgccatctgcatgctcagttgtttttcatgagaattcagagaaatgttacctctaccacatatttccagaatcattttgtatagtttttttttcttcctacctacctaccgacagggcctcactttgtcacctaggctggagtgcagtggtgtaaacacagctcacagcatcctcaacttcctgggctcaagtaatcctcctaccttaacctcctgagtagctgggaccacaggcatgcaccaccatgcctggctaatttaaaaaaatttttttgttgagacgggggtcttactatgttgcccaagctggtctcaaactcctggactcagatgatcctctcacctcagcctcccaaagtgctgggatcacaggcatgatcagccatgcccagcctcatatggcatatatatatatatatatacacagctacctttgctaaagtctcttaataattgtaataatttgcttataaattcttctgggttgtctacatattcaattatacaaattgacaattgtgtttcttctttttcaatatgctttatatatttcttgtcttattttgtctaataattcaaccactatgttgaattaaagtggtgttttggatttaaaagggaaagctaccataaattgccattaaatatgatgtttgctttagggtttttttgtgttgttgttgtatagatacggtattagtttcctagggatgctataacaaagcactacaaactgtgtggcttaaaacaacagaaatgtatacacttatagttctggaggctggaagtccaaaatcaaggtgtcgataaagctatgctctctctgaagactttagtagaggattcttcctagactagatttgcttaatggttaggtaaatggtcactttttgtaaatattctgtgtgtgcttgaaaaaaatgtgttttctgcagtttttaggcactgtgtatgtacatatatgtacagatgttccttgacttacgatggagttatatcccaataaattgatcataagttgaaaatatcgtaaggtgaaaatgcagttaatgctggcaaaatggcaggcatctacaacttatgatggtttaacttaatggtattttgattttataatgatgtaaaggcaatatacatttagtagaaaccataaccctgtcataagttgtaaggagctcccagacttacgatgtggttacatcctgataaacccgtggtaaagtcaaaaaatcataagacggagaccacctatatacacacatgtataaatttagattaagtttgttcattttatttgaatcttctgtatcaaaactcatattttgtgtacttactctatcacttactgagatgaggtgctggaatatccctttatggtttgaattgatctatttcttcatttaattttatcatttttgctttatatattttaggccatactacttatacatacaaaattagtactgtaatatatttgtttgttgaagttttattgttatgcagtgatcttctttatatctagtattattttctgccttaaagtcatttttgtctgatattaatatatccacactttggttaatattttccagatagatcttctctaatccctttactttgaacttttaatacatttatattttaggtgtgccacttctaaaaaacatgtagttacatatttttaatccagtctgaccatttttgttttttaactagggcatttcgtgtttatacatttaatacaatattggtatatctgagtttaaatctgtaacttactttatgctttctatttgtcatttctttttttttttttttttttttttgagacagagtctcactttatgcccaggctggagtgcagtagtacaatctctgctcactgcaaactccgcctcccatgttcaagtgattctcatgcctcagcctcccaagtagctgggatcacagatgtgtgccaccacatccagctaatttttatatttttagtagagatggggtttcaccatgctggccaggctggtctcaaactcctgttctcaggggatctgcctgcctgagcctcccaaagtgttgggattacaggcatgagccaccgtgcccggcttctatttgtcatttctatcctgtttctttttctctcctcacttgccttcttcgggatcaatgtttctaaataatagactttacttgttacagcagttttaggtttacagaaaaattgagtaggaaatatagagagttttcatataccccctcacggttcttcacatactgtttcccctgtcattaacatctcgcattagtgtgctatatatgttacagttaataagccaatattgatatgttatttttaactaaagtccgtagtttacattaggatttagtctttgtgttgtacatcatatgtggtttgatgaatgtataaaaaagtgtctaccattataataccatacagaatagttcaaccccctgtggttcaactattcatcccttcctccctctcactgaactagtgtcaaccactgatctttttactgtctccatagttttgccttttcagaatgtcacataattggaatcgtgcagtatgtagccttttcaaataggtttctttcacttagcaatatgcatttaagattccttcatgtccttttatgggttggtagttaattttttttagtgctgaataatatttcactatctggatatattagtttatacactcacctatggaagaacatcttagttgcttccaaattttggcagttatgaataaagctactataaatatctttatgtagatttttgtgtagacataagttttgacacatttgaataaataccaaaggtgcaactgctggattgtatggcaagagtatgtttagttttgtaggaaactgccaaactgtcttccaagttggctataccatttttcattcccaccagtgatgaatgagagttcctgttgcaccacatccttgccagcattatatgtcgttaaagtgttttgaattttagttattctaatagatgcatagtgatatctcattgctgttttaatttgcaaaaccctaatgacataagatgttaagcatcttttcatatacttatttgccatctgcatattttatttagtgaagtgtttcttcaggtcttttgcccattttatacttgggttgtttattttcttattgttgaatttgaagaattcttcatacatgttgaataccagtccttcattacatatgtgtttggcaaatattttttcccaatatgtggcttttatcattattctcttaatgctgtctttcacagagcagtttttaattttaatgaagtttaacttaccagttttttcttttatagatatggttttggtgttgtgtctaaaaagtcattgccaaagttcacctaaaatttctcctatgttatcttctaaaagttttatagtttgggtttttatatttaggttataatccattttcagttaatttttgtgagaggtttatggtctgtgtctagctctacttttttacatgtggatgtctagttgttccagcaccagttgttaaaaatactattttcattttttttttcattgcagtcttccccttctactagtgtgaaaattatttactgcttctaatcttttagtggctatcctagaaagtatagaatcctttcttaactgtcttccatgtttgtaatcgctctgtgctgcattttggctattttattctttcagcccactaattttctcttcacctgtttctaatctgctattaaacctgtctattatgttttaatttgggtaattgggtttttcatttcaaaaagcttctttgtttcagatccccaaggtcacattttatggtctctgtttcctactaacttcactgatatgcaaagtatttaataactggtatggcacaggtaataatgagacagaatggataccatctagaaacaaccactataactgtattaatttgtaccactgtgtatcaacccacatacatatattttgaacatacattgtatttctttagactttgaaaacataggtgttttataaccagtttttcataattctagtatctgcatcttgagggtctgcttctgctatctcgtttctgctgtttatggtaccttgtttccgagtgtgctttgttatttttgtaacgtgtacaactcatggttcttgaaaaattatttatggaaatatttcgaaggctgacataaggtgctttcccccagagaagatttacatttgcttctgtagatgcttgggagctatctaaactaaattctcagctttaggtcttttagcttcctgtataatgtagtttgggtcagtgaatacatgagtctcctagtattacacctcatggattgtttccctccaccccattgtgctgccttctattcagtactaaggtaactttatttgcagttttccagggatgtgggtaggagtgggtttacttttggcttgtccctagtctaggagtgtgatcccttggaacttgatgtcttttcccctgacctagtgatgtccctcaaaactgaagttaacatttgcttacatttgcaaatgcttaccagataaaagcgactttacttttctgtttacctctctgagacctcagttttccttagattttgccttggtaattcttttgctatttgtcagttgctcttttgttctttctggaaaaaaattaatatatcatccaatatttttggttgttttcagcaggagggttggtctgacatatctaacttactctatttccagaagtataactcactgttgcattagcattctagaagagcacttctgcaaatatttttcttagattcatatattttcattgtgagtatccctcagccattttgactaccttaatgatattagtaaaatatggtaagtccttccttgtagattttattaaaatgacccagtgtttttctttccaggccaaagaggcagtggcagaagctgaacgacatgaccctaggaacgttttcactcaattttatatattcaagattgcagtcatagagggcaactctgaaagaggtataaattttatttgtcacttatatttgactattaacacaaagaataaataatcctcttcaaccacagtgggaaaaaaacattgtttttaagacaatagaattgaatatatgttctgtctttcctatgtaaaggtgatacaacaatgcaaaaagaaaccgtggaaggttatataaaagtaaaagaacagtggttacctattgagggaataggaactgggcaaacgcgggacaagaattaggggaaagtcttatcactatgtacttttttatacttttatttaaaccaacctattcaaaaattaaatttaaaaagctgtgtgtgggtgagattatactaaaaacccatatcagttaagaattgtcttcaaaaaatgaaagttggggtaccttttgattgttttcacttatttgggaggtgattggtgagagatttggccttgagatggagtttctctccacagagtagacagtcttggaatttcacacatgaccctcatcccattaatgttgaggcctttccattaagttaagcatagtttcctagctggtgtgtctgcatgggcacatatatgttgaattggttatagatatgcctttgctcagatattaatgccttcagccctcaggtagctgaattaatcctgaaggagtctgagctccagactggttgccatttgtttggcagaagttaagaaacttaaattaatggatccaaacaaaatgtatacgaatccaattaagcaactgtttttggacacctactacgtacaaaggactctgttattcactccttaagaaaaaagatcatttattttacattaaaaaagaaatgttccagaatagtaaagtatacctgtataataattaaggaatagtaaattagaggttaatattgctgtcatgttcatcatcaaagttttcattagagacttttaggcatttgttttacttgatatactgtgtttaagggtaaaataacttgaagcttttttgccagtaaaaatggcaaaaatattagtaattttcctgttaaatcttttgttttaacattattttttaaaaattattttactttttaaatacaacatcagatcaacccttttatttcttctccagttgtctgtgaccattttttaagtcacgtatattgaagatacatataataaatttactcttgctagtgtatggtcctatgaggtttatatatgttaaaaattctgagttttgaagtgcatacagtcatataactaccaccacaatgtagaaaaaaaatacctcagggccctttactgttactccttctcaccactttcagccctggaaatcagtaatctcttctatctctatagttttgtcttttccagaatgtcatataaatgaaatcatatagtatgaatctttttgagcttctttcacttaacttaatgcatttgaaactcacccatattgtgtttatccacagtttgttcttttttattgctatgtggcattccatagtatggaaataccacagtatggaaaaatgcattcaccagttgaaggatatttgaatggttttcagggttttttttcacctctgagacaagttcaaagttttcagttttgacaattgtgaataaaggtgctgtaaaacatctctttacatattttctgtgataataatattgtttttttgagatggggtcttgctctgtcacccaggctggagtgcagtggcatgatctcagctcactgcaatctccacctcccaggttcaagcgattctcctgcctcagcctcctgaatagctgggactacaggtgtgcaccaccatgcccagttaattcgatgataatattttacttctgtagggtaaatatctaggagtgggactgtggacttatatggtaaatacatgtttaactttattagaaactgcaaaactgttttctaaagcgactatacaatttcacctgtgaaccagctatgtttaagagttctagctgatctacatcctcatcagcacttgaaattgtccacttaaaaaaatttagccattctgggagattattaaaaagtcaagaaacaacagatgctggtgaggctgtagagaaataggaatgcttttacactgttggtgggaatgtaaattagttcaatcatagcggaagacagcatggtgattcttcaaggatctagaaccggaaatactatttgacccagcaatcccattactgggtatatactcaaaggaatataaaccattctattataaagatacatgcacacgtgtgttcattgcagcactattcacaatagcaaagacatggaaccaacccaaatgcccatcaatggcagactggataaagaaaatgtggtacatatacaccgtggaatactatgcagccataaaaaggaataagatcatgtcttttgcaggcacatggatgaagctggaagccatcaacctcagcaaactaatgcaggaaccgaaaaccaaacaccacatgttctcactcataagagggagatgaacaatgagaacacatggacacaggaaggggaacaacacacactggggcctgttgggggcggggaggggagggagaacatcaggacaaatagctaatgcatgtgaggcttaaaacctaggtgatgggttgataggtgcatcaaaccaccatgacacacgtatgcctacgtaataaaactgcactttctgcacatgtatcctagaacttaaagttaaaacaataaaaaagaacaaaaatttagctattctgatagtgggtagtagtgttttactgtggcattagcatttccctaatgtttaatattttattaaaccatgtatgtttttgggttgtttgtacaaatctttttcccagtttaagatagggtactttgttttattattactgatttttgacagttctttatatattctggatacaagttgtcttttttaaaaacttatttttttaattggcaaataaaaattatatatatattgatcatgaacaacatggtgggttttatttatttatttattttattattatactttaagtttcagggtacatgtgcacaacatgcaggtttgttacatatgtatacatgtgccatgttggtgtgctgcacccattaactcgtcatttacattaggtatatctcctaatgctatccctccccagtcccccatcccacaacaggccctggggtgtgatgttccccttcctgtgtccaagtgttctcattgttcaattcccacctatgagtgagaatatgcggtgtttggttttttgtccttactatagtttgctgagaatgatggtttccagcttcatccatgtccctacaaaggacatgaattcatcattttttatggctgcataatattccatggtgtatatgtgccacattttcttaatccagtctatcattgatggacatttgggttggttccaagtctttgctatcgtgaatagtgctgcaataaacatacgtgtgcatgtgtctttatagcagcatgatttatacttctttgagtatatacccagtaatgggatggctgggtcaaatggtgtttctagttctagatccctgaggaatcgccacactgacttccacaatggttgaactagtttacagtcccaccaacagtgtaaaagtgttcctgtttctccacatcctctccagcaacaacatggtgttttaaagatatgtatacattgtggaatggctaaatcaagctaattaacatatacattacctcacatcctttttttattttttatttttttgaagcaaggtcttactctgtcacccaagtggaagtgcagtggaatgatcacggctcattgcagccttgacctcccaggctcaagagatcctccacctcatcttttttattattttttgtatagatggagtctcactatgttgcccaggctggcctcaaactcctgggctcaagcaatcctcctgcttcagcctcccaaagtgctaggattacaggcatgagccatcacacccaaccctacctcacatacttagcattttttttgtggtgagaacacttaaactctcagtgatttttaagaatagaatacattgttataatctatagtcaccatgttgtacaatagatctcttgaacttgttccttctgctcaacggaaattctgtattctttcaccatctccctaatctccccgactccttagtccctggtaaccaccattctactttgcttctatgaacattctattctgcttctatgaggtcaacttctttagatttcacatatgagatcatgtggtatttatttttgtgtgcctggcttatttcacttaatataatgtcttcgaggttcatacctttttttcataaatgacaggatttcctccttttattgaggctgaatagtattccattgtctatatatacaccagattttctttatccacttatccaccgataaacagttaagttgattccataccatggctattgtgaataatgctgcaatgaatatgggagtgcagatatctctttgacatattgatttcacttcttttttatattctactacgtagtgggactgctggatcatatggtagttctactttaatttttttgaggaacctccatactgctttccatgatggctatactaatttacattcccacctacaatatgcaagagttccctattctccgcatccttgtcagcacttgctctcctttgtcttttttataatagccattctagcagatgtggggtgatgttatcatcgtggttttaatttgcgtttctctgatgagtagtgatgttagacattttttcatatacttgtggaccacttgctcatctccttttgagaagtgtcttgtcaggtcatttgcccattttaaaatcaggttatttgtttccttcctattgaattgtttgaatttcttatatattttggatgttaaccccttctcaaatgcctggtttgtaaatatattctcccattccatacattgtgtcttcactctgttgatggtttcttttgctgtgtggaagctttttagtttgatgtaatcccatgtgtctatttttgtgtttagcaatgtcgtggaacttttcctctatgttttcttttagtagttctacagtttcatgtcttacgtttaaatctttaatctattttgaatagcttttttatatattgtgagaaaagggtcaaattttattcttctgcatgtgggtatccagttttaccaacactattggttgaagaaactgtccttttctcattgtgtgttcttgacacctttattgaaaaccaattgactgtaaatgtgtggatttatttctgggctctctatttccttccattggcctatgtatctgtttttctgccaataccatgctgttttgattagtatagctttgtagtttattttgacttcacatagtatggtgacttcagctttcttatttttgctcaagattgcgatagctagtcagggtctttttgcttccgtggaaacgtcagtatttttttttttatttctgggaaaaaatgtcactggaattttaatagggattgcattgcatctgtagattgccttgggtagtatggacatttaacaatatttttccaatccgtgaacctgggatatctttccatttctttgtgttttcttcactttctttcatcagtgttttatagtttttagtgtacatgtctttcacttcaacattaaatttgctcctaaatatttttgtagctattgtaaatggaatcatgtttttaatattttttcaggtagtttgttgttagtatgtagaaatgctactactttgtgtatattgattttgtatcttgctacttaattgaattcacttattggttctaaattttttttcattgcctctgtaaggttttctatatataagatcatgttatttacaagcagacaatttaacttcttcctttccaacttagatatttctcatgcctaattactctgactaggacttccagtagtatgttgaatagaagtagtgagagtgggcatccatgtcttcttccttattttagaggaaacgctcctaactattcaccattgagtatggtgttatttgtccattggtcatatatggcctttattgtgtttttttttttaaatcatggaatgatgttgaattttgtgaaatgatttccattttttggaagaatttgagaaggattggtattagttctttaaacgtttggtaggagcagtgacaccatcagatcctgagcttttcttagatggaagattttttgttattcatttaatctccttattcattatttgttcacattttctatttcattatgattccatctcggttttatatgtctaggactttatctttcttctagattatccaatttcttggtacataattgttcatagtagtcgcatgattttttatatttctctggtaccagctgtactgtcttctctttctttttttattttatttatctttttttaattttttttattatactttaagttttagggtacatgtgcacattgtgcaggttagttacatatgtatacatgtgccatgctggtgtgctgcacccactaactcctcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagcctttgctattgtgaataatgccgcaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctattcatgtcctttgcccactttttgatggggttgtttttttttttcttgtaaatttgtttgagttcattgtagattctggatattagccctttgtcatatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctacgtcctgaatggtaatgcctaggatttcttctagggtttttatggttttaggtcgaatgtttaagtctttaatccatcgtgaattgatttttgtataaggtgtaaggaagggatccagtttcagctttctacatatggctagccagttttcccagcaccatttattaaatagggaatcctttccccattgcttgtttttctcaggtttgtcaaagatcagagagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatgctcttttatttccttgagcagcggtttgtagttctccttgaagaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattaccgtggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctgatctcataaaatgagttagggaggattccctctttttctattgattggaatagtttcagaaggaatggtaccggttcctccttgtacctctggtagaattcggctgtgaatccatctggtcctggattctttttggttggtaagctattgattattgccacaatatcagatcctgttattgatctattcagagattcaacttcttcctggtttagtcttggaagagtgtatgtgttgaggagtttatccatttcttctagattttctagtttatttgcatagaggtgtttttagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaatattttgaaggcttttttgtgtctctatttccttcagttctgctctgatcttagttatttcttgccttctgttagcttttgcatgtgtttgctcttgcttttctagttcttttaactgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgtcttcatttcgttatgtacccagcagtcattgaggagcaggttgttcagtttccatgtagttgagtggttttgagtgagattcttaatcctgagttctagtttgattgcactgtggactgagagatagtttgttataatttgtgttcttttacatttgctgaggagagctttacttccaagtatgtggtcagttttgcaataggtgtggtgtggtgctgaaaaaaacgtatattctgttgatttggggtggagagttctgtagacgtctattaggtcctcttggtgcagagctgagttcaattcctgggtatccttgttgactttctgtctcgttgatctgtctaatattgacagtggggtgttaaagcctcccattattaatgtgtgggaatctaagtctctttgtaggtcactcaggacttgctttatgaatctgggtgctcctgtattgggtgcatatatatttaggatagttagctgttcttgttgaattgatccctttaccattatgtaatggccttctttgtctcttttgatctttgttggtttaaagtctgtttgatcagagaataggattgcaacccctgcctttgtttgttttccatttgcttggtagatcttcctccatccttttattttgagcctatgtgtgtctctgcaagtgagatgggtctcctgaatacagcacactgatgggtcttgactctatccaatttgccagtctgtgtcttttaattggagcatttagtccatttacatttaaggttaatagtgttatgtgtgaatttgatcctgtcattatgatgttagctggttcttttgcccgttagttgatgcagtttcttcctagtctcgatggtctttacattttggcatgattttgcagcagctggtacccgttgttcctttccatgttcagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagggtttctgccgagagatccgctgttagtctgatgggcttccctttgagggtaacctgacgtttctctctggctgcacttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacatagatttggtcttttcacatagtcccatatttcttggaggctttgctcatttctttttattcttttttctctaaactttccttctcgcttcatttcattcatttcatcttccattgctgataccctttcttccagttgatcgcatcggctcctgaggcttctgcattcttcaggtagttctcgagccttggttttcagctccatcagctcctttaagcacttctctgtattggttattctagttatacattcttctaaatttttttcaaagttttcaacttctttgcctttggtttgaatgtcctcccgtagctcagattaatttgatcgtctgaagtcttcttctctcagctcgtcaaagtccttctccgtccagctttgttctgttgctggtgaggggctgcattcctttggaggaggagaggcgctctgatttttagagtttccagtttttctgttctgttttttccccatctttgtggttttatctacttttggtctttgatgatggtgatgtacagatgggtttttagtgtggatgtcctttctgtttgttagttttccttctaacagacaggaccctcagctgcaggtctgctggagtaccctgcagtgtgaggtgtcagtctgcccctgctggagggtgcctcccagttaggctgcttgggggtcaggggtcagggagccacttgaggaggcagtctgcccgttctcagatctccagctgcgtactgggagaacccctgctctcttcaaagctgtcagacagggacagttaagtctgcagaggttactgctgtctttttgtttgtctgtgccctgcccccagaggtggagcctacagaggcacgcaggcctccttgagctgtggtgggctccactcagttcgagcttcccggctgctttgtttacctaagcaagcctgggcaatggtgggcgcccctcccccagcctcactgccgccttgcagtttgatctcagactgctgtgctagcaatcagcgagactccgtggggtaggaccctccgagccaggtgcgggatataatctcgtggtgcgctgttttttaagcccgtgagaaaagcgcagtattcaggtgggagtgacccgattttccaggtgccgtccgtcacccctttctttgattaggaaagggaactccctgaccccttgcgcttccccccgccgagtgaggcaatgcctcgccctgcttcggctagcgcacggtgggcgcacccactgacctgcgcccactgtctggcactccctagtcagatgaaccgggtacctcagatggaaatgcagaaatcacccgtcttctgcgtggttcatgctgggagctgtagactggagctgttcctattcggccatcttggctcctccaatgtcttctctttcatttcttgttttatttatttgagccttatctttttttcttagtctaaataaaagtttgtcaattttgttcatcttttttttttttttttttgagacagttgctctgtctcccaggctggaatgcagtggcgccatcttggctcactgcaacctccacctcccgggttcaagcagttcttctgcttcagcctcctaagtagctgggactacaggcacatgccaccatgcccagataattttttgcatttttagtagagatggagtttcactacattggccaggctggtctcaaaattctgacctcaagtgatctgcccacctcagcctcccaaagtgctgggattacaggtgtgagccaccatacctggtgattttgtttatcttttcaaaaaaactaactgttagtttctagtaagacaagtctgggtggcaatgaactccctcagcttttgtttgtctggtaaagtctttatctctccttcatttctgaaggatagctttactgggtaaagtattaattggcagggttttttctcttcggcactttgaatatatcttcccactctttcgtggcctatatttctgctgtgaagagcactgctagctttattggaactcctttatatgtgatatgctgcttttctattgttactttcaggatcctctcttttatgttgatttttgacagtttgattataatatgtcttggtgttgtcttgtttggattgtatcttattggagactgatgaccctcctgtacctgtatatttatctttccccaggttcggaaagttttctgttgctattgattgaaatgtgttttccagaccttcatatctcttttctccttattgaactcctataattcagatatttgcccttttgttgttgtcccataagtccctaagcttttttttttattgaggaagatctttttttaatgttattttttttttatttccagcttgtaagttcagggggacatgtgcaggatgtgcaagtttgttacataggtaaacgtgtgccatggtggtttgctgcataaatcatcccatcacctaggtgttaagtccagcatccactaactgttcttccttatgatatccctcctcccagcccccaccctccagcaagccccagtatgtgttgctaacccccatgtgtccatgtgttctcatcattcagcttccacttataagtgagaacatgcagtatttggttttctgttcctgcattagtttgctgaggataatggcttccagctccatctatgtccctgcaaaggacgtggtcttgttcctttgtatggctgcatagtattccatggtgtatatgtaccacattttctttattcagtctatcattgatgggcatacgttgattatatgtctttgctattgtgaatagtgctacaatgaacatacgtgtgcattatttttataacagaatgatttatattcctttgggtatatacccagtaatgggattgccaggtcatatagtatttctgcctgtaggtcttcgagaaatcaccatactgtcttccacaatggttgaactactaatttacattcccaccaacagtgtaaaagtgtaaaagcattcctttttctccacacacaaccttgccagcatctgttgttttttgactttttaataatagtcattctgactggcatgagatggtatctcattgtggttttgatttgcatttccctaatgatcagtgatgttgagctatttttcatacatttgttggccatgtgtatgtcttcttttgagaagtgtctgttcatgtcctttgcccactttttagtgggttttctttttttttaatttgcttaggttccttgtagatgctgggtattaggcctttgtcagatggatagattgtaaaaattttctcccattctataatttatttgttcattctgatgatggtttcttctgctgtgcagcagctctttagtctgggaaggcactttattggcctatcaaggaactatgggtaggctgttttgcatggttcacatgtgtgctgactcctggagtcctttggcagcctggccttgttcctggattagcagctgggtgggcctggatgcctaggtccatggggttggatctggagcctatatccactgaggtggacttcttgattgggtctgaaggattgggcttggagcctgtatccaatggggctggcctgaagtttaggcccccattggctgaccaaacactaaagtggtgagtctgaatctgcaagagccagccaggtgggaatgggccttgtgcctgggtcccctgggataggcctggagcctgagtctgtaggggttggcctggcactggggtgggcctcaagcctgaggactagggcaggcctcagtcctaggtcagtgggtgctggcctggaaccttggtttgtaggggtggttttagagcctcagtccatgggggctagcctggcacctgggtctactggggtggtactagacccttggcctactgcagcaggcctggaccctgggtctactggagcttggggccactgagacagtcctagagcctggagctggcctggagttggggcagatgtggagcctcgggccacaaggactgccttgaagcctgggattgttggtactaaattgctatttggagacacactggctggcctagtgtgtggggctgtggggacctgcctggggcctgggtctgtgggggccagcctgggggatggatgtgtgtatgctagcctggaggctaggtctgtgaggtctgacctgggtcctggagctgcaggagctgtcctggaacctggctgcataggggaagtgctgaggctttgatccatgggggccagcccatccctagggtctaaattggcttggacccttggtctgctggagcagacttggaccgtggctccactggagtgtggagtgacataagcaggtgtgaaggctgtgttcatgagtgctagcctcgtacctatggccaggggtacagatctggtattggggcaggcctgtagcctggggctgtgtgggctgacctagctctgaggtggtctgaaaacctggggtatgcctggatcctggggctgcaggggctggcctggcactgagtaggcctggatcctatatctacaaggagcagcctagaggctgggtccatgggtgctgacctgatgactagggctgtggggctggcctagtgctgaggcagacctgaagcctggggctacgggggatccagcttcatactggcagcaatctggtgcctggaactactgatgtcagcctcgtcctaaggatagagactgcatctaaagcctgagtctgttaggactgctatggcactgggacaggcccaaagcctggggctaatgggtctggtccagcactggggccagtctggagcctgaatccgctggggttggcctggtgatgtggcagtcctagagatcaagtccttcgggcaggtctggagcctgggtctgcaggatatgacctggagtctggggccatgggggcctgcccagtgatgagttttactgccgccagcccattgttgtggtctgaggtaaattccagtactcactttcctcttcttcccctaagtggaggatatctgtcttcatgctctatggcctggggttgggggaggggtgacatgggtattaaaaagctgttgttcctacactcttcaatgcatcttttctatttctgtgccacagccaggtgctgcaatctctcacctagttttcctagctcttgtggaggtatttccatgtgtggatagttgttcaaattgatgttcttgtggggaatgagcgctggaaagtcctattccaccatcttgttgatgttcagtggacacaagctctttatcagacatgtattttgcaaattttttctttttattaacaccgtctttcatgaacagaagttttaaatttcgacatagtcctatttatttttcttcttttatggattgtgcttttggcattgtagttgagaaatctttgcctactgcaaggtgacagaaaaggtctcatgttttcttcaagaaattttacagttttaggtttacatttatgtctatgaacaatttttagttaatttttgtatttggttcaaggtatggattgaaaatttttttttttttttgcacatgactatccaattgttccagcatcatttgtttaacaaactattctttctctgttgaattgcctttgtgcctttatcagaaattagttgtcatatatgtgtggatctctttctggactctattccattccattcttctattcatccatccttacgctattcccatactgtctttatcagtgtagctatgtaataaatttgaagtcaactttaacaaatccatccttacactattcccatgctgtctttattagtgtagctatgtaataaatttgaaccccaactttgttctctttctaattgttttggctattccaaggcctttgtatatccatatgaattttagaatcattattttaagttttgcataaatgaattttgattcgtattacattgaatctatagatcagcttggggataactgacatcttaacaacgttgctgagtcttccaaaccacgaacaacttacatacctccatttatttaggtctttaatttctctcagcaatgttttctacttttcattgtacctgtcttctgcatcttttgtcagatttatccctaagtacactatattttatgctattttaaatggcattttaaaaaaatttggtttccgattgcttattgttgatatgtagaaatacaaatgatttcttgtatattgatcttatatcccacaactttggtaaactcacttattagttgcagtacagtaccttccctgtagattccatcagattttattttatttttgttttgttttgtttgtttgtttatgagacctgttctgtttcgagacctgttctgtcacctaggctggagtgcggtggcatgatctcggctcactgcaacctccacctcctgggttcaaacgattctcgtgcctcagcctcccaagaaactgggattacaggcatgcaccaccacgcctggctaatttttgtatttttagtagaaatggggtttcaccacgttggccaggctggtctcgaactcctggcctcaaggaatcctcccaccttggcctcccaaagtgctgggattacaggcatgagctactgcaccagccccatcagattttctaaatagacaatcatgttgcctgtgggtaaagataatttcacttctttttcaatctgggtgcaatttatttttttcttgctttgttgctcttgttagattctccagtaaaatttgagtaaaactgatgagagtggacatccttatctttttcctgattttagggggaaagcattcagtcttccaccagtaagtatgttagctgtaggtttttcacagatatcctttatcaggttgagggagttccatttggtggtgggaggggtaaggaatggatgttgaatttggttgtatggttttctgcatctgttgaaatggtcaatttttaaaaaattgttaatatagtcagttacattaattgattttcaaatgttaaaccaatgctgtatttctggaacaagccccacttgatcatgatgtatactcctttttatataatttgatttgctaatggtttgtttagaatatgtgtatctatgttcatgaatgaaattggtttgtagttttatattcctgtaatgtttttggttttgctatcagagtaatactgacttcatagggtgaattgggaagtatattctccttttcagttttctggaagagtttgtgttgaaatgatattatttcttcctcaaatgtttttggtagatttcaccagtgaagccatctgggactggagttttctttatgcaaaggtttttaattataaattaaatgtctttaatagatatagggctattcaagttatctattatttattgatttagctttggtggtttgtgtctttcaaaaatttgtttcatctaagttgttgaaattatgggcctaaagttgttcataatatcccccatattatccttttaacacctgtaacctttcttatttctgatatttgtaatttatgtcttctctatttttcttcctggtcagtgtaactaaaggatcaatcagtgtagaaggtcaattttattgatcttctcaaagaacccagcttttggttttactaatttttctctatcagttttgtttttgtttttgtttttgatagagtctcaaaaaaacgaacacagctcactacagccttggcctcccaggctcagtttatcctcctgcctcatcctcccgagtagctgggaccacaggtgcatgccactacacctagctcattttaaaacttttttgtagagatagggtctcaccatgttgcccaggctggtctcaaactcctgggctcaaacgatcctcctaccttggcctctattgtttttatctgatttctatttaatttatttacgttctgatctttatcatatccattcttctgctttctttgagttccatttgctctacttcttcttatttctaaaggtgaacactgaggtcattgatttaagacctttattctggtctatctggacagttaatgctacaaattatcatctaattactgtttagtgacgatacacaaattttgatatgtcatgttttcattttttttttttttcaggttttcctttagcatttttattagacccaaatgaaaacaaaggctaatttagaagccaagcattgattttcccatttgttaatattatgtcttacaatgagttttaacactgaaactcatctaatattaaacagaaacggttgagttacttgttgattttcaatggctgtttttccccctgcattcctccatgcatttatttgtccttgtatcaacaattacttgagctttaccatatgcaaaggggaaggctttacttctctttggaaacatagccttccctgttgcatacagtatttccacaacacacagtcttctgattcggaggaagtgacatgatggtctatatttcaacagttcttttacagtgaactaacaactttatagatgacaccatgacgttaggctttgaaacttatgcgagggtgaggattaaggaaaacagagatcttttcgagatatttataatactctcaaaggagggaccatttggatatcatattagtttcctgttgctgctgttgtaaaggctgccaataaattaccacaaagttaatagcttacaacaacacaatccattatcttacagttcaggaggccgcagtcccaaatcagttcactgggctaaaatcagcgtggaatcagggttggcagaggatgttttcattttaatttggttccaaatactttccaatttaactttggattcctttttaaacttgtggattatttagatgtgttacttattttccaaatatttgcagattttccagagaacattcttttgttgatttttaatttcatttcattgtagtcaaagatcatactttgtatgactttaatccttttaaatatattgagacttgttctagggcctagaatattgtttttcttggtaaatatttcatgtgcacttgagaggaatatacattttgctggtgttgggttgaatgtgttataaatgttagccacatcaagttgatttagtgttaagtgtactgaatccttgctgattttctattctatcagttattgagagaggatattgaaatctttaactataattgtggatttgttcatttcttcttgcagttctaccagcttttgcttcttatattttgaaattttattgggtgcataagcattcagagttatgtcctcatgataaactgattattgtcttgaaataaccttttattgccaataatattctttgctctgaaattcactttatctgatattaatatagccactccagctttcttttgattaccttcactttagtgtatattatcccatcctcttctttcaatcaattttgcttttatatttaaagtgtatttcttgtaggtggcatatatttaaaagatgtgttttgttttgttttcagtcttactatctctgccttttaattggtcatttggtcatttatatttaacatagatattgatacacatagatttaaatttagcatcttattaattatcttctgtttgtcccatttgctctttttccttttttctgctttattttggattaattgaatttttatgattacatttatctccctttttgcttattagtttgaacaaatatttatttgttgcttgaagtctatagtacacatatttaacttgtcatattccacctttaagaatataatggaatataacacacagctactcaattttttattttattctgtattatatttcaaattatggatgtaccaaagtgtgttttgcccattaattatgatggaatttaggctgatttcatattttactctttttttttttttttttctgagacagagtttcgctctgtcacccaggctagagtgcagtggcccgatctcggctcactgcaagctccgcctcccgggttaacgccattctcctgcctcagcctcccgagtagctgggactacagacgcccgcaactgcacctggctaattttttgtatttttagtagagacggggtttcaccgtgttagccaggatggtctcgatctcctgacctcgcgatccaccctcctcggcctcccaaagtgctgggattacaggcgtgagccaccgcgcctggcccatattttactcttataaacaatgctggatgaacatccttatgtgtatttgtttacttttgcaaatatatccgtaagataaattcacagaagtgcatgtgcagttgctcagttgggcatttttctggtgttcaaatcctccttgaaagcttagcaactcacattactttatgaatactaacattttaaaaatgttcttaaaataagttccaaattcattgtggcataattaaccatagatatgtaatttctttgattagagtatatcatttttgaatttttttcttgtttttcagctttgcaggcaataattactttagagaatatattaacagatgaagagtcagaagataatgatctagttgcagagagaggttcacctaccatgcttctaagtttagctgcccagtttgctctagaggtaattcatatgtattcatctactagatttttatcccttttcctttttgaaagacaattaatagaatcattatcagttagacacagaagagacctttactgtttgttttgcctcatattttcatgccaaacttggttgcagaactgctttatttcttctcatttcactataatgcagactaaagtaaatgaaacagtgaggtaacagagttgtgctcaaaacaacataaaaataaacgtagcaaaacattaattttttaaaagaaactccaaattcaaaatgccataccatgtcaataaatagctatctatatagaaacttatctttctcatcaatttgaacaaaatggtttaaatttctggagatcctttgagttcataaccacaaaatagtattagtttagaagtaataaataattgtacccctgtttgttactacagaattctggttttattaatatattgaattaggaaaagcatagtagcatctgtggagctcttagactaggtttgaatactggctctgccatttaatctgtgcttaacttcttcaaatcttaatttcatcctttgcaaaataaagataatgcctacctccaggattgttatgaaaatcgattaagatggctgaaaatgtgctttataaactattaagtttatcttctttttaaaactactttaaataggaaaaccatcttcctgatcagaactacagttccatatttcttccagtagctctctttggctttctacatcaaatgtacatttataaaccttcctttaaaaagataattgcttttgggtttcctctctttcatcttcttccccattctgcacaaatacattccatatctgcatctgccaaatacttttcttccttcaggagttctattacccttctcactaacatcaaaatacatatcattcaaactgtatttagcaactactttgggcaagatattgggctagatgctagaaatatgttccttcaggacctcacaagtcaatttgaacagacaagccatgcattaggaaagtaagtctacagaatatagagttctatgtaagtatatagaataaagaccaaatagctaatatatatgttaaaaattaccaaaattcagagtaggaagagagcactgagaaccagaatcgatttgggaagtctctacagcggaaggaaaccttaagttgggctttggaaagagtagcatttacataagtaagaatgtttttttaaaggaagagatggtataaacaagacatggagaaaggaatgtgattggcttgagagacacagtgtttggttaaagtgatggagggcttatgtttccaccattccagatgttttgcctgatgtaatagtggctttttttttttttttgacaaagtctcactctgtcacccaggctggagtgcagtggcgtaatctcagctcactgtaacctctgcctctcaggttcaagtgattcttgtgcctcagcctcccatgtagctgggattacaggtgtgcgccagccacacctgactaatttttgtatttttagtagaggcggggtttcaccatgttggccaagctggtctggagctcttggccttaagtgatctgtctacctcagcctcccaaagtgctgggattacaggcatgagccactgcaccagccatgacttttattattatgttgatgctataggggaggagtatgagataaagtagaagaaatagctgtgacaagattatatatacattttattctctaaacaataagaaaatattgatggtaatttatgtaaaagtagtgctttaggaaaataatttgggttgtgcatggggaaatgaatggggagaaattatatgtaggacagaatgggagactgtgataataatccagttttaaaataatgagagtctagacaagggtagtgagagtggggtattaagcaggcaaaacattgctttcttttcttttaaaataagctaccttatctttaaatccctttacaaaattcattcccccacctcccaagagaaaatgtggatattctaggttctgaaaactgaagcagtcaggaagagaacttccacagattcctactacctctactcacacaccaggaatcacaccacatagtctgccttctcaactgccaccatagattagctatcatgttccttcctaaagccagtctctaaacttacacacttgtttctatcacctcttgcctttttctcactcactttgtcaacattttattctcttactggtttattcccatcagcatatgaacatgctcatttatcccatatcaaacaaacaaaaagtaagaaaacctcttgaccttccttctctcaccaactactccccaatttctcttcttccctttgtagttaaactcctctaaagatttgcctatatttactgtctccaattctctcttgagcttactccaatcaggcttttgccccaccactctaacaaaactgcttttgtcaaggtcaccaatgacctctttatcgtaaattgcagtggttaattctcagtcctcattgtatttgacctatcagcaacattcaatgcagttgatcactctttcctccttgaaacacagttggcttccaggacaccacattatccttatttttatcctacctcatgagtcactctttctttctcctttgctagttcctcttttctcttcaaccattctcagtgtcaaattatgagctcaggagaggaggtattagggagttgagaagaagggataaggtattaactattcattcagaaaagtaagaaagtgaatgactacggaagtgcaatatgcttgccagtagcactaaggccatttcatgaagttttaaaataaaacaagtagttgtatgtatttttttctggccacattcagctgatgagtggatgtaagcaccaaaatcagtagaaagttggacttaatcagagttgaggttttgccagatgaatacaataaagcaaaagaagggcaggaaaatcaaggaacaagggagtggttataattagtctccatggaatttaaactgggtatgcggtagaacatcaaggggatgagggacagtgaaaaactggtaacatcagtgggttgggggtcttactgcagttgaaggattgctggagtcagggtaatagaggtatcaagttggaaaggtaagaggcggtagacagaaagtagaatgtgtgaaagtaagagctggggtggagaactagggggagggagggagacacctagggcacaaaacttaaggaggaacttattctctgggtggtacaagtaaaggcttggtacttgtacaacactgagagcctccttaaatttttcaccctaggtgcttcactcacctcacctgtcccaccctactcctagccctgactgagagtgtgaaatgattgcaattgttagtaatgacagagtctagtgaatgactgtgggagtaaatggctaaggtaattgttagagtaaaatttcagaaaccaggaaactagaatattgggaggatcctctacctatatattgaaaatgcggaaaatatgccgcgcgcagtggctcacgcttgtaatcccagcactttgggaggcccaggcgggtggatcacctgaggtcaggagttcgagaccagcctggccaacatggtgaaaccccatctctaaaaaaactacaaaaattagccaggcgtagtggcgggtgcctgtaatcccagctactcaggaggctgaggcaggagaatcgcttgaacccaggaagcagaggttgcttcagcctgggtgacaagagcaagaatccatcttaaaaaaaaaaaaaagaaaaagaaaaagaaaatgccaaaaattaagacaggagcagtttttggaaaatataactgagcaataagtaagtcaccaacaaatgagaagaaatgacctgggagctagtaggccacagcaacaatgaagggtagtgggtgatatagtctggttataggaaattcaaagttgaggattttagggaatagaatgggagaataattttaaaatggcaatgaagagcaagaaagacacctactccatctccaggcctatgggtaagctagtgagagcaaaaacagctaccacttaagagggcttcagtggaagcagcatccttggcagaaacctagatttccattagagcaagaatatggaggaaacttttagggaagaggttgctggtagaggagattttgctgaaagtggactgaatttcagagagcatagtggaagggttggaggagtcggggagagatagaaaaagaggacagaagaggggatatatggagacttttgggaatagagtgctggaaatgagggtgacctgacaatctggggttcttttgtttactgctaataagtgggggataaagagcacaataagattagtcctagtggactaagggtagtattggcaaggctttgagtgtttgtgaatagggaggattcggtttccggggctaatgcaaatgtgtcctgtttttgtcagtgagttgcatcttcattctaccatcttgcagtagcgtttttgagaatacaaaatgaacatgtttagatatttgtcttatctttaatgaacaggaatatagataatattttgcagtatcactttgagatgtaatttaacgtattatatttgttctttttagaatggacaacaaattgtggcagaaaaagctttggaatatttagctcaacattcagaagaccaggaacaagttcttacagctgtaaagtaagtaacctacatcctgtggaagagaaagtatttcctctgcttatcttgctcttagtcaataaactgccaaaatagtgctattgagatcaaggaaacttacataaaatagcgaagcagaggagggtgaggttgggacttgataaatacttaatggtatgactgagaaaatgccacagtgagaaataagaaaccagcaggattctagagtggttctcctgttggtcaattacacttgaggccacatttccaaagggaaatggagtcacataaataaaagagtcagaggagtcttgagatacttgcatcccttcagtaaggtaaatatttaaaaatcattcaggagagatagtattttttaaagctttttaggttttaaaactttaccaactaccttattttgtcagtttgtcattatgctgccagatcccttcaaagaatagtgatcccagtttgagacccaaaggccagttctagttcctctacagaaagagaaagataaagactgatttaccatacctgatgttctagcaggtgtttttgagcaatggtataaactgtggaaccatttaagaatttgttataagcaacgcttttgttttaaaactcttttattaaattcctctttcaaaattataaaattggtatgttttcattgcaactgttaaaacaataaaatatatataaattaaataagattaatctcccctttaccctctcttttctcacttctccctcccagagtaatcaaggttagtaacttggtatgtattcattcacacatgtttcttcctaacctaagaatcactttccatattactttgtcatacaggtgtttgcttcgttttcttcttccaaaaattgctgaaatgccggaatctgaagataagtgagttatttcaacaaaaatgatgtattccccattagacaaattatagtaacttacaatataaatcatatattcagagatacttagtgtagtgggtaagatcaatacaggttttggggccagtcttcctgggttcatatcctggctctgctgcttaccagatgtgtaaccttcagcaagtttcttaatgtctctgggcttcagtttccccaactgtaaagtgggaagaataataatacctacaccattgggttgctgtgatgactcaatgagttaaaacatctaaaaggcaaaagacttatgtgatctgcagagaaacgagagtataagttaatacatgtgaaacatttagaagtgtcaggaacttaataagccctcaataatgttatctatgatagaattatgatattgcatctgttccccctttcttaacagatgactcaaatatagacatatctcttactttcccacagaacatataacctggatggcttgttggttatgattctgtatcaggtctgctgagagtattcaaatatatttctgtgcacaatatctttggaataagatattaaaacttaacaattcgttgaagactttggtcaccaatttttcgttcacaaatctcactacctcctgattatttgaaagaaaactctactcggggtgttgattagggataactttcagagaaatatcacccatctctgcattctctgcttagacaagaactctgtaatagttccctctacttcacttttgcagctggaggcaatgtattttttcaaataaattcttttggatatatctttgactgaggtaacataggacagatgacttataactgtcattttcataatgcaaattttacccaattgcatattataagttttgccttttctttataggcttcataaatccattagaagggaattcaaacaaaccaaacaaaagatgaagcaattggaattttgaataatgaccaaatatttgctgatactaagaaattattaacttttagacatgataattgtagtgtggttggttttttaaaagattgcttatctcttacagacacatcttgaaatatgtatggatgaaataatgtgatgtctggaatttgcttcaaaataatatgggagaggaagaagtgggtggaggtatcaaggagataagattgatgatgagttaataattattgaagctgtgtgataggtacatgaggattcattatgcttgtctgttaacatttggacatctttgaagttttcaccaataagaagcttttttaaaaaaggactaaaccatgataactactagattgtaagagtacctttagggctaggactatatttgtatttatctttgtatcactgaaacctagggcagtatctgacacataattgccattcgatttatttaaatgactgaatattagttatttataatatctccagcactggacttaaagatgcttcatatttctcataattgtggcatacagtcaaaccacacacattaaaaccaattgggaaatggggtaagggagggaatcctgtttgaattaatgagaaattacaaacactttttaaaatataccttcattgttttcaagtaaatgcagtgacagagaacatcctctagcaatgttttcaggtagaggttagaacctgatttaacaaatagattagactaacttgtaaaaaatattttaagtgcctaattcaatgagagggctcaagagaattgaattgtaggttcagctatttcaataacttttggtttactgtaggcaatggcaacttctttaacttctctaagctttattttcctcatctgtaaaattttaaaaactggactggataatttttataggccttttctgttccaaaattcctgtggttataaatgagcagtatctacctaagtactaacaactcatatgctaaatcttttaaaagcagtttttctcttaaatagattatacattcctttgcatgtcttcattcttatttgtactgtatatttttattaatggacccttcctagattatttgatatgaagtcaccgaattaagcagtgaagaaatcaactttagcttggctgaaattcaaattaataaatttactgtaagaagttactttatataaaccagacttctaagatttatccctgaaaaatctgctgcttttcctgaccacagtctttatatgttaaacctctactgataaggccagtcttatagtatgttctacccttcttcctgtaaacttccttagttgagtttgccaatactttcgtattcattcctttgtttgctttaagtttttatttcattttattttttaagtttaatattttatttttatttatatatatatatatatatatatatattttttttttttttttttttttttttttttttgagaccgagtttcactctttcgcccaggctggagtgcagtggtgtgatctcggctcactgcaaactccaccttctggtttcaagtgattcttctgcctcagcctcctgagtagctgggactacaggcatccgccaccacacccggctaatttttgtatgtttagtagagacggggtttcactatgttggccaggctagtctcaaactcctgacctcgtgatcctcccacctcagcctcccaaagttctgggattacaggtgtgagccaccgtgcccgaccctaatattttatttttttagttaaattttaggttcacagaaaagctaacaggaaggcacagagattcccatacatcccctctccccaccacatgcatagcctcctccattccccgccagagtgctacagttattacaattgatgaagctaaattgacatatcataatcatttgaagtccataatttatattagggttcactcttgatgttgtacattctatgggtttggacaaaggtataatggcatgtatgtatcattacaatatcatacagagtattttcactgccctaaaaattctctgtgctccacctattcattcctccttcatcaaccccttactgtctccatagttttgtcttttccagaatgtcatacagttggaatcatacaatatgtagccttttcacattcgcttctttcacttagtaatatgcatttaaggttcctccatgtatttttgtgtcttgatagcactgaatgatattgtattgtatgaacgtatcacattttatttatccattcacctactgaagggcatcttgatttcttccaagttttggcaattgtgaataaagtttctgtaaacattcatgtgcaggtaactttttagctcctttggtaaatattaataccgaggagcatgattgctgggtcatatggtaagactatgtatgtttggtttgtgagaaaccggtagactgtcttccaaagtggctgtacccttttgcattccttcctgccagcaatgaataagagtccctgttgctgtgtgccctcaccagcatttggtgttgtcagtgtttgagattttgaccattctgataggtatgcagtggtaactcattgttttattttgtatttttctgatgatgtatgatttggagcgtctttttatgtgtgtatttgtcatcgtatatcttctttggtaaggtttctgctaaggtctttggcccattcttttctcccaaggattttaggacccttgccagcaacctcagaccaaatacacttctaattataccacagtataataccacagtataaagatccctggcgtttgaccacagatcccaaatataacaaaaggatcataacggttaaaagacactggcacatggccgggcattgtggctcacaactgtaatcccagcactttgggaggccgaggcgggcggatcacaaggtcaggagattgagaccatcctggctgacacagtgaaaccccatctctactaaaaatacaaaaaattagctgggcgtggtggcaggtgcccagctactcgggaggctgtagtcccagctactcgggaggctgaggcaggagaatggcatgaacccgggaggcagagcttgcagtgagccgagattgtgccactgcactctgggcaacagagtgagactccgtctcaaaaaaaaaaaaaaagatactggcacattactggagtcccattcagtcattaataatttgtccagtccatcattatatcatgaaattgtctcccaggtcccagggcaaggctactgaggtttccaggcttctgtttggtcagattccaaaagcaggagtggtctccacaatatatggcttcaccttttcaggcatctggtataattgaactaagagacaatatcatcttttgctttgagactcttttgaggtactgatgtaatattggatttcccttactacataactcatttgttcatttcttactctcatctactattcctccttttttctatttataaccaaacttttccacatttgaaagaacattaggtgctggtccagattacaggcaacactactaatctagcaaatgcctccccctcagtccactcccatttatataaggtagggttatatagatacagaactagtggactatcttgaccattaagcaatacaactgcatttactcttaaccccaattttgctagatagggtaaagacacaccctgcccccaagaggcccttaggaattctgacataaagatttaaaaatatagttaggtttcttgcttaggaatctgccctgtttccaacacttgtagttgcagccatggtcttgctcatgtttcatcaggtaggaaacataaagttgaggtgatatgaggaggaaagaaagaaagaaaaaaatattgtcatcatgccagtgtcctacacccttgggaagaattgcagtcatactagcatccttccccaactcctcttcctcagactcagcagaaaaacagaggagtctatctagtggggacacttccttagccccaccccccatattgagtgtgagcttgtgaaggcatgtaagccagtccttcatccctatgtctgcccccattttagacaaccaatgtttcaattgcttgttccggcttccctttctaactattattccaaggaggatatatctctgcccgttgttggacattatgggttgtaaagtgtgtttcttggtctgagaaaatgtgactcagcagcccaaattggtgcagtatattctgttccagttcttttattacactctgagcatttgcatctaccactgcgtaagcaaaggccaatccagagttagtgtctattcctgtcgaaactcataccctggggctatcagcatcagtctgacttgctagctgtgttcaaggccttccccgtgaggaatctgccacatagccatcttaagtctctgtctcttttgttggaaaacagaacagttattggcattttgtgcttcagagggtacaagaggaatatgtccaggttcaacttcagaggttacaagaggaatatgtctaggttcaactcatttctttttgctgagtccccagatgcccactaatttcgtggacccagggggccgcctcaagggagcacacagagatatccacttgttgattctcatcaccttccaaacctggaaggggattcttctgatggatatcaacatgtcctacattaatgcacctctcagatttccatagtgattttccatagagtcatacaccatacaaacatcctgttaatggaccagttttccatttcccttctgtaagactacatggccaggtcattggccactgccaatgagtcagtcaaaacccaaacacaggggcttttaccactgttcaattcttccttcactgctaggaaaacagcatgcagttctgcctgctaagatgatttgtttttaccttctttgatctgatggtagccttccaaacagaatattgtttgttcaccttggaactgccatgcataaattaagcagctctttgtcaatcagttgagaactgtttatagggcactgtcccaatgacaatagaatccagcagctcctcatgcatttccaaagtcagtcctaggggaaatgagactctgctcatgagtacctcctccttgcattcacaggtagcatgatcatgtatgtataaaccacttccattttattatggagtttttctgggcactgccctcccaattagagtgtttttccaatatcacccaaggcttcatcatgggtatttcagctttcaggattattttcctccaccatccttcccatccttccaagtctccaatgtctattttatccctttctgtgtccatgtatacacattatttagctcccacttatacttgagatgtggcatttgactttctgcttctgagttatttcacttaagataatggcctccagttctatccatgcttctgcaaaagacatggtttcattccttttatggctgagtagtatctcattatatatatataatgtatatatatgtattgtatatgtgtatatatgtattatatatgtgtatatacatatatgtgtatatgtattatatataatatataatgatatatatgtatatataatgatatatatatataaaaccttcacttattcttcttttgatgcttttcctatctttatgtagatctgagtttctgacctatatcattttccttctctctaaataacttcttttaacatttcttacaaggaaatctactggcaacaaattccttcaactttctttgtctgagaggttttctttcttttaatttaattgttaattttttctgggtacatagtagatgtatatatttatgggctacatgtgatattttgatacaagcatacaatgtgtaataatcacttcagggtacatggggtatccatcacctcaaacatttattgattatacacttttagttgtttttaaatgtataattaaattactttttactatagtcacctagttgtgctagaaaatactagctcttatacattcttcctaactatttctttgtacccattaaccatcctcacttccttctaccccccgcaacccttcccagcctctggtaaccatcgttctactctctatctccatgagttaaattgttttaatttttggctcccacaaataagtgagaacatgtgaagtttgtctttctgtgcctggcttatttcatttaacataatgacctccagttccatcccagttgttgaaaatgacaggatctcaattattttctatggccgaatagtcctccattgtgtatatgtaccacatttcctttatccattcatctgttgacggacacttgggttgcttctgaatcttggctattgtgaatagtgctgcaacaaacatgggagtgcacatatctctttgatgtactgactatctcttccttctttccttctgtcctgtcttccttttagtgaaggtgatttttctctggtggtatgatttaacttctttgtttttttgtgtgtgtatctgttttatgttttttatttgaggttatcatgaggcttgcaaataatatcttttaacccattattttaatctgatgacttaacactgcttgcataaacaaattaactactaacaagcaaaagaaaaataatacaaattctacagcttaacttcttcccctcactttttaactttttgttgtttctatttatatcttatactgtctatgtcttgaaaagttgttatatttattatttttggttggttcatcttttacttttagtttttctatttaagggtagtttatacactgtacttacagtgctataatattgtgtttttttctgtgtatttatatattactagtgagttttgtaccttcagatgcttttttcttgctcattaacatcctttcatttctgattaaagtactccctttaacatttcttttaggacaggtctggtgttgacgaaatccctcagcttttgtttgtctgggaaagcctttatttctcctacatgtttaaaggatatttttgccagataatactattctagggtaaaagttttttccttcaacactttgaatacgtcatgccattgtctcccagttgtaaggtttccatggaaaagtttgctgccaagcatattgcaacgccattgtatgttgtttcttttctgttgcttttaggattctttctttatcctgaacctttgagagtttgataattaaatgtcttgaggtagtcttctttgggttaaatctacttggtgttctgtaactttcttgtacttggatattgatatctttctctagatttctctagttttctattattatccctttaagaaactttctacccatgtcactttctctgcctcttcttcaaggccattaactcttacatttgctcttttaaaactgtcttctagatcttgtagctgtgcatcatttttaaattcttttttcttttttcctctcaccgtgtgttttcaaatagtgtgtctttgagctaactagttatttcttctgcctgatcagttctactatttagaaactctgatatattcttcaattgcatttttcaactccagaatttctgcttgattcttaattattttaatttctttgttaaatttatgtgatagagttctgaatttcttctctgttattttgaatttgaatttcctcaaaacagctattttgaattctctttctgaatggtcacatacctctgtttctccagaactggtccctggtgtcttatttagttcatttggtgacatcatgttttcctgggtggtcttgatgcttctgggtgttcatcagtatctgggcactgaataattagtattattgtagtctttgcattctgggcttatttgtacctgtccttcttgggagggctttcgtgatatttaaaagtacttgggtgctgtgatctaagctgtatctgcattaggggacaccacaagcccagtaatgctatagttcttggagactcatagaggtactaccttggtggtcttgaataaggtccggaagaattctctagattaccaagcagaaactcttgttctcttcccttactttcccccaaacaaacggagtctctctctctctctcgctctttctctgtctctctctctcactctctcctgaactgtctggcattgggggtatgttgatacaagcacccctatggccattaccactagaactgcactgggtcagacttgaagccaacacagccctggttctcacccaaggcccactgtaagcactacctgactaccacctgtgttgttggttcaaggccttagggctctgcaatcagcaagtggtgaaaccagctagtcctgtgtcctcttcagggcagcaagttcccccaggccccaggtgagtccagagaagctgtccaggagccagggacggcagtcaaaaaccttagaagtgtagctcagatgttctcttctactgtggctgagctggctgtcaaaccatgagacacagtccttcccactcttccctcccacttccacaggcccatggggagtactgccagcctaccgctgatgttcacttaaagcctgaggacttttcagtcaccttgtggtaaatgctgccaggccttatttcacctttcagggcagtgggctcccctctggcccaaggcaggtccagaaataccactcaagagccaaggcctagaattggggatcctgagatcccgcttgatgctctaccctactgtggctgagctggtacctaaggcataagacaaagtcctctttacttttccctctgcttttctcaagcagaaggagtctctcaccatagctgccatagctgggaatgtggtggatctcacctgaagccagcacatctcagagtttcacccaaggcctacagtgtactacttgggatcactgctgattattcatggcccaagggctcttcagtcaacaggtgatggatccttccgggactgggtccttcccttcaaggcaatgggttctcttctggcccagggtgtgcatcaaaatgtcatccaggagctagagcctggaatgggggtctcatgcctctgcccagtgccctatcctactgtggatgatctgatatccaagatgcaagacaaagtcttccctctcttccctctcttctcttcaagcggaaggaagaggtctcctttggagccacaagctatgctacccagggttggggaggggtggaacaagcacccccttagctaccccagctggtggctcagtaagttgcgtgcccccaagtccattggttctgagcccagctcagcactaagacttgcagtccttgtggcctagactgtctttcaagtttatttagagccccagagcactttagcccatgatgacgaggcttgctggaattcagattccaacgactgggatgggagattccccacttgctacagctggtccaaatgttccctctgttagcgggagttggctgtgtttagcccagttttccttcctgctgtgacagggcagcactgagttcagtgcaaagtctgataatctctgcactctctctctctttctcaagtgcgcagatttctctgcaccaggcagctgctgggggatagggaaggggtggcattggtgattaaagactgtctttcctaccctcttcagttcctctttcaacaatatgaagttggaaccagatactgtgagtgctcacctgatttttggttcttatgagagtcattttttgtatgtagacagtggttaaatttggtgttcctacggtgggggaggatgatgggtgggccttctgttccataatcttgctccacccctgtgtctgagagtctttattttccttcacttttgaagtataatttcacaaggtacaaaattctgggttagtgggattttctctcaacatttaaataatttgcttcagtctcttcttttttgtgtggtttctgagcagaagtagaatgtaattcttatctttgttcctctttaggtaaggtattttttcctcaggctttttttcagaattttgtctgtatattttatttcctgtagtttgaaaataaaatgcctagatgtctttttttgtcatttgtcctgtttgatgttctgagcttcctgaatctgtgatttgatatatatgacattaatttggggaacttctcagtcatattatttgaagtattttttctgttgcattacctattcttctccttctggtattcccattacacatatgttacaccttttgtagttgtctcacagtccttggatattctgttctatttttttcagtctttgttctctttgcttttcagtttgggaggtttctgtttatataccctcaagggcagagattttttttttcctcagctttgttcaatctactaataagcccatcaaaggttttctcatttctgttacagtgtttttgatcactagcattcctttttggttcttaggatttccatctctctgattactttgctgatctgcccttgcatgctgtccactttatccattagagcccttagaataattatcataatcgtgatcaattatcatagttgtcttaaattcccagtctgataattccaacgttcctgctatgtctagttctagtgcttgctctgtgtcttcaaattgtattttctgccttttagtatgccttctaattttttcttaaaagctgggcatgatgtaccaggtaaaaggaactattagtttcctaataaataggcctttagtaatgtggtggtgaattgtggggagaggggaagcattattattattattattattattgagatggtgtctcgttctgtcacccaggctggaatgcagtggcatgatcatggctcactatagccttgacccccacccaggcccaagtgatcctcacacctcagtctccagagtagctggaactgcaggcatgtgcaaccacagctggctgatttttaaatttctgtagaaatgtggtctcactgtgttgcccagactagtctcaaactcctggattcaagcaatcctcccgccttggcatcaaaaatgctgggattacaggcatgagccactgcacctggctgggaagcattgtttagtcctatgattggtcttttagcaagcctatacctctggactgtgaacttcacaagtgcttctcaggtttttttctcccccattaagtgggacaggatggctagagtggactgaatttgagtatttcccttctccgagatcagttaggctctgatataccccagaaggtcaggctgtggttaagcagtttctcttgagggcaagacttgttaagaacagggtgctctggcatgttttaaagtgttttgtttcctctgccccctgcaagatgcataaagagattttgctccaatattcactgagtagctaaccaagctcctggaggcaaaactcacaaaactgtggaggcctccttatgactgggtcctcctgagtcttttaattcagacttgtccacactgagcctccagtggtttgtcagttacgcttcaggttttcctactccagcattggttcccatggtagtttccacttttgaatctctgctctagtaagctatgactccctatcttcgcccttctctccaatttttgtggcagtggttttccctttttcctctcgtctcttataggtccaagaagagttactaatttttcagtgtgttcagcgttttacttgttaggagaaactggcaacttccaagctccttacatgcataactagaaaccggaagttctcttttaaattttatatgcttaaagaagcttgacagaggggtcaggaaacctgggtctactcttttcttcatctgtaaaatgatgtgtctgtacaagataagttattttttaagctgcattccttagaaccgtggaaattttgtggcactgcatcagggacttccaggaaggtgaaactccaagcctccacccactcctcgttcaaccacagcagctcaacttttatcttttatcttttcttgtatattagacttttatacaactttatttgaaataagggttctagttccccccttcaaaaaagcttataaatcacagagatcaccagctgctctcaagtgttatgaccctacaatataaaaccttgtcattgaaatcctttgctgagagtttatgaagaagtagaagagagaaaaaatatgagggcactgggaatgagtaactgtatcctacagtggggaagaagattgttgaaatggtagattggagtcctgagcaaaaaacttcacaattttgcattttcttagttcaattctcaggcacaaatagtgtccctttttagttatgttttatagtaaagatttggagcagttggaaaatatccttttctttatttttaggaagaaagaaatggatcgacttttgacttgcctgaatagaggtaaatatctccctggttatattcagtccttcatcttgcctctattctctgttgaattctccaagtacactaagcacagcaactttaaccttatgtttgagttaagcttcatgctccttattaatctttgccacaggaatctattttggtttcttcattcacaagcagagaaaagtgtgtcatcattagcattcatctccaaatgtgatttcagttctgttttaattcctatttgttttaaggacatttccttccctccctccctcccgtccctccctccctccctccctctcttccttccttccttccttctttctctccttcccccttccctccctcctttcctttccttctctcccttcctcccttctctccctccctgtccctctacctttcttttctagtagccacttgatcctaacctaagaattgaacaggtgaaaaaagatcaagacaaataaaaatactctgaaccctgctgtttttttcataccctctgaatcaaattcaggttgcatattctcttattttgaagctgtccacccaagtctgtgccatctcccttatctactaataatttttccctgtccactttattcaagctaatctcctagttgtatcacattttttttctaactacatgcttttttacatggcatcccttttaacagatctcccatttttactgtccatgtacctctttccttatgtccaaaacacaccaaaaagttcatatcttagaaattctatcctgctcagtgcagtagttcaattttatacctcaaatacctgtcagcagggtgttaaacatagcaaagtggtttagaaaccagaccacttcttttcaaaagagaaaaactttgctggttggcattcttatttctcagaaagagaatgccttctgatagtgatagcacattctggttctgtcctgagcttgctggctcagtaaatattatgccagcatattgatacccttctaattttcaatctccagttcagtcttttaaacgattgtttctattttttatttcctcacatgtaaatcatatctttctacctcaggtggtgaatgattgcactaattaaaattataaatctctccaaagacatgtttgttccccagagtttgagttaacaacttcttggaacttggtaatgctttctgtcattttaattacttttggtatgcacccctacacacatacacaaaaaagaactttctaaattcaaactcctgtgagactgttcttaaagcaggattaaacaattttgctagagtataaaataagaccatcagtatcaaattttcctgtttgatgcagcctttgtgaaactttctcagccttttggtgaagaagccttaagtttggagtcaagagctaatgaagctcagtggtttcgaaaaacaggtaagaggaaattctgtggctctgggaaacattgtggggtggtggaattagacagatgtgatttcaaattctggatctttcatttgtagctgtgggtacagagataacttgcttaatctgttttattacttataaaatggaaatagttatatatacttcatgcagttattaagggttttaaatgaaacagcatatatacttttttcatagtagatactcaatggacattagttgtgtcccttttctatagaaatgggtctaagatgaaactaatgaactgtaactacaggtcctcaaggttgtgctcctaaacttggtttagaatacttaatttttttttttttttttttgagatggagtctcgctctgtcgcccaggctggagtgcagtggcttgatctcagctcactgccagctccgcctcccgggttcacaccattctcctgcctcagcctccctagtagctgggactacaggcacccgccaccacgcccggctaattttttgtatttttagtagagatggggtttcaccgtgttagccaggatggtctcgatctcctgacctcgtgatccacctgcctcggcctcccaaagtgctaggattacaggcgtaagccaccgtgcctggcctagaatacttaatttatttctgagtgtgattgaccaaaaatgaactatatacaacaatatggatgaatctcacaaacataatgttgagcaaaagaagctagatattgaagaatacatattgtgttgttcattttatttataattttttaaatgggcaaaactaatatatggtgttataagtcaggataatggttaccctggaaaaggagttggacttgaaagttgtaggagcttcagggtttctggtaatgttcaagatctttcttaatgtgggtgccagacgcatggatatgtccactttgtgaaaattcatcaagctgtacaattatgagttgtgtaatatactttataatggctctatttcaataaaaatgattttaaaacttgcggaggcagttactacagtgataagtaagcatgagcaattaagcagcagtgccacaaagtggactgattctacatgaacctctccctgtgttatgaggtttaatagggctttaatcctgggagaaagggaatgaatactgcaatctgacttctaagaaactgatgcaaataatgaaaaataacaaacatttaaaatatagacaagtttggtgactttaatcttttgaaggtttgaaaaggaatgtttttactttactgcattttaatttggattttccaaggggaagatgatgctgactgatgcctgatgagggcttctactgctctttggaagatatgaatctctccagtaatttttctcaactcttgattacagtgtaccttgttcttaggtgaattttaacttactttcaccactgcgagttagtgagctctatccatgttgatcttcatttttagatagattagtgtcaattaagaattttttttttttttgagacggagttttgctgccagactggagtgcagtggtggcatcatagctcactgtaacctcaaattcctggtgtcagtcttctgggactatagttgtgtgccaccacacctggctagttttgttttgttttggtttgttttttaatttttttgtatagacggagtctctctctgttgcccaggctggtcctgaactcctggcctccagcaatcctcctgccttggtctcccaaagttctgggattataggaatgagccaccaagcctggcctcagctaagaattcttattgcatgtccccaattttaaaaaattcagcagtacctcccttggtcattggtctagtgttgaagattggaattgacgagggtctctaaatttacctggaaaatttttctttaaaacctaaagttaattgtttaaaccttgagaaaccccttactagtatgttaatatcaaaggtgtaagtatcagaaattgtaatggtacagactaaatggtagattttcataatttcatattattatgttatttcatgttaatttccagcttggaacttggctgtgcaatgtgacaaagatccagtgatgatgagagagttttttatactttcttataaggtaagtttcttttaataagtatctcatgtatggaccacaacaaggctataaccactatggctatagtaaagggctaaatatagactaggattgtctcttgatctaggaacttttaatatatatgtaagcaggaatgacctaagaagaatttgttccttttagggtataacataagaatgtggggcatatctttctataccaaaatatcagaaacattcatcagggagcctaaagttctaccatttaagacttatttctttgcctttgaagggatctcagcctcccaaagtcctatattaaaatgtaaatatctttaggaggggaatactctaagtagttgttaattaccaacacattatgaagagttatgggaataagtctacaagaacatagaataagtatctggggatagcaggggctgaaaaaagagataagaagcttaggcctcctttataactttcctatagcaggtcctgagtgtagcgatttgtgagtttgttatttaattataagcatttttaaatagtcgttggcctccaaggtagaggttaaatgccagaaagaggaccaagtattgacaggaagataaaaggagaaggactaaagaatatccttcatacacattcaggaatacacagtatgatatgttgagatcaattaaatgttaagagttttagagctagaaagaactataaagactatctagcacaactccttcatctcacataagagtaatcagagacctaaagagattggttgtcttaaaatgctattaatttaataacaatgatgattatgatcactgaatgtttggggagattaagaaatagtctttgcaagtttaggcataactgccattttaattaagtgaaataaattggttttagttttggcatttgtgatgggacttgtaggattggcgtgtaagaatccaaatggcctagagttttattgtagtagctgggagtttttcctaaaactatacaatgttaatgatgaggtcatgactaatgcctgtcaagatttgacaatgcctctttcaaccatgacaatatatgaactaattttggctctattcaatacaaaggtggaaatcttatttgccaggggaaaaatcacttacaaattacaacataaaccaagaagtaaatcactagatagaaatacaagggcgaatgatactacttgtcactggaaaagataggaatactgtgaagaaatgaagctttttatctctaggaaggtactaaaaacaatggaaagtaatataaaattaaaagcataaatcagtattatagtttatatcatttctatggtgacatgtgcttttccagctgaattttctcattcaaacaggaagttgctgattttcattctgattgtttgtgttcacctggcagaattctcactattcattgatgttctggttacttcttatcagatgtcccagttttgtccttctgatcaagtaattctgattgcacggaaaacatgtttacttatggcagttgcagttgatctagagcaagggagaaaagcttcaacagcttttgaacaggtaatgtgcaaccttcaaagaaaagacaagagttcagtgtgctatttgatatgtttgccttccctgatgcagttctttttgattctctttagagaatccttttctccactccagcatcgtcttgatttcaaaagtttgtaatggctaattccttcctaagcaaaggttacttttggtgtggcctcttcttttaagaagattagatatctcttcttttaaaattccccttcctatggaccactctttccaaaaatgtttttaaatatcttttatcttcattgtctgcctgtgattatatacgcgtttggactccacttttgtttcttaccacatcttctaaggaagaactcatctgtttccatagctttgatagccatctgaaattattacttatctggtttttcttctctcaattgcatttgctttctttttcccacatccttaaatatctcattaacttaatttctacaagacagaattccttacctttgcctgaattcccctatcagattcttaaatgttaccccttttaggagctatcaatatcaccgtctcccatacaccagattattggtttgcttttagctgtttacctttcttctttcaatctaagaaaattgtctccaaatcagaccaatagcatttttgtatgatttttaagatctagatctctctgcttggtttctcgtacctggacaaagaaaacttcctaatctcccatacttgtcaccttccctcctctccaagtaatataaaccctttgctgtttattctcttcctcctgttaatctcttatttcatattgttctttggatctgaaacaaactctcaccagagctatgccaactatttcgcttcttttcccttccattgttgagttcaactcaaaaaacatttgagcaccagacacttttctaggtactggggatacagagataaagaagccaaagtccttgcctctgaggagtaaagggggccctcttttaagagtctttttattttaaaagaagatgagaaaagactctaccttccccagagcaaaataaacaaacaaaaattctacttaacaggcaaaggtaaatgtaatttaattctcaatagggacttttgctttactaaaaaataataataacatcttatttttatatagtgcttttaaatttctaaaagtttttcctttttggttggtaatcctgagtttgtttaattttttatcttagtgaatagagatcaaattgatgtgggggaaatttcacaaactcttaagtacaatcattattttgtttgtttctaactaccgttcttttttattctgtgttctttctcatgtacacctctgtgttttctcagaactctctaaactagtaacctttctataatcttctttgcttttgaaaggatgtctatatacataattgaagatgcacttctgccttttatcatctaagtgtggtccctatgaatcggacagtggtactctgtctctctaaagaatacttgttcatgtccttcgcccactttttgatggggttgtttgtttttttcttgtaaatttgttggagttccttgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccactgcttttggtgttttagacatgaagtccttgcccatgcctatgtcctgaatggtaatgcctaggtttcctttagggtttttatggttttaggtcgaatgtttaagtctttaatccatcttgaattgatttttgtataaggtgtaaggaagggatccagtttcagctttctacatatggctagccagttttcccagcaccgtttattaaatagggaatcctttccccattgcttgtttttctcaggtttgtcaaagatcagagagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcctttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttctctcatgatttggctctctgtttgtctgttattggtgtataagaatgcttctgatttttgtacattgattttgtatcctgagactttgctgaagttgcttatcagcttaaggagattttgggctgagacaatggggttttctagatatacaatcatgtcatctgcaaacagggacaatttgacttcctcttttcctaattggataccctttatttccttctcctgcctaattgccgtggccagaacttccaacactatgttgaataggagtggtgagagagggcatccctgtcttgtgccagttttcaaagggaatgcttccagtgtttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattatattgaggatttttgcatcaatgttcatcaaggatattggtctaaaattctcttttttggttgtgtctctgcccggctttggtatcagaatgatgctggcctccagccgccccatccgggagggaggtgggggggtcagccccccgcccggccagccgccctatccaggaggtgaggggcgcttctgcccggccgcccctactgggaagtgaggagcccctctgcccggccaggaccccatctgggaggtgtgcccagcggctcattggggatgggccatgatgacaatggcggttttgtggaatagaaaggcgggaagggtggggaaaaaattgagaaatcggatggttgccgggtctgtgtggatagaagtggacatgggagacttttcattttgttctgtactaagagaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcagaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaaagaatgatgctggcctcataaaatgagttagggaggattccctctttttctattgattggaatagtttcagaaggtatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacctagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcaaagctgagttcaattcctgggtatccttattgacattctgtctcattgatctgtctaatgttgatggtgggaagttaaagtctcccattattaatgtgtgggagtctaagtctctttgtaggtcactcaggacttgctttatgaatctgggtgctcctgtattgggtgcatatatatccaatacgaagacatttatgcagccaaaaaacacacgaaaaaatgttcatcatcactggccatcagagaaatgcaaatcaaaaccacaatgacataccatctcacaccagttagaatggcaatcgttaaaaagtcaggaaacaacaggtgctggagaggatgtggagaaataggaacacttttacactgttggttggactgtaaactagttcaaccattgtggaagtcagtgtggcaattcctcagggatctagaactagaaataccatttgacccagcaatcccattactgggtatatacccaaaggactataaatcatgctgctataaatacacatgcacacgtatgtttattgaggcattattcacaatagcaaaggctaggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacagaaaaccaaacaccgcatattctcactcataggtgggtattgaacaatgagatcacatggacacaggaaggggaacatcacactctggggactgttgtggggtggggggagggggagggatagcattgagaggtatacctaatgctagatgacgagttagtgggtgcagcgcaccagcatggcacatgtatacatatgtaactaacctgcacaatgtgcacatgtaccctaaaacttaaagtataataataaaaaaaaaagaatacttgttgatttctgttgtatacatctgctccctgttctctaaaccctcataagtgggaatatttccaaataagtagctgatgaaggaatatagatggactgcatagttttatcaacattgcctctacccttctgagtatgagttaggagaaattgagggataggtaaaaaacatattctaattgtaatttgtcaaggaaccacaccttcttcctagagcaggagtgggtaaactactgccagctggccaaatcaggcccctggggggttgtagttgaaaataaagaaaataaagaaaaatatttctttattttatttatttatttctttattttctttatttcttttcttttatttgtatatggctaggaaagcctaaaatatttactgtctggccttttgtacaaaaagtgtcctgatccctatccttgattatattttaacagacttattgaggcataattcacataccttataattcacccacttaggtatacaatttattggtttttagaatattcttagaattgtgcaactgttgatacaatctaattttagaacatttttatcaccctaaaaagaaaccccttacccacttagcaatcacttctcattgcctgccaccagcactaagcaaccatgtactttctgtctatataggcttgcctattccagatatttcgtataaatgtcatcatcatcatattttacacgaaagtcaaatgttttttgatgtgtagtcttttctgactggctccttgtataaatgcctgaataacattttcaaggttctttgtgttgtagcatgtatcagtgtttcatttctttttatggctgaattatattccattgtataaatatatcacatttttaaaatccattcatccattgatggacatttgggttgtttccaattttcagctcttgtgaataatgccgtgatgaacaatttatgtacaaatttttgcatggaaatctgttttcatttctttcaatatgaaatatacctaggattggtattgctgggtcatacagtaactctatgtttcatcatttgaggaatgctggagtttttcaaagcacctgcaccattttacattccaaccaggactgaatgaggattccaatttctccacctccttgccaccacttgttattatatctttttaattatagccgtcctagtgaatataaattgatacctcattgtggttttgatgtgcatttccattatgactaatgatgttgagaatcttttcgtgtgtttattggccatttgtatatcttctttggaaaatatctattgaaatctttttgcatttatctatttatttagagatggagtcttgttctgtcacccaagctggagtgcagtggcacgatctcagctcactgcaatctctgcctcccaggttcaagtgattctcctgcctcagcctcccaagtagctgggactacagccacacaccactgtgcccagctaatttttgtatttttgtagagacagggttttgccatgttggccaggttggtctcaaactccttatctcaactgatccccccacctcggccttccaaagtgcttcatgctcattttaaattagcctatttgtctttttaccactgagttgtaataattctttatatattctttatactatactcttatcaaatacatgatttgcaattattttctcctgttctgtggtttgtcttttccatttcttgctagtgccctttgaaatacatttttaattttgatgatatccattttatttattttgttatcatatctaagaccattttctaatccaaagtcatgaaggtttacctcaatgttttcttgtaaggttttttatattttcagctcttacatgtagatctgtgatccattttgagttaatttttgtgtatggtgtgagataggggtccaactttattgttttgcatttgaatatccatttgtcctagtactatttgttgaagactgttttttccccttgaattatcttcgtgccattgttgaaaatcacttgaccacaaatgagaaggtttattctcaattctattccattgacatctatgtctatcctcagggcaataccacattgccttgataattatagctttatgtagtacattttgaaatagggaggtgttagtcccccctcattgttcttctttttaaagattgttctggctattctaggtccctggaatttccattaggaccaacttgttgatttctgcaaaaaagccagctgtgattttgataggggttgcattgaaactgtaaatcagtttagggagaatattaaagcctctgattcatgaacatggaatatctttccatttatttaggtttttcacttctttcaacaatgttttgtggttttcagattataaatttttcactactttttgtagtctcttcagattttgtatttcctcttgagtcagttttagtagtttatctttctagaaatttatccattacatctaagttatagaatttgttggtttacagttgttcatagtattcccttatagtcctctttatttttgtaaggtcagtagtgatacctcctcttttactcctaattttagttatttgtgtcttctctctttttgttcttggtcagtatagacaaaagtatatcaatttgttgttcttttcgagaacaacttttggtttcattttttctattgcatttctagtctctatttcattaattcccactcaaatcttccttctgcttgcttacagttcaatttgctttgtttttacagcttcttaaggtaaaacttggagttactgatttgagatatttcttttttttaatatcaacttttgcagctataaatttcccttcaagaactgcattaaactgcatcccatacattttggtatgttgtatttttttcattcatctcaaaatattttctaatcttaattatgttttcctgtttgacccatttattatttaggaatctgttgtttaattttcacatatttgtgaatttcccaaattgttttctcttgctgattttaaattttattccactgtggtcagagtacatactttgtgacttcaattattttaaatttatttgaagtttgtgttatggcctagcatgtcagctatcctagagaaagtgccatgcatatgtgcttgagaagaatgtacattctacttgggttagtgaaatgttttatggctattaggtctagtaggttgatagtgttgttcaagtgttctatatccttgatggttttctgcctacttattctattcattacttaaagtgggctattgaagtctccaactaataaaagttgaagtatctatttctttcttcaattctacccagttttgctttatatttttggggctctgttgttaggtcatatatgtttataattgctatacatttccaatggattggcccttttaacattataaaattttcctctttgttcctagtaattttttttttgttttagagtctatttttgtcttattttagtagtgtcaccctaacattcttatggtcaatgtttccataacataactttttccatcctttcacaatcaacctatttatttgtctctgaacctaatatgtgtctcttgtagacagaatgtagttgggtcatctttgtttcaatatgataatctttgtcttttattgggttgtttaatgcactcacatttaatgttactatttttatggttgaatttacttatgccactttactttttggtttctatatatctcatgtattttttattcctgattttctcctttactcttttcttttgcattaagtgaatgttttctaatataacatttttgttcttttaatgatttttacacaatatttgagttattttcttagtggtcactctggggcttacaatatagatcttaatttatcagaatctacatcagattataaacccaatttcagtgagatatagaaatgctattcctattaactctgttctctcctctttttttatgctattttgttatacacattacatctatatatgctccaaacacaacaatacatcttatagtatcactttatagaattttaagtattttaaagaaactcagagaagaagccgggtgtggtagctcacacctgtaaacctagcactttgggaggccgaggtgggcagatcacttgaggtcaggagttcaaaatcagcctggccaacatggtgaaaccccatctctactaaaaatacacacaaaattagctgggcatggtggcaggtgcctataatcccagctactcaggaggctaaggcaggagaatcacttgaatccggcaggcagaggttgcagtgagccaagatcgcgccattgcactccagcccgggcaacaagagcgaaactctgtctcaaaaataaagaaacttagagaagaaagtatatattatggtttcttatattaagcatcttacttaccttttatgcttttcctcattttttcctgtagattagagttactatatggtctctggattagtctgttctctcacacactatgaagaaatacctgagactgggtaattcataaaggaaagcggtttaattgactcatagttccacatggatggggaggcctcaggaaacttagaatcatgatggaaggcacctcttcacagggtagcaggaaagagaatgaaagccgagtgaagtgggaagccacttacagaaccatcagatcttgtgagaatttactatcacgagaatagcatgggggaaactgcccccatgattcaattacctcccactgggtccctcgcaccacacatggggattatgggaactacaattcaaggtgagatttgtgtggggacacagccaaaccatatcagtctcattttcttactccaaaacaactttcttcccacctgcctcttgtgctgttattgtcaaatatatttcatttctatatatcagaggcccaacaatacaaatatatattcacatatatgtgtatatatattgtttttttaaaacaagagaagaagaaatatacatttatattaatactatcttttataattatataattaatgctaccagtgctctttgttttttcatctggattcaaattactgcctggcattacttgcttttcagcctgaaagattgtctcttagcaacgaattctctcagctcttatttatccagggacatctttatttcaccttctctgaataatagttttgctaggtattagattattagtagacttttatttttctttgatcactttggatatgttgtcccactgccttctggcctttattgtttttaatgagaaatcagctattaatcttaatcacccgtacatgtggcgagtcatgtttctctttgctagtttcaaatttttctttgtcttttaccattttgtaatgtatcttggttggatatctttgtgtttcttgatcccacctagagttttttgggcttcttgagtgtgtagattattgtttttcatcaaaattagggaattttcagccatttgtttaaaatattttttctctttttcgctccttttcttttggtaatcccattatgggtatattggtgtgcctaatggtgtcccatgttttactgaggcttggtttattttttttctttttcattctgctctcatattttgtaatctctgctaatctatcttcatgtttgctgattgcttcctctgctaagtcaaacctaatgttgataccctctagtgagttttaaaatttcatttattgtagttttcaactccagaatttccatctgatttttataatttttatccttttattgagattcatttttgatgaacatttttatcataccttctttctttaagtgtggtttcatttagtatttgaatatatttaaaatagctgctttgaattctgtgtctattaagtttaacatctgggctttttcaaaatcagttcctgttacctgcttttttcctatgtagaagtcacactttcctgtctctttgcatatcttgtaattttctgttgaaaactggacgttttagataatatgttgtagtatctttgggtactgatctccccatggggtttgtggatgttaatgtttgcttctttatttgtttagtgaattagctatagggaaatagtgaagtctattttccccatggtacatagactctgatgtcactctttggaaggcacagtctttgcctgtgcaaagactgcttatacctccctctggtaaaggatgacagtgattttaggagagttctttattactcttttcctgatctgacctcttaagcttctagatgaccttcttctattggtagcacatccagctgttagtcttgactaattgctaggtgattactgtgtgtgtgcgtgtgcgtgtgtgtgtgtgtgtgtgtgtgtgtgtgtgtgtgtgtgttaaaatgctcttgtgcataaattgccccacagcctgttccaattaaaagaagacccctttgaaggaatagaaatcttcttagctgtctcttcacatacttctctctataaacttctagttggtctattattttcttcttaatatcattgagctatcaatctcctcttaattgctcactaccaaaatctccatgattttttacagtgtccttagacttgaacttccccacgctctgttccaattaaagtcatttcctttagggagtgctatagatctgcctctcctactgggcagaaactgaaccactgttttggagctaggggcagggacagtggcccacttctgtcagagtgacaatccaattgtatgagtggaagactggacaagagttgtagtccctgatagtcttggcttgctgctcccagcatggacactctatcctataagcagctgagatgagagctgagatgagagagctgagatgagatgagattgagacccaggatcctgagcttgcaatgcctgggatagagcttttgccttacaaatagaggctgggtagagaaagagagttctaggcctctgagctatgcttgtttataatagagcttctacaatagagatctggggggatgagaagtgccagcattctggcccttcagagaatccctagcccagaaactggaggtagagagagtcctatcttcttggccacacccacctaaagtagtgcttacatcacactgagctggcggatggtgagtgaatcatagcttaaatgtcacaggctcttactgttcttactaagacttagtagatttcctggaataaatgtttcttcattttctgtataccctcagggcaatttcctgagcctttacatgattatgttttctaattttcactagttatgatgattgttttgctgaggagaggatccatggagctcctcacacaaccattctagaagtgtttctcttctgttctagattgttaaagaaattgataatgctcaagattttctatttaatcctcatttttctgaaacagtaaggaaatgtgcaaatagaggctaatatttctatataaactccaaaatgttcagtttaaactatcatttttctattaatttatttttacctgtttttaatgaaaatgatatgagattatattaatttgcttaaagttcttttttgttgggactaattaacttgttgcactgttgccaaacagaccatgttcctgagtcgtgcacttgaggagatccagacatgcaatgacatccataatttcctgaaacaaacaggtacagtaggaactggaagtttggtaacacagtttgaaaggagcttagaatcgaataaacaagtcttttgtcaccagaaatttgtgccactgcagtacttgataaccagtcaaatgttttttttttctgttgttttgtttgttttttcgagtcagggtctcactgtgtcacccaggctggagcgcggtgatgtgatcttggctcactgcaacctctgccttctgggttcaagcaattttcccacctcagcctcctgagtagctgggaatacaggcatgcactacaacgcctggctaaacttttctattttttggtagatatagggtttcaccatgttggccaggctggtctcgaactcctgacctcaagtgatttgcccacctcggcctcccaaagtactgggattacaggtgtgagccaccactcccagcccagatgattctttaagagctgattttttccccactctatatcagtattgactctgtaacacactacttagattaagaatattttttactttgctttatatgaaagtatagcattaaatattttattattgtttaacataatattatcaatcttagatcactagatttaatgtctaatttaatcaagctttaactttgactaaatgtaggctagtcttcacaatcaagataacagatactgctaatattttgttataaaattatctaaataggctgcatgcagtggctcacgcctgtaatcccagcactttgggaggccgaggcggacagatcacctgagattaggagtttgaggccagcctgaccaacacggagaaagcccgtctctaccaaaaatacaaagttagccaggcatggtggcacatgcctgtaatcccagctactcaggaggctgaggcatccttgaatctcttgaacccaggaggcaggggttgcagtgagccaagatcacgccattgcactccagcctgggcaacaagagcgaaactctgtctcaaaataaataaataaatacataaatacacaaataaataaataaataaaataatctaaacagtagtaagcctttggaagttatataatatcttgattctatttcctgattaaatatggtattggcttttaggtttagactgaagtttttacaatgtgtttttctgtccctgtttcagaatttgttaaaatcaatggatattcaattgaattacatgctttttcagactttatggagatagtcatatttttctcttttgaactattaatatattgagttataataatagattttataaaattaagtcatcatttcattcctggaataaaccctatttggtcatagtatgttattattttaatatattgatgaattctgttttccaacatttagaaattattggtctgtcactttgtttttgcttatgtgttatgtctttggcagtttgagtatcaaattataggaattataaggaagaacataaacatatgaaatttaatttacttctcgtagtctatgacagtcacttaaatgaataaaaacaacaaaaagtaaagatagagaaaacccaaataaaatacttattatagaagatttaatgggagtaaaactctgtagcctgaaaatatactgtgtatcctgagaacagaaaacatatcatcttttcgtgtgccttttgaagttttacaaaattgatgtcaaggaagacctgaataaattctaagacatgtaaataaaacagacaacatcgtctgatcacaatgcaaaaactagagattaacattggaatcattcttttgaaataccctaccacctggacattttttaaaaacccaaactacagtatacctaggctctaatggtaatgaaaataactcatagtagaatttaaagtgctaaagcagtgctcagagcaaattcattgcctccgtgacttttctttaagcaagtatgcagtggctcacgcctgtaatcccagtactttgggaggccgaggtgggtggatcacatgaggccaggaattcgagaccaccctgccaacatgacgaaaccccatctctactgaaaatacaaaaaccagccaaatatggtggcatgtgcccgtaatcccagctacttgggagcctgagacacgagaatcgcttgaaccccgcaggcggagtttgcagtaagcctagattgtccactgcactccagcctgggcagcacagcaagacactgtttccaaaaaaataaaaaataaaaaagtatgtcagaatgctaactgtccaccaaaaaaaatgaatttcttcttttttaggaatacaactaggctatagatagagtagatagagagatatagtgagatagagataaatgcctctctatatatacatatatatagtctaagtatatttttatacacacagctagactatatacatatatatatgtatctatatagtttatatatagacttcaggcaatcttcagagtttttttaactgtctatacattatagagatttaatggctgtagttaattaaggtgactaatatcagaatgaaggaaagtaaaattccctattggaaaacagtacattatttcatgaaagttttgtggtaaaatatatataacataaaatatgctattttgaccatttttaagtgtacagttgtacaaccattaccactatctatttttaaattttttcatcatcccaaacagaaactctgtatccattaaagaataatttccccattccccctttctccagcccctggtaacctctcatatgcttactgcctctatgaatttgcctattctagatatttctttctttttttttttttttgagttggggttttggtctgttgcttaggatggagtgcagtggcacaatcatagctcactgcagccttgaaccctgcgctcaagctatcctcccaccttgacctccttaagtgctgtgattacaggtgtgaaccaccatgcccaaccctagatatttcctttaagtgaatcatacaatatttgtctttttgtaactggcttatttcacttagcataatgtattcaagattcgtccatgtcatagcatgtgtcaaaattcccttccattttaaggctgaattctattccatcatatggtgtattagtccattttcatactgctgtaaagaactgcctgagactgggtaatttataaaggaaagaggtttaattgactcacagttcagcatggctggggaggccttaggaaacttagaatcatggcagaaggcgaaggggaagcaaggcaccttcttcacaaggtgatgggaaggagaagtgccgagtgaaggggaagagtcccttataaaaccatcagatctcatgagaactcactatcacgagaagggcaagagggaaattgcccttgtgattcaatcacctccacccaatctctcccttaatacatgggaattatggggattacaattcaagaagagatttgggtggagacacaaagcctaaccatatggttccaccccggaccctcccaaatctcatgtgcctttcacatttcaaaaccaatcatgccttcccaacagtcccccaaagtcttaattcattccagcattaactcataagtccatgttcaaagtctcatctgagacaaggcaagtcccttccacctgtaagcctataacagcaaaaccaagttagttacttcctagataaaatgggggtacagatattgggtaaatacacccattccaaatgggagaaattggccaaaacaaaggggctacaggccccaagcaaatctgaaatccagcagggcatcaaatcttaaagctccaaaatgatctcctttgactccatgtctcacatacaggtcatgctgatgcaagaggtgggttcccatcgtcttgggcagctctgcccctgtggctttgcagggtacagcctccctcttggttgctttcacgggctggcattgagtgtctgtggcttttctgggtgcacagtgcaagctgtcagtggatctaccattctggggtctggaggatggtggccctcttcttacagctccaccaggcagtgccccagtggggactctgtgtgggggctccaaccccacatttcccttcctcactaccctagcagaggttctccatgaggactccacccctgcagcaaacttctccacggacacccatttgtttccatacatcctctgaaatctaggtagaagttcccaaacctcaattcttgacttctgtgcacccacaggcacaacaccacatgaaagccaccaaggcttggggcttgcaccctttgaagcaatggcctgagctgtatgttggccccttttagccatggctaggatgtggctagaagtcacagttccaagagtacacaaagcagagaagccctgggcctggcccaggaaaccatttttccctcctaggcctccagacctgtgatgggaggagctgccttgaaggtctctgacgtgccctggagacattttccctattgtctttgtgattaacattgggctcctcattacttatgcaaatatctgcagccagcttgaatttctccccagaaaatgggtttctctcttcagttgcattgtcaggctgaaaattttccaaacttttatgctctgcttcccttttaaacataagttccaatttcagatcgtctctctcaagttcatagttccagaggtctctagggcagaggcaaaatgccaccagtctctttgctaaagcatagcaagagtgacctttgctccagttcccaagaagttcctcatctccatgtgagattatgtcagcctgggcttcactgttcatatcactataagcattttggccaaaaccattcaacaagtctctaggaagttccaaactttcccagatcttcctgtcttctaaaccctccaaagtgttccaacctcttacctgtcacccagttccaaagtcacttccacatttttgggtctctttatagcagtacctcactctactggcaccaatttactgtattagtccattctcgccattttacattcccaccaggaaatgtatcttaatttctccacctccttgccaacacttgttgttttccattttttattattatagctattctagtaggttaaatagtatctcatggttttgattagtatttctctgatgactaaagatgttgagcatcttttcatgtgcttattggttatttgtatttcatctttgagggagggaaaggacttgtctattcaagttctttgcccatatttaaaattgggttgttttttggtgttgcgttttaggatttctttatatattctgtatattaaacccttatcaggtatatgatttgcaaatattttctcctgcatgttttcttttcactttcttgataatgtcctttgatgtaaaaaagtttttaactttgatgaagtccaatttatctaccttttcttttgttgcttgtgctttcagtgtcatgtcaaagaatccattgccaaatccaaagtcatgaagatttattcctataaattcttctaagagttttatggttttagcttatatgtttgggtaattgatccattttgagttcatttttatattcaatggtgtagtaggcatccaacttcattcttttgcctgtggaaatccagttgccaccatgccatttgttgaagagactattattttttgtttgtttgtttgttttgagacggagttttgcttgttgcccaggctggagtgcaatggcacaaccttggctcactacaacctcctcctccctggttcaagtgattcttctgcctcagcctcccaagtagctgggattacaggcatgcaccaccatgcctggctaattttgtatttttagtagaggtagggtttcaccatgttggtcaggctggtctcgaactcctgacctcaggtgatccacccacctcggcctcccaaagtgctgggattacaggtgtaagccaccacacccggcctgaagagactattctttgtcccatataatggtcttgacacccttgttgaaaatcagtcagccatagatgtatgggtttatttcttaactctcagttctattctattggtctatatgtctatctgtatggtagtaccacactgttttattactgtagctttctaataagctttgaaacagagaagtgttggccctccaactttgttatttttcaagattcattttgaactattggggcaccttacaattccatataaatttgagaattgactttttcatttctgtaaaaagaggctggtggaattttgatagggatcgcttagcgtgatataagttttgaaatgttgacatcttaacaatattaagtcttccaatccataaatgtaggctgtcttttcatttatttaggtcttctttaatgtctttcatcagtgtgttatagtaatcattgtacagatcttccaccttcttggctaaattcattcttttgaatactattgtaaatgaattgttttcttaatttcctctttagattgttcattgctgatgtatagaaacacaattgatctttgcatgttcatcttgtacctgcaactttgccgaatttgtagctttcttgtggtttctttgggattttctatacgtagggtcatgtcatctgtgaacagtgagagttacacttctttctttttactttggatgccttttgtttctctttgttgcctaatttatctggctaaaacttcccgtacaatgttgaatagcaaacttcctgtacaatgttgaatagcggtagtgagagagggcatccttgtcttgttcctgatcttagggctaagcttccacctttgagtataatgttaactgtggaattttttttaatgccctttatcagattgaggctattcccttccattcctagtttatcttgaaaatattttggatttcatcacatgatttttctgcatcaatgaatatgaccttttttccttttttctattgatgtggtatattacattaattgatttacttatgttgaacttgcgttcttgggataaatcacacctaatcagattgtataatcctttaatatgctgtaagatttggtttgctagtattttcatggggtttttttaattgatatccataaagaatattggtttgtaattttcttttcttgtgatgtctacatttggctttagtatcagggtaatgctggcttcatagaagaagttaggaagtattccctcctcttccattatttggaagagtttgagagaactgctgtttattcttctttaaatgtttggaagaattcaccagtgaagccatctggtcctagacttctgtttattgggaggttttaaattacttatttaatctctttacttgttataggtctgttgagattttctatttcttctaaagtcaatttagtaatttgtgtgcttttagtaatttgtcatttttttttttttttttgagacggagtctcgctctgtcgcccaggccagactgcggactgcagtggcgtaatctcggctcactgcaagttccgcttcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaggaatttgtcattttatctaagttatctaattttttgatgtacagtagttcatagtaatctctatttgtgattcaatttttggaaggtaaaatcaagagttgttagaggcaaattgggccttgattaaaataggatctggtagttctgtttttagttctttgagaaatcttcacactgttgtccatggaagctctactgatttacattcccaccagcagtgtaaagcatttccttttctctgcatccttgccaacatcgttattttttgacattttaataatggacatcctgactggtgtaagatgatatgtcattgtggttttaatttgcatttttctgatgacttttcaatccagcaatgccattactaggtatctacccaaaggaaaagaaattatatattaaaaagataccagcacccatatatttattgcagcactattcacagttgcaatgatatggagtcaacctacgtatccatcaatggaagattggacaaagaaaatgtggaatgaagatacacacaattaaatagtactcagccataaaaatagaatgaaatcaggtcatttgcagtaacgtggatgaaactggaggccattatcttaagtgaaacaactcagaaccagaacgtcaaatactgcatgttctcactcataagtgggagctaaataaagtatgcacatggacatagagtgtggaataatggacactggagactaggaagggtgagatggtgggagggggttaaaggatgagaaattacttaataggtacaatgtacattatttgggtgatggttacagtaaatacccagacttcactactacttaatatatccatgtaacaaaactgaacttctgtcctttaaatttatataaattaaaaataaaaataaataaataggatcatgagtgcccaataaacaatacttggttacctatttaaacaaagtgacaatcaaacatttaaaaataaacatagggctttggaaggccgaggtgggtggatcacctgaagtcaggagttcaagaccagcctggccaacatggtgaaaccccgtatctactaaaaatacaaaaattagctcggtgtggtggtgcacgcctgtaatcccagctactcgggaggctgaggtaggagaattgcttgaacctgggaggtggagattgcagtgagccaagattgtgccactgcactccagcctgggagacagagtgagattccatcacataaataaataaataaataaataaataaataaataaataaatgtacataggaggtaacacaattctaacataggaggtaacacaattctaaagaactttagctctttgacaagtgaggaacctttgttctttgttagtttgccactaaataatcaaaaataaagaaaaagacaacataaagctcagagaattattcttgtaaaacacagagtctgctatctaggcagattacacagaagatgaagaataacttttgcattgtggtgaaggcattaatcaataaattaaggaagcaagcccatcaaaatttagataaggttgctacaattttaacacattgcatagctttatttcagacctaggtttaaaccagggcaaaaaaatttaactttcccagtttgtccttcattatgctctttgatgttctggaacaaactgaccatctttcagagcatctgctaggtcaaaactatttttattataatactaagatgtgtagtttttcaggggcagtatgatgtgtgatattgtaatagattgaatgcagaagcagatagtagagtctaattatttctattaagttgggcattagggaactttgcaaaaatgtgaagcaatcttcttatttttaaaataaaattatttttattaaaattgacatcaacatgcaacagattcatctcaaatcaattcaatcaataaatatatttaattttttctgttttaatttataatatggtaagtattgatagttacaacatacatgcggaaaacctctttggaagtccttagtaatatttcagagtacgaagaggtcctgagaacagaaagtttgagaactactgtcttagaaacaaactacttttccctttaaaacagaagcatatacccatttgtcactattgctcataatataatctcaaccacttgttttaattttaacttttaaccaaaataatatctatttcaaagagaaaatttgaggggtgcaattgagaactatctctcacaaacattatagcagattaacagagctcacgaacacatgtagcactttcaatgtacacacccatcccttttaaagaggaaaatgaacacaaccattaacatgacccaaagatattgcctctttatagcatataaaaataagaagcaacagtatataggaccaggcgcggtggcttatgcctgtaatcccaacactttgggaggccgaggtgggtggatcacgaggtcaggggatcaagactagcctgaccaacatggtgaaaccccatctctactaaaaatacaaaaaattagccgggtgtggtggtacatgcctatagtcccagctacttgggaggctgtgctaggagaattacttgaacccagcaggcggaggttgcagtgagccgagatcacgccactgcactccagcctgggtgacagagcgagactccatcttaaaaaaaaaaaaaaaaaaaaaagcaacagtatataaacttaaaactgcttagtgaggccaaggtagggagattgcttgagctcaggagttcaagaccagcctgggcaacataggaagaccctgtctctataaataattttttaaagaattaaccaggaatagtggcacatgcttatactcccagctactcgggaggctgtggcaggaggattgcctgagcctggaaggctgtggctgcagtgagccatgattgtgccaccgcactccagcctgggtgacagagtgagaccctgtctcaaaaaaacaaaacaaaacaaaaacaaaaacaaaaaactgtgcttagtaatcaataagcagtctatattaattaaaatttatgtaggtatccaatgattatccattaatgaactcaatttaatatcaaaccagtgtttaagttaattagattatcttaaatctaacataccacagaatgtaattactgctgaaataaaagtttgtcagaacagggattcaatttcagttgaacacaaatttacatctttcataatcttaaatattacatataagtaacattatcttatttgattagtaaatctgtatacatttaggaaaaacagaccgaagtaaaataaaatgtatgcttgttttatacattacataaataaatcaccaaaaatgacataactcttttaaataaaaattatttttaatgttttatttttaatttttgtaggtacattataagtgtatccatttattgttacatgagatattttgatacaggcatgccatgcgtgataatcacattagggtacatgaagtagccatcacatcaaacatttatcctttgtgttacaaacaatccaattatactcttttagttattttagaatgtacaattaatactgactgtggtcaccctgttaggctagcaaacactaggtctattcattctttctatattttttacccattacccatcctcacattctcccctactatctttcccagcttctggtaaccatcattctactctctatttgcatgagttcagttggcttaatttttagcttccacaaataagtgagaacatgcaaggtttgtctttctatgcctggcttatttcacttaacataatgacctccagtcccattcatattgttgcaaatgactagatctcattctttttaatggctgaatagtgctccattgtgtatatgtaccacattttctctatccattcatctgctgatgggcagttaggttgcttccaaatcttggctattgtgaatagtgctgcaatacatatgggagtgcagatatctcttcaatatgctgatttcctttcttttgagtgtatacctaggagtgggattggtgactcttctccacagtggttgtactaatttatgttcccaccagcagtgtacaagggttcccttttttccatgtcatcgccagcatttgtttttgcctatcttttggatataagccattttaactgggatgagataatatctcactgtagttttggtttgcatttctctgatgatcaatgatgcggagcaacttttcagttgcctgtttgccattcatgtgtcttcttttgagaaatgtctattcagatcctttgctcattttaaaaattagattactagattttttcctatagagttgtttgagctctgtatatatatctgcttattaatctcttgtcagaggggtagtttgcaaatactttttcccattctgtggattgtctcttcagtttcttttttgtttttttttttttttgttttttttgtttttttgtttttgagacggagtcttgctctgtcgcccaggctggagtgcagtggtgcgatctcggcttactgtaagctccgcctcctgggttcacccaccattctcctgcctcagcctcccgagtagctgggactacaggcgcccgccaccacacccagctaatttttttttttttgtatttttagtagagatggggtttcaccgtgttagccaggatggtctcgatctcctgacctcgtgatccacccacctccgcctcccaaagtgctgggattacaggtgtgagccaccgcgcccggcccagtttcttgatttaaacaagaattattaaacaaatctcatttgccaaagatataccttaattctggattctcaaaatgtttgagctagcagaattttttgtgaaaatatttttagtttagcacattttagtattaaaagttcaacttctggctgggcgcagtaaccagcactttgggaggccaaggcgggtggatcacctgaggtcaggagttcgagaccagtctggccaacatggcgaaaccctgtctctactaaaaatacgaaaaattagctgggtgtggtggtgggcgcctgtaatcccagctacttggaaggctgaggcaggagaattgctcgaacccgggaggcagaggttgcagtgagccaagatcgtgcaattgcactccagtctggacaacaagagcaaaactctgtctcaaaaaaaaaaaaaaaaaaaaaaagaagttcaacttctttttttcttggagttaaaaaaatatgtatgtaagttcttatttatgtctataaaccaattagaacagagctcctttaatttaggaaactttatgatataacttattaatactccccagagataggaaaatattttacactcacacaatgtgaggtcaaagcctttttcagttgtagacacatagacatagataaagcgatcttatgaattctgatctacaatttcagctataagttaagagtaaacacagaaatatgccagtccagatattacagtgttcaccttccctgcgggtgtgaaattactgattaatttaagttcaaaatgaacaaatagaacaacaaaaaagacaaattctctgttatttcccacccatcagtgactagataagtgactagataatccgttagtccaattacaaagaccaccaaatggtcaaaccatataatcacattcccagtcattgctgctaccaaggaagaatataacttactgactatacacaaaccagaaactaaaacaaaacataaactcaatagaaaagaaaaaagaaagaagcagagattcaacaaatttctgctgccactttggattcaacctggaagccaagaaaagattaatgtaaacaatctaggagttacatttctccagtaacacaatttacctggccctgtcaagtgtatccattgggcatctcagtcagtacttttaagatataaccttggctgggtgtggtggctcacacctgtaatcccagcactttgggaggccaaggcaggcagatcacctgaggtcaggagttcgagaccagcttggccaacttggtgaaaccccatctctactaaaaatacaaaaattagcttggcgtggtggtgggtacctgtaatcccagctacttggtaggctgaagcaggagaatcacttgaacccaggaggcggaggttgcggtgagcagagatcctgccactgcactccaacctggtgacagagtgagactgtctcaaaaaaaaaaaaagatataatcatgactctcttaggaatattaaatgaacacatcaaggattttatttaattcattaactgatgaggaaaccgagaagatgttacaaccaatttcaatttgcatttcattttggttgcttggtttttcctgttttctgtctcttactgtttattcagcggtatcttttttccctttgctgcttccacttccttttgctgcttccagttttacttttattcctgtggtggctttatttttttaccttctttgtctctgaaatagctcatattccatttccttttgttgtgtaccaactcttccctgagttctagcatttctgttttatattcttgttttatagagatgactacttaattaatattactgaatttatgctgatatgtttagtcacaattttaatctgcatatggcaacatttctctggtaagaattctccatctgccattttttttttctgtttcttccatcccattttcatgtagtatctttgtgtataaactgtgctggagttgtttgttttgttttgctttgcttgataacatctttaattgcaatgaggtctctttagaccttctacttgcagatgatacatgtggagaggagctcaggacctgatcaaggataatagaaatttttacttaagttctaaggttgttgtgtatgtgagttcttgtaggctctacatcttctcagccagtggatataggcagctatgggcttctcataacaaagactctttcctccccactgcttcactgacctgttgctcactctttattctctgcttctcaaaaccaaactaaggccagacgagttccctttaccagcctctaaactcttttcttgttattgtagataaaggatttgcacttcagggtgtgctcctccccttggagtgttgtacttttgctgactttttctgattctatttttatttttaaaacatatgtgtgtatgtgtacacaaataccctagactataagctccacaaggacagatactgtgtctgattttgcttacctttgtattgtgcgcctagcacataataggtcttcagaatatgcacacatatatatattcttataaaatgtgtgtatatgtatatatatttatgaatgcatatttcatctataaagccttggaaggatacacaccaaacttaacacttgatagctcttggaacaagtattagtgtgtttaagggactttcactttttattttgttttttgtttctgcatttgaatttttcaatgaatacatagtactttaataattaaaatgaaagatacatttagaaaaattattctgacttgttaaaggtttgtttcttgagattttgtatttccaatgaactaatgcttaaaataatgagcccagtatgtcagtaatgtaaataaatcattaagctaccaactgcaaatagataaattgagggaaagtacaaagccagtgaatcataaattcttgagggaaaattggaaaacgccatccttttaaaaatctactccaaatcagagttaattaagagctgtataaacagtgattaaaattttagtgctatgggaattggcttttacaaaaggattaaccctgacatgccattatattagtgacctaaggaaagcagctcaccacatttattctgcaaagtatttattaaattcctaaggactactatgtattgtggaaataaggaaatgtattactgtctctgtccctaacaaatttacagcaaagaaaggtcagaaacataatcaattatacatatataaggcaaaatgaaataactatactaatagggatacagaatatatgggaccacagaggaagaaatgatctattccaaaaggtgatatttgaacttactcttcaagaataaatagaattttaatggtaggaatcaagtgaacagaagccaggagtaatacaggagaacattgttagtttggggattatctcttattcaggggttatatagtgggagatgagtccatgtcttagtctgtttctgctgctgtaacaaaacacctcatgcagaccgggtaacttacaaaagagaaaaatttttttttctcacatttctggaggctgggaagtctacggtcaaggatccagaaggttcagttttctggtgagggctgctttctgattgcaagatgataccttgttgctgcatcctccagaggggagaaacactgtgtcttcacagggaggaaagtggaagggcaagaaaagttagtgctgtgtggaagcctcttttttaagggccataagggctatctgtaaccctgttcatgagggaggagccctctgggtctaataagctattaaaggttccacctcttatcctatcacattggccattaagtttcaacatctgaattttggaggggacacattcaaaccacagtaggctgaaagtagtgtgatttgtgatgtgcccattctcaataacaaattaggccactagtatcacctagttccaagctatctcatgtctcacttggaccactgcaatagcttcccaagtgtcctctctgctgcacttcttgccctcctaataaattcaatagccacacagcagccagagtattttaacataagtcagttcatgtcagtctccttgcacttcccatttaaatggatttaaaataaaatcccaagtccttaccataatctacaaggccatagataatccggtccttagataccttcctcgccacctctcctgccactctgcctcatagctccatgtactctagccctactatgtctcgataacaccttgtacttccctgcttctgggcctttgtatttgccctttcctttgcattggacactcttgtcctagatattcatatgccttgctccccaacttgctcaagttttaccccctcagagaccacaccctttcaaaaatagcaactttcaatactatttaaccccttaacctgtgtgttgactacttgacatattctatgttgcttattgtttgtctccctaaatagaatccaagttccatgcaggcagaaaagttgtctgtcttgttcattctttatccatacctcctaaagttttgcctggcatataatagggctcaataaatatttattaaatgaaattctgctataacaccagaaattatatcattagagagtcatttattttagtcttagagtgttttgatcttagagaaccctctgcaaagatccttgggagagctcacaatttagtcattatcagcgtatactctgggagaggaacatttagaaaaaagtacttaatggagattgaacttgggatttagagcagagaagggcaggtttccaggggtgaaaaaggaaatttaaggggaagttgggtttgtaccaaagatgactttgcttatagtgagaagatactcaaacctttcttacttgaggaagctcacagcttctgaatctctctttctggctgtgaaaagaaatttcctcttttgggtctcccttgaagattatcatttttggatgttgctaagagcatccttggagtcagagtctctatatatagcaaatcatcaaatgttagggctagaagtaatcttggtgatttggtttcttaaaactatttattttataacatgagttaaacatttatcacaaaaacaggaagatagagaaaaggctttagtttttgtaggtcattgcaaggaagaatttcgcttatctccagtgctataattttgactttggtataaagtattcatcaagtgtcatcatcgaaagtattagtggttatgacaaacaaggcaaacctcctgagaactttagaacaaagcccagcatggatgttctgccagcataaatgcagttcagctggcagagcagaggattatctatgtttttatgtattatatattacatatttatatattagggtctcctcaacccataactggaaaggtcattctaatttatccaaatacagtagataaaagctgccatttaacaaggtgtatgctagaaatagaaatattttttgtcttttccattgtacacaccaaaactaggattgaatgcttattcctttgcaggcagtctttgcttggttccttcattggcttaatacagcaatcagtcatgcattacttttgtctcagagattagttctcatgggtaagaaattctcagagatgaaagttttgagatcagccaaaagaaaaggcaattggagctgatcctcaggcacattaaacagaatggcaaaacttgagtagattttctagtgtacattttgagccagaacttaggccacagaaataggagaacctgagtttaggatttttcctggaaggaaattagacaattagctggagatacccaagtatctctgataaaaatggatcctaaaagtcttcacttttggcagcattccatttaaatcatgcctcatagtcagcataagcttaccctaatgatgcaatccaaagccttaatggcagtgagtagagactttgatacagggctatggagtcactgaagaaatatagtaggggttccaggttgaggagacaggtttgttatggttcccagatacttatggtgatatatactattccttctcccaagtgcctgatctaattaggaatgtcagtccaatctccctgttcccaatatatatcttattatggtttgcttttagaaaggacaaatgtgaatctggaaattttatttatttatttatttattatactttaagttttagggtacagatgcacaacgtgcaggttagttacatatgtatacatgtgccatgttggtgtgctgcacccatcaactcatcatttaacattaggtatatctcctaatgtcatccctcccccctccccccaccccacagcaggccctggtgtgtgatgttccccttcctgtgtccatgtgttctcattgttcaattcccatctatgagtgagaacatgcggtgcttggttttttgtccttgcgatagtttgctgagaatgatggtctccagcttcatccatgtccctacaaaggacatgaactcatcattttttatggctgcatagtattccatggtgtacatgtgccacatttacttaatccagtctatcattgttggacatttggcttggttccaagtctttgctattgtgaatagtgccgcaataaacatacgtgtgcatgtgtctttatagcagcatgatttaaaatcttttgggtatatactcagtaatgggatggctgggtcaaatggtatttctagttctagatccctgaggaatcgccacactgacttccacaatagttgaactagtttacagtcccaccaacagtgtaaaagtgttcctatttctccacgtcctctccagcacctgttgtttcctgacattttaataatcgccattctaactggtgtgagatggtatctcattgtggttttgatttgcatttctctgatggccagtgatggtgagcattttttcatgtgttttttggctgcataaatgtcttcttttgagaagtgtctgttcatatcctttgcccactttttgatggggttgtttttttttttcttgtaaatttgtttgagttctttgtagattctggatattagccctttgtcagatgagtagattgcaaaaattatctcccattctgtaggttgcctgttagatggtagtttcttttgctgtgcagaagatctttagtttaattagatcccatttgtcaattttggcttttgttttcattgcttttgctgttttagacattttcttgtacagttatcttagcacaatgtctcctgatcagaataagttgtgtactatacctcacctacacattcattacttattttcacaagacttcccaagctttaaacttcagtccaccactaactgattatatatatatatcacaatacatattcttttcaagtgtacttgtaacatataccaaaatagatcatatgctgggccaaaaagcaagtctcaacaagtttcaaaggattgaaatcatacaaggtatgttatccaaacaaagtacaattaaatgagaaagcaacaacagaaagatgattaggaaacccccactgttggaaatctaaaagaaacatttctaaataacccatcagtcaaagaaaaaatcaaaatgaaaacgatggaatagattgaacttaacaaaaatgaaatatgacatcaaaacttgttggatacaactaaaataaaggaaaagacatagctttaaatgcatatattagaaaagattaagggttgaaaattgatgatctaagcttccaacttgagtctagggaaagaacagcaaattaaagatagtagaaggaagaatgtaacaaagataagagcagaaaacaaagaaatgaaaaataacatataacacagaaaatcaggctgggcacagtggctcatgcctgtaatcccagcactttgggaggccaaggcgggcagatcacctgaggtcaggagtttgagaccagcctggccaacatggtgaagccccgtctctactaaaaatacaaaaattagccaggcatggtggcacatgcctgtaatcacagctactggggaggctgaggcatgagaatcgcctgagcttggaaggtagaggttgcagtgagccaagatcacgccactacaatccagcctgggcgacagagaaagactctgtctcaaaacaacaacaacaacaacaacaacacagaaaatcaacaaagctataggttgcttgtttggaaagattaatacaattgctaaaagtcttgcaagatggatcaagaaagaacacaaattaccaatatcagtaattcaaaagtgggcatcactacaaatccctcagacattaaaatcacaataaaaaggatattgtgaacaactttatgccaataaatttgacagtttggacaaaatggacaaattccttgaaaagtacagctaccaaaattactttcccgccccccattacttctcagctttttggctaagatcaagtacaaaattgtgcccccaaaaataatctgagtagtcctatttagactattttaaatagtcctaaacctactaaagaaatgcaaccttaaataccttctcacaaaggaaatggctttaccagtacattattccaaatatataagaaagaaataatagattttgggttggagccaagatggccaaataggaacagctctggtctacagctcccagcgtgagcgacgcagaagacgggtgatttctgcatttccatctgaggtaccgggttcatctcattagggagtgccagacagtgggcgcaggacagtgggtgcagcgcaccgtgagtgagctgaagcagggcgaggcattgcgtcacttgggaagtgcaaggtttcagggagttccctttcctagtcaaagaaaggggtgacagacggcacctggaaaatcgggtcactcccaccccaatactgcgcttttctgacgggcttaaaaaatggcgcaccaggagattatatcccgcacctggctcgtagggtcctatgcccacagagtctcactgattgatagcacagcagtctgagatcaaactgcaaggcggcagcgaggccgggggaggggtgcctgccattgcccaggcttgcttaggtaaacaaagcagcctggaagcttgaactgggtggagcccaccacagctcgaggaagcctgcctgcctctgtaggctccacctctgggggcagggcacagacaaacaaagacagcaataacctctgcagacttaaatgtccctgtctgacagctttgaagagagcagtggttctcccagcacacagctggagatctgagaatcagcagactgcctcctcaagtgggtccctgacaccgacccccgagcagcctaactgggaggcaccccccagtaggggcagactgacacctcacacagctgggtactcctctgagacaaaacttccagcggaacgatcagacagcagcatttgcggttcacgaaaatccgctgttctgcagccaccgctgctggtacccaggcaaacagggtctggagtggacctctagcaaactccaacagacctgcagctgagggtcctgtctgttagaaggaaagctaacaaacagaaaggacatccacactaaaaacccatctgtacatcaccatcatcaaagaccaaaagtagataaaaccacaaagatggggaaaaaacagagcagaaaaactggaaactctaaaaatcagagcgtctctcctcctccaaaggaacgcagctccttaccagcaacggaacaaagctggacggagaaggactttgacgaggtgagagaagaaggcttcagacaatcaaactactctgagctacaggaggaaattcaaaccaaaggcaaagaagttgaaaactttgaaaaaaatttagacgaatatataactagaataaccaatacagagaagtgcttaaaggagctgatggagctgaaagccaaggctcaagaactacgtgaagaatgcagaagcctcaggagccgatgcgatcaactggaagaaagggtgtcagtgatggaagatgaaatgaatgaaatgaagcaagaagggaagtttagagaagaaagaataaaaagaaatgaacaaagcctccaagaaatatgggactatgtgaaaagaccaaatctgcatctgattggtgtacctgaaggtgacggggagaatggaaccaagttggaaaacactctgtaggatattatccaggagaacttccccaatctaacaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcggcagaaactctaaaagccagaagagagtgggggccaatattcaacattcttaaagaaaagaattttcaatgcagaatttcatgtccagccaaactaagcttcataagtgaaggagaaataaaatactttacagacaagcaaatgctgagagattttgtcaccaccaggcctgccctaaaagagctcccgaaggaagcactaaacatggaaaggaacaactgggaccagccacggcaaaatcatgccaaaatgtaaagaccatcgagactaggaagaaactgcatcaactaacgagcaaaataaccagctaacatcataatgacaggatcaaattcacacataacaatattaactttaattgtaaatggactaaatgctccaattaaaagacacagactggcaaattggataaagagtcaagacccatcaatgtgctgtattcaggaaacccatctcacatgcagagacacacataggctcaaaataaaaggatggaggaagatctaccaagcaaatggaaaacaaacaaaggcaggggttgcgatcctattctctgatcaaacagactttaaaccaacaaagatcaaaagagacaaagaaggccattacataatggtaaagggatcaattcaacaagaagagctaactatcctaaatatatatgcacccaatacaggagcactctgattcataaagcaactcctgagtgacctacaaagagacttagactcccacacaataataatgggagactttaacacccctctgtaaatattagacagttcaacgagacagaaagttaacaaggatacccaggaattgaactcagctctgcaccaagtggacctaatagacatctacagaactcttcaccccaaatcaacagaatatacatttttttctgcaccacaccacacctattccaaaattgaccacatacttggaagtaaagctctcctcagcaaatgtaaaagaacaaacattataacaaactgtctctcagatcacagtgcaatcaaactagaactcaggattaagaaactcactcaaaactgctcaactacacggaaactgaacaacctgctcctgaatgactactgggtacataacaaaacgaaggcagaaataaagatgttctttgaaaccaacgagaacaaagacacaacataccagaatctctgggatgcattcaaaacagtatgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacgcaaaaaccccttcaaaaaattcatgaatccaggagctggttttctgaaagcatcaacaaaattgatagacctctagcaagactaataaggaagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacaccctcccaagactaaaccaggaagaagttgaatcactgaatagaccaataacaggctctgaaattgtggcaataatcaatagcttaccaaccaaaaagagcccaggaccagatggattcacagccgaattctaccagaggtacaaggaggaaccggtaccattccttctgaaactattccaatcagtagaaaaagagggaatcctccctaactcactttatgaggccagcatcattctgataccaaagccgggcagagacacaaccaaaaaagagaattttagaccaatatccttgaagaacattgatgcaaaaatcctcaataaaatactggcaatccgaatccagtagcacatcaaaaagcttatccaccatgatcaagtgggcttcatccctaggatgcaaggctggttcaatatatgcaaatcaataaatgtaatccagcatataaacagaaccaaagacaaaaaccacatgattatctcaatagatgcagaaaaggccattgacaaaattcaacaacccttcatgctaaaaattctcaataaattaggtattgatgggatgtatttcaaaataataagagctatctatgacaaacccacagccaatatcatactgaatgggcaaaaacggaagcattccctttgaaaactggcacaagagagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaagaatccaacttacaagggatgtgaaggacctcttcaaggagaactacaaaccactgctcaaggaaataaaagaggatacaaacaaatggaagaacattccatgctcatgggtaggaggaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatctccaagtcaatcctaagccaaaagaacaaagttggaggcatcaagctacctgacttcaaactatactacaaggctacagtaaccaaaacagcatggtactggtaccaaaacagagatatagatcaatggaacagaacagagccctcagaaataaagccgcatatctacaactatctgatctttgacaaacctgagaaaaacaagcaatggggaaaggattccctatttaataaatggtgctgggaaaactggctagccatatgtagaaagctgaaactggatcccttccttaccccttatacaaaaatcaattcacgatggattaaagacttaaacgttagacctaaaaccgtaaaaactctagaggaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaaaaaaccccatcaaaaagtgggtgaaggacatgaacagacacttctcaaaagaagacatttatgcagccaataaacacattgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagcaatcccattactgggtatatacccaaaggactataaatcatgctgctataaagacacatgcacacgtatgtttattgtggcactattcacaataggaaagacctggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacactgtatgttctccctaataggtgggaattgaacgatgagaatacatggacacaggaaggggaacatcacactctggggactgttgtggggtggggggaggggcgagggatagctttaggagatatacctaatgctaaatgacgagttaatgggtgcagcacaccatcatggcacatgtatacatatgtaactaacctgcacattgtgcacatgtaccctaaaacttaaagtattataataataaaataaaataaaaagaaagaaataatatcaatctcatacaaatatctcttatggaaaatagagaaaaaagtaatacatggattttatgaggccagcatactctgattccaaaaactaaaaagaaaaatacaagtcagtgtcagtgtcttttttgtttgtttgtttttgtttttgtttttttgagatgaagtctcactctgtcgcccaggctggagcgcagtggcacgatctcagcttactgcaatatttgcctcccaggttccagcgattctccagcctcagcctcccaagtagctgggactacaggcatgcaccaccacgcccagctaatttttgtatttttagtagagatggggtttcaccatgttggcaaggctggtcttgaactcctgacctcaggtgatccgcccgcctcggcctcccaaagtgctgggattacaggcgtggaccaccacacccggcatcaggccagtatcttaaatgatagatgcaaagatcctaaatacattttagaaaattgaatccagcaatatataaaaaggatactgcatcatgaccaatattgcttatcccaggaattcaacattcaaaaatgagtgcacattaacaaaataaaagaggaaaatataataatctcaatagatgcagaaaaagcatttgaaaaaaattccatacccattcatgacgagaacactcaacgaactaggaatagaaagtcacttcctcaatctgataaacattacttgaaaacaaactactccttattttgtatttaatggtaaaatatgaacactttctcactgatgtcagggaatgaaacatggatatacactatcaccacttccattcaatattatactggaataattccaggcctcctagtaacccatttcacatcttaggtctaattgatcactctctccatgctgcctcttaaagacaatatgttcttttttaacttcagttgtaaaccctttatatgctttaagacggtttccaaagcatttgttaagctctgtcttcttcagatcaactatttcagaaataggttctattttccaaccttctagtcatagccattcttctcctttacatgttttccagtagtggattgtgaatcagaacatgtgggattagggtcctggctctccattaatttgctgtttctatgggtaggaacagcatttagtttctcagccataatcttctcatctggaaagtggggttaataacccctgccctgtgtatgcattagaagggcatttcgcctatccgaagaactcagaataatggagcaatttctaaaccatgactttgaaaacactgcagagacccagccaatctaccatttccaggagcttacaacataattccaacaacaaatgtaacctgaaatagataaacaaactgtacatctctataatggaatactactcagaagtaaatgaatgttaaatgcatttgccaagtgaaaaaagacagatccaaaaggctatgattccatttatatgatatcctggaaaaggtaaaaccataggaaaagaaaacacatcagtgattgccagaggttggacattggagtaggagttccctataaaggggtaacatgagagaatctttagggtaatgaatgttctataaggagcagtgatagtggacacacaattctatgcatttttcacaaccaatagaactatatgccacaaagagtagattttaccggatacaattttaaaataaatcaatcaggatgtggagggaatcccagatggaattcagactgtgacaaatgaatctgactctattacgaatgaactacatagccacatggaagggggtgaggaagaaagaagccgatttaagtaactttgaaaaactctgttttgattagatgcaaggctaaagacaaaaagaactatgcacaatactgtattctagttggtaacttttttcacgtggatatggattagcaataatgaaaatactttacatatttagtcagttttgctgttacatggcatatgcatgcctaaaaattattacagtatccaaaattgtgtaataaagaccacagggcttacgggaaaaaatggggttggggtataacactaaaaaatttggtctgtgacatattaaaaaaaagataagagcctaataaaatgacagcatggttttatatatgttaaatgactaaaaatacatgaatactacaataaatatggctatttaccttaaaaaagacctggcatttgcttatggaagtgaatatcagaaggactgcagcttgtgagatactgtgaagtggtgggaggaggttgtctgaaatctgatggaaagttgtagcaacagatgtggatgagtgtggcccataacacattcagtgaactgaggtagtggatagaagtttgagttgtgcacatgtgtgtgttatgcatattcctatacagcttggttcagccagatgctgctttctgcattcacttactatttcacatagactaaattgcacataagcaagtacttaatttacataatttacattaattgttacctaatatatcaatcatgttggaacaaattcacattttcaaaacaaacattataacaactgtatgtatgtgtgtgtatatatagtatgtattatgtatatgcaaatagacatgcatataatatggttttctttatctgtgatttggaataaagttttaaaaataagtaaatttgggctgggcacggtggctcacacctgtaatctcagcactttgggaggccaaggcaggtggatcatgaagtcaggagttcgagaccagcctggccaatatggtgaaaccccgtctctactaaaaatacaaaaatcagctgggcatggtggcacgtgcctgtagtcccagctactcgggaggctgaggtagaagaattgcttgaacccaggaagtgagggttgcagtgagctgagatcacgccaccacactccagcctgggcgacagaacgagactctgtcaaaaaaaaaaaaaaaaaaagtaaattgatatggttgttggatacaggtttatatataaataattaattatatttctgtatactagcaagaaattattggaaagtgacctttaaaatacaatttttgatagcatcaaaatccatcaaatgcctagtaatctataatgaaagatgtataagacctctgcactgaaagccacaaaaccttgaaacatggctgaaagaaatttttaaaggtctaaataaatgcagatatatgccatgttcatgtgttagaaaactcaatattgttaggatatatcagttttcccaaattgatctatagattcaaagcaatcccaatcaaaatcccagctggggctgtgtgtggtggcttacagtactataatcctagcactttgaaaggccaaggtgggaggattggttgagcccaggagttcaagtatggcctaggcaacatggcgagaccctatgtttaccaaaaaaaaaaaaaaaaaaaaaaaaaaaaaaaaaaaccggtgtggtggcatgcacctgtggtcacagtggtcacagctacttgggaggctgaggcaagaagatcacttgagcccaggaatttgaggttacagtgagctatgattgcaccactacactctagcctgggtgacaaagtgagaccttgtctcaaaagataatgaaataaaataaatgaaaaatcataggagaatatcttcatgactttgtggagacaaaagtttaccaactataaaagaaaatattgataaagtggacttcattacaagtgagaactttggtctgtcaaaagataccgttgagaaaagaaaaagacaagccacagataggaagaagatatgccaatacataagcttgacaacttccagaatatataaagaattcttacaattcaacaagaaaagataaataacccaataaaaaaatggacaaaagaattgaatggctgggcacagtggctcgttcctgtaatcccagcactttgggaggctgaggtgggtggatcacctgaggttgggagttcgagaccagcctgaccaacatggagaaaccccatctctactaaaaatacaaaattaagcgggcgtggtggcacatacctgtaatcccagctactcagtaggctgaggcaggagaatcgcttgaacccgggaagcggaggtcacggtcagctgaaatcacgcctttgcactccagcctgggcaacaagagtgaaaatccatctcaaaaaaaaaaaagaattgaatggaaatttcacccaaaaaaaatgtataaatggtcaacaagcaaaggaaaagatgctcagcatcattactcatcaagaaaatgcacattgagaagccgctgcaccctcactgaaatgactaaaaaaaaaatcaagtgttaatgagggtgggaagcaactggagttctggcacacaactagtggaaatgtaattggtacaaccactttggaaaactgtttggcagtatctgctaaaaccaaacatgtttctatcccagcagtgaccgtcaaatctcacttttagatatatactcaggtgaaatgagtacatctcttcaccacagtatgtacaagaatgttcaagacagctctattcatagaactaaaaatttgaaacaacattactgttcatcagcagaatgatagattaaataaattgtggtatgttcatacaatggaatactacaaagcaataaaaagaatgaacgtctgatagcatacaaaaatatttatgaatatgacagacattatgagtaaaagaagttggtcccaaaagaatacacaatataaattcaatttttcaaacaattgtattgagatataactcacatgccatgcagttcacccatcaaagtgtacaattcaatacactttagtatattcacagatatgtgcaaccaccactgacaatcaattttggaacattttattacctcaaaaggaaagcaacgtaccctttagtttcccttgcatttctcccacaagccctgaacaaccactaatctactttctgtttctatagctttgcatattctgaacacttcatttaaataaaattatataatacatggacttttgtgactgccttatttcacttagcatatttttgaagttcattcatgttgtggcatgtcagtacttcattactttttatggtcaaataatattccattgcctgggcataccatgttttattcatccattcatcagttgatggacatttggatcatttctatcttttagctattatgaataatgctgctgtaaactcttgtgcacaagtttttgtgtggacctattttcacttttttgtgtgtgtatacctaggagtggaattgctgggtcatatggtaaccctatgtttaatcatttgaggaactgccagagtgtttttcaaagcagctgcatcattttacatttccaccagcaatgtatgaggcttccagtttctccacctccttctcaacacttgtattacctgccttttttattctagccatcctagtgaatgtatagtgatatcttattatggttttgatttcctgatgactaattttcctgatgaccaatggtgttgagcatcttttcagatggttattggccattgtatatcttctttggagagtatctattcacaccctttcccaatttttcattaggctgccttttattattgaatagcaagagttatttatgtattctagatacatgtctttgatcagatatatgccttgattttgccccactctgtcaattgtcttttctctttcttgatcatgtcctttgaaatacaaaattcgttaactttgaggaggtccagtttatctatttttctttcattgcttatgcttttgatatcatatctaagaatccattgccaaatcaaaagttatgaaggtttacccctctgttttcttccatgagttttatagtttagctcttatctttaaatatttgatctatttcgagttaattcttgtatatgctatgaggtgagggtctaacttcattctttatcatgtggctatccagttgtcccagaactatttgattaaaagactatcctttccctcattggatggtctttgccccttttggaaaatcagttgaccacagacacattgttttatttctgggttgtcaattctgttccatatatatatatatatccttatgtcagtaccatgctgtcttgattaccattgctttctattttctttttcttttcctttcttttttgttgagactgagtcttgctctgttgcccaggctggagtgcaatggtgccatctcggcttactgcaacctctgcctccttggttcaagcaattctcctctcagcctcccaagtagctgggactacaggtggccaccaccacatctggctaatttttgtatttttagtagagacagggtttcaccgagttagccaggctggtctcgaactcctgacctcaagtgatctgcccacctcagcctcccaaagtgctgggactataggcatgagccactgcgcccagcctccattgctttctagtaagctttgaaatcaggaagtgttagtcctacaactttattcttggttttcaagattgttttggttattctgggtcccttgaatttccatacgagtttcaagatcaactgtcagtttctgaaaaaaataactgagctgggatgctgatagggattgtgttgaatctatagataattttggggagtgttatcatcttaatgataaatcatcaaatccatgaacatgggatatgtttccattttgttacatcttgtttatttcaatgatgttttatagtttttgtttataagttacataacaaaatggaaactaagttacataacttatacactaaaaactataaacgtacacactaattctttctttttctttttttttttttgagacagagtctcactctgttactcagactggagtgcagtggtgcgatgtcagctcactacaacctctgcctcccgggttcaagtgattctcatgcctcagcctcctgagtagctggaattacacacatgcgcccccacacccggctaatttttttttttttttatagagatgggattctgccatgttggccagactggtctcaaactcctggcctcaagtgatccacctgccttggcctcccaaagtgctggaattacagttgtgagccactgtgcctggtccttgttctttatttctaagtattttcttctttttgatgctgttataaagggaattgtttcaattttattttcagcttactcattgctgctatataaaaatagaattggccaggtatggtggctcactttgggaggccaagactggagtatcacttgagctcaggagtttgagaccagcctgggcaacatagtgagaccttgtctctaataaataaataaataaatacttgattgttgtatattgatcttgatgaacttgctgattagttataatggcattttactggattccctaggaattttattcacaagattatatcatcttgtgaataagattgatgtttttattccttttgatgctattgtaaatggatttattttgcagagcttcaaaacacttgaagcaaaaactgctagaactaaaatgaggaatagacaaatccataactacttggaaacttgaatattcctttcttagtaatcaatagaataggtcaacaaatactcaataaagatgtagaagacatgagcaacactatcagccaacttgacctaattgacatttagaacactctacccaacaacagcagaatacagttttttcaaattcacaaggaacattcatcattgtaagccatattctgaaccacgaaacaaacttcaaaaaatttaaaagtattgaaatcataaaattattgaaatatccaagtattttctctgaccacaagagaattatatatctataatacaaagttatctgtaaaaccttccaatatttggaaattaaacaacatactttaaaataatccagtaggctaaagaggaagtgacaggggaaattaggaattttttttaattgaatgaagatgaagacacaacatataaaaatgtgtaggctacaactagagcagtatctagacaaaagtgtatagcattaaatgctcctattagaaaaaaaaagaaaggtctcaagtaatctaagtctccaccttaagaaactagaaaaaatgagcaaattaaacccaatcaagcaaaagaaaagtaataaaaataagagcacagatcaataaaatttaagacagaaaacagtagataaagtcaatgaaaccaaaagtttttttttcttttgaaaagaccaatacaaatgataaacctctagccaggcagatcaagcacaaattaacaatatcaggcataaatgtggagacctcactagagatcctacagacattttaaaaggtaataagggaatattatgaacacttttatgtccatgaatttagaattttaggtgaaatgtacaaatttcttgaaagtcacaaactaccaaagctccctcaagaagaaatatatactcctatgcctattaattaaattcatagtttaaaatcttccaacaaagaaaactgcattgaagaattctacctaacatttaaagaagatgtaataccaactctatacaaactcatcctgaaaggagggcccaattcccagttcatcttatgagactattatcctgataccagtagtagacaaagacaatataagaaactgcagaccaagattcctcatgaaaatagatgcaaaacataaacgcagaaaagcaaagatagttgctaccttggttggatggtattgactggaaaggagcacaaaggaaccttctgtattgttggaagtgtttgttatcacaatctaggtagttattacacgggtttaaacacatgtaaaaactcatcaagctgtttaaggttagagcacttctttcagtttgttgtatatatgtcatacctcaaaacatttttcaatgttcaatctaccaagaaggatgaatgaaaagtgtctcacatagtttagtgtatgacacctgacatgaaattctttctatgctgatgcccaagaaattctgtcgactaatgaaacagtttggaaactctcctctattctgcttaaaataaagtcactgttggtttatacagcactgtatcttctggttaactcggccattagagtgagcaccagcccagttgaaagttcacaagaagcaagtaaacactggatttgatttagaatcaataatagcagcagggttttctcaggctgtttagaagcatcgtggcaattgtttgagaaaatataggtagttctagtgaatgcgctacagaatgttggaagtagcggttagcttagagattttaaaatgttagaatcaaataaaaaacaaaaataaaatttagaatctgtctacagcagtgaagatgaccttcaaattgtaagtaaaattaatatttcttagaaggaaaacctctccagttagtgaaattacaaccaaagagaataatataatataatcacaaagaatgttgcatttttgcctctttcttagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaagtaagagctatatttatgcttttgtaaggctggtgcccatttagatcgtatgactttttttcttctctttactcttctttcttacctccaggtaggaaataattttttctcatagcactttgtttctccttctctaatgccattcttagactattttgtattatgatcatttgtgcatttatcttcttcactctatgagattataatctctttagggtcataaacaataattacttaatttgtacttacaaaccctagcgaagttcattgctcctaataggtgctcaaattttttctgtgtggaatttaattatgtaactacacaacagggggagctcaaactttagaaagtttttctgggctagctagaaataactgagtgcttcaacaatcaaaagtgatgcaatcttagctgtttgttgaaatgtacagagaaatactggtaatattttttaacacaattgccactctcaaatttcaggccaaactttacgtgggtttgggggcatagagcctttttgggagtacactgcaggaaacagcctaattatcttccctttttatctctcaccctcttcaggagcatgtgtgtggttaataaaaatattaggtagctccaagtgcacaagagtcacatttgcctttccttggtcttgccaagacagaattcctagagccatggagcagatgatatatactttatggacatgtgacagcaaccactgctccttgtataatggaactccaattctaaaaatctgttaaatgcatctggaagtcttagggttagttacctctgatactcccttgtcaagtgtttcctatttttagtatcagataaaaataggacattttagtacaaacctgtttcaattagtgcccttttactgatctgctttctgtttccttcttagtgtgcccttccttgactgtcattcataagattattgcttcacctgtatgactgtgtgcaaggtcatacaaacagtaggttttctgttgatgtttgctgaaaaaaggatgttacctggtaatcccaccatgctactctgcccagaaagtagaagctatttccaaaagcgactgtagatttatcatttataaaattcattgttgtttatttttgttcatctgtttcagcccagtttcattagagaaagcaagtggtagcctgggatgaaaactgtgatgggtgacattatcatgttcacaacctttttccttttcttactctagtaatagcaatggaaaagcctgcacactatcctttgattgctctcaaggccttgaaaaaggctttattgctctacaaaaaggaagaaccaattgatatatcacaatacaggttagtaaatacaatccagcctttttgctagccaaaagaactatagtcaatgcctcaaaagtaaccaatcgttcttaattgactcaactttaaagatgatatggggatgatctgggggcattcttgtgaacagctccatactgagagttgtattacagaccaataattatttagcaaagtcaaggagcttggttttcccaaaggagaaaaaaaaggggaaaagttgcttctttgtgtgaatctgtgtatataataaaactgctaagtacctttctttctttgtttcatcactaaataatattccaaatgtacagaaaagcacaggggttaatataacaaacaccaacgtatccaccacccagatttatttgttttatttttagagatggggtctcgtgatgttgcccaggctggattcaaactcctgggctcaaatgattctccacctcagcttcatgagtagctgggattacaggcacgcagcacccagatttaacaaatgttaacatcttgctatgtttgcctcattatttttctaagcactttaagcaccgataagtgctgtataaaatattatctattggagacttttttgttttctgtgtccagacatggggaaaaatagatgttgtgtgactttttttgtctggaaaacatcattacagtcttcctgtgttaaggcacgaaagacagttcttgtggaatcattccactttaaaccccagttcccttgcccatttgaggaagtaccgagatgctttaaaatgcctgtaaattgaaccagctcataaaatataatagacagccacaactccttcgtgcaggaaactaaaaaaagaatgaaagacaaccataggcatgaaaaaagaaaggattggtcaacctgttttacagcttcaaaaatctgtcttctgaggttggaggccagataaaaccgagggaagaacagaagtgttttgaagctgttagtctgggatgagatccaggttttacttatcttagccatgaagccaatgatttctttccttatgggatgagttttctctttttgattttcagcaaatgtatgcacaacttggttaacctctcagtgccagatggggcgtcgaatgtagagctctgtcccctggaagaagtttggggctattttgaagatgctctgagccacattagccgcactgtaagtcaaatagtgatattaaactttcagttaattttaaagaactgaactgtcttgtgtactataaattatatacaataatgctttctgatatgagttttaggataaattcatattacaattttgtagttacacactacagaattttcctgggtttctgaaatataaatagttgaaagtagacattttctaacacaagtgtattatggattaggtccaagtagcagtaccaccaggcattttgaattattttatattttcaaatcatggtgggatgattactttctctgtgatgatatgaaccttttgaaaaaagttattgctattcccatcctttctcagaagcatcctttctcagaagagtagaaggaacattgaagacctgtattctagtccctcctctgctgatttctttttcttttctgtgcaggtttattcagttgttttaaaattaggtttcttgaggtataattcacatatcataaaattcacccatggcttgtgcacaattcagtaaatttatagagttgtgcaactatcactacaatccagtgttttttagttttaaaaatgttttatttttaatttttgtgggtacatagcggtgtacatgtacccatacttatggggtacatgagattttttggtacaggcatataatgcataataatcatatcaggataaatggggtatccatcacctcaagcatttatcctttgtgttacaagcaattcaattatacttttagttttttaaaatgtacaattaaattattgttgattataatcaccctgttgtgctattaagtacagatcttattcattctattttttgtacctattaaccatttccacatttcccccacccctcctctggtaaccatcactctactctttctctccccagcagttcaattattttaatttttagctttcacaaataagtgagaacatgtgaagtttgttttttgtgtgtgtgctgggcttatttcactcaacatactgacctccagttccatccatgttgttgcaagtgactggatcttattttttttatggctgaatagtactccattgtgtataggtaccacattttctttatccattcatctgttgatggacacttaggttgcttgcaaatcttagctattgtaaacagtgctgcaacaaacataggagtgcagatacctctttgatatactgatttcctttcttttgggtatatatccagtagtgggattgctggatcatacggtaactcaatttttcgtattttgaggaacctccgaactgttctccatagtggttgtactaatttactttcccaccaacagtgtgcaagggttcccttttctccacatcctcaccagcacttcctattattgcctgtcatttggatataagccattttaactggggtgagatgatatctcactgtagttttgatttgcagttctctgatgatcagtgatagtaagtaccttttcatatgcctgtttgccatttgtttgtcttcttttgagaaatgtctattcagatattttccttattttaaaactcgattattagattttttttcctatagagttgtttgagctctgtatatattctggttattaatcccttatcagaggggtagtatgtaaatattttctctcattctgcaggttgtctcttcactttgttgattgtttcctttgctgtgcagaagctttttagcttgatgtgatcccatttgtccatttttgatttggttgcccatacttgtaggatattgctcaaggaatctttgcctactccaatatcctggagagctttcccaatattttcttgtagtagtttcatagtttgaggtgttcgatttaagtctttaatccattttgatttgatctttgtataaggcaagacatagggatctcaactttcctccttctgcatatggatatccagttttcccagcaccatttattgaagagactcttctttccccaaagtatgttcttggcacctttgtcaaaaatgagttcactgtagatgtatggatttatttctgggtttgctattctgttccactatgttgagctgcctggggctggaggaggggtgatacaagcacccttgtggccactgccactgggactgtgctggtcagacctgaagccagcacagcactgggtctcacccaaggcccactgtaaccactacctggctaccacctatgtttgctcaatgccttagggctctacagtcagcaggtgatgaagccagccaggctgtccttcccttcagggcagcaacttccccctggccccagagatgacatgcaggagccagggcctggagtcagaaaccctagaaatctacctagtgctctattctactgcagcttagctggtatccaaaccacaagacaaagtccttcccactctttcctctttccacacgcagaagagtctctccccgtggccaccaccatcaggtggtgtggggagttctgctgggctactgccagtgttcacttaaggcccaagggctctgcaatcagcttgtggtgaatgctgccaggcctgggactcatacttcagagaagtgggctcctctctggcccaggacaggtacagaaatgccatccaagagccaaggcctggaaccggggaccctaggagcccacttggtgctctaacccactgtggctgagttgatatctaagctgcaatacaaaatcctctttactcttccctctgcttttctcaagcagaaggagtctctcctcatagccaccacagctgggaatgtactgggtcacaactgaagccagcatgtctcagagtctcacctaaggcccacagtatgtactacctggctactgctgctgatcactgagggccaaagtgctatttagtcagcaggtgatgaatcctgccgagactgggtccttcccttcaaggcagtgggtaccttttagcccgaggtgtgtctcaaaatgttatctgggaactaggtcctggaatgggaccttcatgactatgccaagtgccctgtcctactgtggctgagctggtatccaagatgcaagacaaagtcccccttaagcttccctctcctctcctctagtggaaggaaggggtctgttttggagctgcaaactgcactgcctggggttgagggaggggtcgtgcaatcactcccttggctgccctggctggtgtctcactaggtcgcatgtcccccagatgcactggctccaagcccagcacagcacaaagatttgcccaggagttgcagtccttgtggcctagactgcctctcaaatttatttagaaccccagagcactttagctctcagtggcaaggcttgttggaactcaagttccaactactgggatggacaattgctctctagctagggctggtctaaatactccctccatgagcatcagttgagttctgcccagtgttactttctgctgtgacagggcagcactgagttccaagcaagatcccacaatcactgtgctctcccttccacaagcacacagattcgccatgccatgcagccactgttggggcataggagaggggtggcattggcagttcaagattgtccttcctacactcttcagtggctctttcggtgatacgaagttaaaaccaggtgctgtgatcactcacctgattttttattattattttttaaattttattattattatactttaagttttagggtacatgtgcacaatgtgcaggtttgttacatatgtatacatgtgccatgttggtgtgctgcacccattaactcatcatttagcattaggtatatctcctaatgctatccctccccactccccccaccccacaacaggccccggtgtgtgatgttccccttcctatgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatgtgtgccaattttcttaatccagtctatcattgctggacatttgggttggttccaagtctttgctattgtgaacagcgctgcaataaacatacgtgtgcatgtgtctttatagcagcatgatttatagccctttgggtatatacccagtaatgggattgctgggtcaaatggtatttctagttccagatccctgaggaattgccacactgacttccacaatggttgaactagtttacagtcccaccaacagtgtaaaagtgttcctgtttctccacatcttctccagcacctgttgtttcctgactttttaatgatcgccattctaactggtgtgagatggtatcttattgtggttttgatttgcatttctctgatggccagtgatgatgagcattttttcatgtgtattttggctgcataaatgtcttcttttgagaagtgtctgttcatatcctttgcccactttttaatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcaggagctctttagtttaattagatcccatttgtctgattttttattcttaatttttgtgtagatagttattaaatttggtgttcctgcagagaggatgattggtggaggcttctaatcagccatcttgctccgtccttcctcccacaatccagttttagaacatttccattaccctagaaattttccccttgcccatttgcagacaattcttgctcccaccttcagctccaggcaaccacagatccgctttctgtctctgtagattttctctttctggacacatcatataaatgaaattatataatacgtggcctcttgtgtctggcttatttcattgagcataacgtttttgaggttcgtccatgttgtagcattatcagtattccattcctttttttttttttttttttttttttgctgaataatattctagggaatggatataacacactttgtttatctgttcatcagttcatagatatttgagttgtttccactttttggctatcatgaataatgctactataaatattcatgtgcaagtgtttttgtgagcatatgtgtttaattctcttgaatatatacctaggaatggaattgttgggtcatcaggtaaatctatgtttaacttttggaggagctgcagtctgtttgccaaagtggccataccattttacattttcactagcggtgtatgaggattccagcttctctacattctcaacacttgctattgttcatcttttcttttttttgttatagccattgtggttttgatttatatttccttgatggctaatggtgatgatcattttttcatgtacttattgactgttcgtgtattgtgtttggataaatgtctattcaattattttcccatttttaaaatggaattttttattgagttataagagttctttatatattctggatacaagtcctttaccagatatgtgatttgtaagtattttctcctagtctctggcttgttttttcattttcttaagggtatcatttgaagagccaaagtttttaattttgatgaagtccaatctatcaattttttcttttgtgggtagtgttttggtcatgctgagaaatctttgcccaacccacgtttacaaagattttttcctacgtgtttctgtagaagttttatacttttatctctgacatgtagctctatgattcattttaaattttgttatagtgtgaggtagggtctaaatgatgttttgtttgtttgctgttgcatattaatatcactcctctgctgtttgacttcagttttcacatttgtaaagtgggaataatacctgatctgactctcccacactggggttgtaaggatcaatgaaaataatgtatgttttgtaaactttaacagcttgtacacatgtaaggcagtattgttattataagagagctataaaacattaagaacactacatgccttgcttaaagttacacagaaagtcattatttgagtccatgttaatatctgaggatcctgactgctcttgactcaactacttcttaatatataaatatagtcatgtgccacataatgacatttcataatatataatggtggtcctgtaagattataatggagctgaaaaattcctgtcacctagtgacatcatagccatcgtaaggcaacacattactcacatgtttgtggtgatgccagtgttaagaaaacttactgaactgccagtcatataaaagtacagcacatacaattagatacagtccataattcttgttaatgatataacaaattactatgttactgtttcatgtatttactatacttttatcattattttaaagtatattccttttatttataaaagaaagttaaaactgtaaggcagcttcaggcaagtccttcaggagatattccagaaaatggcattatcatcctaggaaatgacagctccatgtatgttttgcccaagaagcctttccagcaggacaagatgtggaggtgggagacagtgatattgatgatcctggccctgggtaggcctaggttaaaatatgtgtttgtgtcttagtttttatcaaaaagttttaaaagttttttaaaaaattaaaaataggaaaacacttatacaataaggagataaagaaaatatttttgtacaactgtataatgtgtttgtgttttaagctaaatgttattacaaaagagtcaaaaagttggggttttttgttttgtttttgtttttttgagacagagtcttgctctgtcacccaggctggagtgccatggcgcaatctcggctcactgcaacatctgcctcccgggttcaagcagttttcctgcttcagcctcccaaatagctgagactataggtgcatgccaccacacccggctaatttttgtatttttactggagacgaggtttcaccacattggccaggctggcctcaagctcctgacctcaagtgattgtcccacttcagcctcccaaagtgctgggattacaggagtgagccagcatgactggccaaaaaaaaaattttttttttaattaaaaaggttttttttgggtttttttgtttgtttttttgggttttttttttttttttttttttgagatggagtctcgctgtcactgacgctggagtgcgaaggcacaatctcggctcactgcaacctctgcctcccaggctcaagtgattctcctgcctcagcctcccaagtagctgggattacaggcgtgtgccaccacatctggctaattttgtatttttaggagagacagggtttcaccatgttggtcaggctggtctcaaactcctgacctcaagtgatccatccgcctcgacctcccgaagtgctgggattacagtttataaaggaaaaaagttgcagtaagacaaggtcaatttatatttatatattttttgagacaaagtctctgtcacccaggctggagtgcagtggcatgatctcagctcactacagctttgacctcccaggtacaatcaatcctcccacctcagcctcctgagtagctgggaccacacgtgcgcaccaccacacccagctaatttgtttgtatttttagtagagacagggtttcaccatgttgcccaggctggtctcaaactcaggttcaagtaatttgctcaagtaatctgcccaccttggtctcccaaagtgctgagaatacaggtgtgagccaccacacctggccaaagttaatttattattaagaaagaaaaataccctttaataaactgagtgcagcttaggtatacagtgtttataaagtctgcagtaatgtacaagaatgtcctacaccttcatgttcactcaccactcactcactgactcacccagagcaacttgtagtcctgcaagctctattcatggttagtgccctatacaggagtaccattttttatctttcataccacatttttcctctaccatttctatgtttagatacacaaatacttacctctgggttacagttgcctacagtagtcagtagagtcacatgctgtatgggtttgtagcctaggagcaatgggctttaccatatcgcctaggtgtgtaggaggctataccatataagtttgtgtaaggacactctatgatattcacacaatgacgaaatcacctaatgatacatttctcagcttgtgtccccattgtgaagtgagacatgactatctgcaaatcacaacagatggtggaacattatagcagggtgacaatctgatacaaactagcattgacttaccaaagcctagaattctcctggagatgtgtaattatggcctgtgtgaatttaagtttaaaaataaaaacttcaacattggacatttggattatttattttactgtcttctcggatgaataggaaattctatttctaagccatgagcctcatctggacctttcaggtgtgtttgccatagtgaccaatacaaactgaaattagattgtactataactccaagttgatcaatttccatagtctctctataaggccaaaatttctctgtgcattttgtttttgccactttcattctgtccaatatattgcagttccaattctctggctcttgggttacctgttagagagcttaatgtttttctacttttctcatgagtttcccatccatttattgctcatcccctgaaacatgactggatagttagctttttaatgcagtgattaatttattttttaattttttaatttttatttatttattttttatttatttatttttttgagacggagtctcgctgtgtcgcccaggctggagtgcagtggcgcgatctcggctcactgcaagctccacctcccaggttcacgccattctcctgcctcagcctcttgagtagctgggactacaggcacccgccaccacacccggctaatttttttgcatttttagtagagacggggtttcaccgtattagccaggatggtcttgatctcctgaccttgtgatccgcccacctcggcctcccaaagtgctgggattacaggcgtgagccaccgcgcccagcctgcagtgattaatttaataaccctcttggctctttatattatatatgttgctttatcctatttgattgaatgtgccgtgcatctcctttgtttcaaatgcttgggacaaaattctgcctttgtttgactgacttttttaatgaccagtcactcattcattattcactgagcagataacctttatcaagtgcctccacacactggcaaaatggctatcatacaaatataaaacctcatgcctcacaatattatgctttagactgagcagagtactcttacgtccactctctcgtacaacctccaacagcaattatagaagtagacaatgctgctattgttatccctaatttatcaatgagggaattttaagattcaaaaagtcaagtaaccaatttacctaaggtcattcatgactaatgagtgagagtcaggactagaatgcaggtcttctgagctcctgtcttagtcaattcgggctgctataacaaaaataccatagagtgggtggatcataaataacagaaatttatttctcacagtttgggaggatagaaagtccaaaatcaagacactggcagattcagtgtccagtgagggtctgcttccccatagacggtcctttctgactgtaagctcacatggcagaaggggtaaaggatctctctagggtctcttttataagggcactaatcctattcatgagagcactcctcttatgaccttatcacctcccaacagccccacctcctaatatcatcaccttggaggttaggattttaacatactaattttgaagggacacaaacattcagtccgttgcacatcaactacagggctgtttccactggaggtgcgtggcttctttaccagtttttgctaggaaattttagtttaaaggagaagctcaagttgatatttagaagctagtggtaatgaaaaagcagggagatgactcccaggcttaagcagacaaacctatcaacctatgtaggttcatattctagataatttttaagaagaagtcgattgttcaagtttttttaaatcaaaattttattttgaaataattgtagatttacacgcatttgtaagaaataacacagagagatctcgtgtactctttttattgtttgtttgtttttgagacagagtctcgctctgtcacccaggctggagtgcagtggcgccatctcggcttactgcaacctccgcctcccaggttcaagcgattctcatgcctcagcctcccaagtagctgggactacaggcaaatgccaccatgcctggctaaatttttttgtattttcggtagagatgggttttcaccatgtaggacaggctggtctcgaacttctggcctcaagtgatctgctcgccttggcctcccaaagtgctcatgtactctttacccagtttcccccaacgataacaaaactatagtacaacatcacaatcaagatgttggcattatcacaatcaagacatagagcattgcatttctgtcaccacaagtattcctcatgtttcctttgtatagccctcacactcttctctcccactctcagctcctccttaaaccctgacaaccgcaaatctattaccaatttctataattttgtcatttcaagcatgtcatataaatgtgatcaaacagtatatagcttttgagatttggaatcatacagtacataactttttgagattggctttttttgagacagggtcttgctctgtcacccaggctagagtgcagtgaagctgatcatagctcagcctcagccccccaggcttaagcgatcctcccacctcaactccccgagtagctgggaccacaggcatgcaccaccaagcccagctaattttttaatttttttgtagagatggtctcaaactcctggactaagcgatcctccctccttggcctcccaaagtgctgggattataggcatgagccaccacacctggccaagattggttcttttcacttagcataattctctagagattcatcaagtcattgtttgttacaaaaggacaaatattgtatccttctatttatatgaagtacccagagtggtcaaattcatagagatggacacctgcaggggaggctccccaggaagagctgactgggtgtttaatggcctcttcttgcaggctcaagattgaccttagcttggagtcactgggcttgagcttctatttcccagtcagggttgttcactcagttttacatgagaaaatactcagtgtttgaagaatccagcaaaattactcaaactcagtgtttatggaagggaataaaatagtaaggcatttacattttatatctccataaacaagcaaaagtgtctatctctttcagacaacaaacatgtcatttaattatctccataataaaaaaaattatttaataaacaattgaaaaaaaaagaaagtaaagtggtagtcaccaaggactggggttattacataatgggtacagatctttagctttgcaagatgaaactggttctggagatggatggtagtgatgatagcacaacaatgtgaatgtacttaacgccactaaactgttcacttaaaatgattaagatggttaaattttgtgctatatgtattttaccccattttttaagtcatagaaaagaatctttgtcaggtatcgtaacatttctgtcatctcagtgttggcatcaattcattgtcttttttcgttatttgagatcttcctgattattggtataatgagtaaatttgttaaacctggacaatttcatattttgttctgagactctggatctcatttaaaccttctgttttaacttggtttctctgacctgctttagcaagggagtgggcccagccttgttacttccaggtagaagtagaaacaagcctaagtttctaacttgacctccatcattgatactcaaggtagaggactcctttttactactggtcccttggctagagacagcagacttttcttggggcttttttctttctttttctttttgggtctatgtctgttggcatctctagcaccaagtttggggtatatgaagcaaaaagaaaacccagagaacttatcactgtgtcaatccttggctccaaggtcttccctttctctacacctttcagaggtttcttatgtttgttttatgtataatgttcaagagttagttttatttagcaggaagaatagggataagtacatttattccatctcatggaagtggaaatttcttggttcatttttaagaatatacaaagacttaaataatggtgggggggaaacctacacttaaagagaagggacaaacctaatcctcacagctgatgtcagagtcacagagtcacaaaggcgttttgtaaccaagaagcccagaagaacacagactctttccttttacaagggaagctaaggtgattcaaactactgagctacattctctaagagtttgcttcccaaagcgtgatcagcatcccctaggagcttgttagaagcatggaatcttaggccccagacctactgaatcagtctgcgttttaactatacttccggccgggcacggtggctcatgcctgtaatcctagcactttgggaggccgaggcggatggattacttgaggtcagagttcaaaaccagcctggccatcatggtgaaaccctgtctctactaaaattacaaaagttagccgggcgtggtggtaggcgcctgtaatcccagctacttgggaggctgaggccgaagaattgcttgaacctaggaggcggagattgcaatgagccaagatcacaccactgcactccagcttgggcaacagagtgagactccatcttaaaaaaaaaaaaaatatatatatatatatatatttccaagtgtcttgtatgcacattaaagtttgagaaggtcatttatcagtatcttttgtctcttgtttggccttctacttgttcaatttcatctcagttcctacttctgccaatcttatataagttcatagattaggcaattgggatctaaaggaaatataaggtaaagcttcattcaatgactgagaaaatttagaactggaaactaatgatctttgcagttacctaatttaagctcattattttgcaaattgaggcattgaaaggttaaatatctgacacaaggtcataccactatataatggcaaagctaaaaattgcagccgtgttatttcttcataggacaatggtccttgggttttctttcatctattttttaataaaatttttttaattgagaggaggtcttactatgttgcccaggctggtctcaaattcctgggctcaagcaatcctcctgccatgtcctctcaaagtgctgggattacaggtgtgagcccctgcacccagccttctttcatctaaatcttcctccttccaagcctcacgtctccctgagactggaattgaggttcatacaaagccatctttgagtcagactttgatattgtgtctctcctacagctttgtagtttcctaattggtctctggctctttcttctcttctccattttttcctgttcatccctatcaaatatatctccgtaaaacacaacttttgctctatcactccctttccctcaaatcttttaacaactctgtatttcccaaatccttacctagacccttaaggctatctatccataacctcattcaacccccaaaacaagacagagtttttcccaggcaatagtcaatattctctttatcatcaaccttcacctccttctctcccttcttcttagaacaaagcagaatcttccctgaagaaaacgtgtccctcactacgaatttttatggaggtctcatcttttccaactccctttttctcagcagaagggactaaattacctggatctttgctccatggtggcactttgtactatttatataccaccttcctacggcttctcttcacttaaaacctatatctcttcatcaccaatgttgtcatgtcctggacccaccttttccttccttggtaacttcattgttatttattatcctaagtgactttggcatccatgttagcaattcttgtacctcacagtttccgtttttcactttttagccactgtctacctcccatataagccacccactgtggcactgctccatcttcaagattggtaactaacgcaacacttttctattgagtctaatctcccttacttccccatatctattctctgttctcacttgaacttcaaatcactcgtcttttcccactctattatagtccagtctaactaccttttttttctttttctctttcttttcctttctttctttctcttttctttatttctttatttgcttccttccttcttccctcccttctttcctccccttccttctctctttctctcttcttttgattattcctgctgtttcatttttttccaaacctggtaccttgccaccatcagttcttctgctcctgatcttgagcagcagaagcactaaagaaagttacagaaccatctagatctggcccagtacagattcattctgttaagctttcagtgggttctcattgctgctcagaaattcttttattcttgtcaactttttggcaaactcaagtaaagtggctgcttcaaaccttttctaatctcgtaaaaacttagacctacctcattccccattagatgatctcatcatatcatttcagttgagaagatcaagggcatcacatatgagatccctcattggcccatgtctcaaccataacattctaccactgtacctacctactcacctttcctcttttttcaaaagaaattttctcaaccttgcactgtcagttcaatccccttctacttcctgaggcattttactgcctgtccatcatttttactctctgcctacagatggttccattctgctttcaagaatgcataagtctcaaacaaatggaaatatataccatgttcttggacaggaaagccctaacagtataaagtcagtttccctaaattcaatgcaataaattcagtcaaaattaaaatctcaataggatttttaatgaaacttgatgattctaaaattcttccctaaaagaaaatgaaccaaaacattttttgtaaaagaacaaggaaggacttgccttatcaaatacttttaaaactataaaatgatattaattttaaaagtatggcattagtgcaaaaatctacaaagagattaatagaacaggactgagcccagaaggagatccacatatctatgagaattttgtatgcaatggaaaaggtatatcacatcactgagggaacaattggtaaaatggtattgggacaatttaaaaagcaaagttacgtccttatttttaaactgaggggcgttatagcatagtggttaagagaacagactttggagccacataaccagttcaaataaattctggctacaccatttattagctgtatgactttggtcttattaattaattatgtatacctctgtatcctcatctgtaaaataaatataataataatctcagcactttgggaggcaaaggcaggagtatcgcttgaggccagaagttcaagaccagcctggccaacatagcgagatcttgtctctatgaaaaataaataaataaataaaagctaaaaaaagtgcctaccttacagtattattagtattaaataacttaatatatataaagtacttatagcagcacatagtaagtactatataagtgatagtattatttttttgccttataccatgcacaaaaataaagtccaaaaggaagaaataaagaaaatccagatagattaaagagctaaacataaaatcaaagctataaaagcattaggaaaaaacagaggaaagcatttttttaaatcatggaatggagaggacccactcagaagctgtataagaaacaaatagttttggttacatgaattaataaatagcacaagataccacaaaacattttaggcctggtggagtggctcatgcatgtaatcccagcactttgggaggccgaggtgggaggttcacttgaagccagaagtttgggaccagcctgggcaataaagtgacactctgtctctatgaaaaaaaaaaaaacccataagttttgtgggtttttttttgaaatggagtttcactccgtcacccaggctggagtgcaatggcatgatgatggttcactgtagccttgacctcctgggctcaagagatcctcccacctcagcctcccaagtagctgagactacaggcacatgccactacacccagctaattttttgtatgtttggtagagatgcggtttcaccatgtctcctaggctggtctcaaccttctgagctcaagcaactcaccctccttggccttccaaagtgctgggattataggcatgagccaccacacccaggcagatatgtattttatactttgggttataatacaatattactttattttattgttcatattgttctagctttgaaaaagtctggcagcttcccagaaggttaaacatagttaccctgtgacccagaaattccactggtaggtgtatacccaagagaaatgaaaacatgtgtccaaagactcatagcaaatgttcatagcaaagttattcatatagcccaaaatggaaacagcctgaatgtctgttagccaatgaatgggtaaacaaaatgtggtatttccattcaatggaatactatttgtccattgaaaggaatgaagtactaacacgtgctataacatggataaaccttgaaaacatggtaagtgaaagatgtcagtcacaagggcccacatactgcctggccccatttatcttaaatgtccagaaaaggccaatctataagagacagaaatgagagtagtggttgcccagggcttagtggggtaggggggcaggttgagaggaaatggaaggatattggctgggggcagggggaatatggagccaatgggcatgggctttccttttggaggaatgaaaatattccataattgattgtgatgatggtggcagaactctgtgaatactgtgaatatactaaaaaccaccgtattgtacactttagataaactatggtattttatttaattgtatcttaataaagctgatgcacatactatttactttgggaatctatggagagcctaaaaggacaggcatttgtgctccagaatacctacgattcagttagagatctacgtggctgccatatgtattaagatgttgaggacagagaaaactggtttaaaatatgtggccccaaaaaccatcagagcaaacacctcagtttgctgacattgatttgtattacacgtaggcaagtccatgtggctttcaggtcagtagctgtgtggatgcatttctttattgaggattaatgattttcataagcaatgctgggcatgagggcaactaatgcaaattaaaataaaactcgagtgttccctaactcattggatgacaccatcattcttctggttgcccaagccagacatctaggagtcatcctcagcacctccctcactcccacttctaatctatcaccaagtactatcaatcaatttgacctcccaaatatctctcaaattcatctacttcctcctatctttcaccatcagtaacctagttcaagttacacaccttttatcttagctagtttagtgatctcaggaaccttttaactggcctcacatctactcttgctttcttccttcctttctttgcccagcaaccaaggtgatcttttacttttttttttttttttttttttttttgagatggagtctcgctctgtcaccaggctggagtgcagtggtgcaatctcggctcactgcaacctctgcctcccaggttcaagcgattcccctgcctcagcctccccagtagctgggactacaggcacccgccaccacgcccagctaatttttgtatttttagtagagatgaggtttcaccatgttggccaggatggtctcgatctcttgacctcgtgatccgcccacctcggcctcccaaagtcctgggattacaggtgtgatccaccatgcccagccaatcttttacatttttgagtatgcatgaccttttgaaatcctctttagtagtttcccattgctcttaaaataaagaccaaaatcttgaatgtggtatacaagatcctactaacctatctgtcctcatcttgagccactctttccctcacattctgcactgtcagccacactttacaagaccacaaattaccaccgtctaggcaaatatgatggtctcttttccctggccttcgttattgaccactgcctccttattgaaattctgttttcctttgtcctttattttctcgccactcctctgcgttcttttccctcttaccacccaactatgaacatttccaatattctctactctttgctactctgtattctgtactctgtcctttaagtgaattaatacactttaactattacctgagttccaatccatatctgcaacagcctgcttatctccagagttacctcaagccaacttgtttaaaatagaacttattgttgtcccttatccccagaaacatgtccttcaattttttctttcagtgatgccagcattctttcagccattcaaactacataccttagagccattttcacttgacctgtcattccccatatcaaatcagttaccaaattctattgattcttcctttaaatgattcttacatccgtccatctaaattgtcactattttagttctgaccctcatcacttcattcttagatcacacaactccttttattttattttattttatttttatttatttatttttttgagacagaatctcgccctgtcgcccaggctggagtgcagtggtgcgatcttggctcacttcaagctccgcctcccaggttcacgccattctcctgcctcagccttccgagtagctgggactacaggtgcctgccaccacgcccggctaatgttttgtatttttagtagagacaggatttcaccatgttagccaagatgttcttgatctcctgacctcgtgatctgcctgcctcggcctcccaaagtgctgggattacaggcacaagccaccacgccgggcctttattttattttttgagacggagtttggagtttcactcttgttgcccaggctggagtgcaatggcacaatcttggctcaccacaacctccgcctcctgggttcaagcgattctcctgcctcagcctcccgagtagctgggattacaggcatgtgccatcacacccagctattttgtatttttagtagagacggggtttctccatgttggtcaggctggtctcgaactcccgacctcaggtgatctgcccgccttggcctcccaaagtgctgggattacaggtgtgagccactgcgccaggccataactccctttaaacacgtctccctgtctgtgttttcccacacggaggtctgttctaaacaccactggcatttctatcttattaaaactacactttcatcatatcactctccttctcaaaaagtttcagtgccttcccgttgccagcaggataaatttcaaaatctgaagcctgtaatgcaaaaacccttaacactccagcccacaagatgttagcaaacgttccacataccctggattagacaaagttccatggtttctttactgtaaaacttccctaaactttcagtgaactagtgtgcattataatgctccaaaagggtgatatatagaatgcggcatttccaaaatgtatttgactaaagaactctattttcatagaccatctgttaacatttctcatgacactagtgttctgaggaagaacattgaggaaaggcttaggaagctccatcctacatttccagtcttatttcccgttaactcctctacataaatcgtctgcttaggccaaagaactcttggtcttcctaagacatgcttgttctcaagtacaatccaagtcttcatttattctgttctacccacatggaatgcccttctctttctctgaatatctatatttttctttttaattgagatttagttcatatatcataaaactcacattaaggtatacagttcagtgagttatagtatattcaaaagattgtgcaaccatcaccattatctaattctagaacattttcatcatccccaaaagaaactctatacccattagcagtccttccccatacctcccttccccagcccctggcaaccacaaatctcctttctgtctctatggctttgcctattctgcacatttcatataatctctgtatatgtagatcctactcatctaccctaagatcatgtttgtttgtttgtttaagtcatttttttcattcacaacattaaaatcacaacactcataccctgtatcagacactgtgccaagcaaaggcaaatgtcattttaccttcaaggggctccctgcctagtgggggagacaggcagtacagtgttcaaagtactattatggtgctgtgaacaaagtagcagaggggcaaagaggtttgagcaagaaattgtggagagccagggaaatcctcactgaggaggtggcatctgactggatattgattcatttgttcattcattcattcagcaaacatctgttgtgcctcttatgtgccaggcacagtgctggactctgaagatacaaaaatgcacaggaaaaattccctgtacctcaaggaactcaatagtctggaggagataaatacatagcatttcaaaacaatataacataagttatattagaggaatggaaagctcactgtgggaacagacaactaactgttcttgtgaatttgaagaaaaagtataagtctatgaagtggacaaggatgaggagtagtgtttcaagcagagactagaccgcctctgactggaatatcctagtgctcatttctttaactgaatgagagcacctaatgtttgtgtctcttaatcacataccttgtgaagtcgtctttacatgtggatgccttgtgtccccaaaagcattgcacaacctttaggataaaagttttgtcttttccctcttagtgccctcattatcacagtgttttatgtatagtaatttctttttggatccaaatgaatgaaaggatgacagctgagacagcattcttgacactctcaaaaagctgctgcctaatgtgtctcctatcacatttctcccttctggggctttaacatgaatgctttctttgtgttccatctcctatgcaagaaccaagaaagtagcttcttagactaatacttttcactattgcaaagtattgtgaagaagcaaatataatcttgtgattagtcatgttaaagaccactgataaggctaagggaccatcttagaaatgtgtgctgtgttcatagctaggtagatatcgttaactctgaagatgaatataatttctactccaaatatggactaattctggtgacagaaattaagaaattcaataaaactgcttcttgacaaccttatccgaaaagtagaggtaggtattagggaggtaattgactgaagacagaatcaagggaagccccaaacagtatgcaagtttttctcgtgcctcaggaagattaggaatctttctaattctttccttcagtcagagaggacctcggtttacgtctcttcatgagatcttgctatggaacattctacagctgacaaaccttcaaagtgctctcctcctgcactctccaggagcacagaccttcctaaacatcagcagagctcctattgtttgtttagtaataaagggacatagcatggatacaggtagtgccacaatgaactgtgacagtaataactgcaaaatttctgttcttggattatagaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcaggtaaggagggagagggctagggcagatgacatgacctagggggcaagaggttatggctgggctctccacaaggactcaaccccatcctccttggctaggaaaggatcttgctcattgttcctctcaatggttccacataacttcaagaatcaggagaccataaacagtaattccttagagcaaaaaccaagaaggacagagaacagggggaaatttaaggatagcaaatggaatctaattaagaggaatgccaagagtgagctctggaaagatgcatcactgtcagtgccagtgcatgtgggaaaggactggcctctgctcaaagcaataactgttgaaaaaggcattttctccaggaactattctcagttgcagagttctgggccattggctaaccaggagaggtttggtagagaaaaagccttgttaccaaataagagcaaaggatattttatagttaagtatcttctcccttataataggggattccttttcctcaagagaggactgtattttctccccaaatctgagatgcttcagatctccgaaggtaacggttagactttcatgccatcaccgtgggtctgggaagctttcccacatttctttttcccctcaagaaatctatttgttgttctctttcccagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 4689 - DNA, 26358 bp, human
ggcacagcagccaggctgccggagagctgatctcggggattcgggtgcggagcccttggcctggaggcgatatgggtggtccgtggcccggttcagtcgcttgcagcagcccggggaacaggtgaggccgcctgccccggtctctcatcctctagctgcccataccttgcccccatcctaacccctcccaatcccaggctcctccactccccagccagtggcccccatccctctcaaccccatgttctccatcggtacccctgacccccgatcctcccccgcttctgttctcccttctacctcctccctaaatcccgcatccctaacatcctcccgcccatggtccctctatttccacagcccatcccgcatgctcatcaaaatacccctattgagggcccccagccccatcccgggattgcacattgccagtcccccctcccctgcagtgcagccccatcccccttccatcatagcatctcatagccaggctccctcccccactatctgcagcccccccacccaatggaggcctttatcctatcctcccccattccagtgcaactccatcccccaatccattccaagccctcgtagcccccaatactgcagttctcaatattggtccattcctgcacaatgccccgcgcccagcaccgctgcagccccaaaagtaccccgagatgccattctcatccccggcattgctgcctccccttgtcttctcccaaattgcaagttggaccaggatggagatcttggccttggggattcacagtgggtcctagggtacagagggcgtttgggggtcggtccgattgtctaggtgttcacgggggaggggctgcagggaattgactcaaaggagaatttggcatttggcgccgaagggttactggagaggagggcatcccgaaagggttaatggaatttgtgggttgggggcagcaccgagggggttaatgtgggggggttgctggtggggaagctgtgtgaatgagcggtctgtgccctggagttgccatggagacggtgaatggggggattgtgtgaactcagctgcggactatgccccccccaatacacacacccacccactccctcctgccccacctccctactcctaccccttccttccccttcccctcctccccacacccgggtgcattctgggcagtgtctgggatcttaccccccatactttgctccccatttcctcatttcctctgagcccccacccctttagccactttacccgccctccctcctcttcctttttcttctctctctctctctctctctctctctctcacacacacacacacacagacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcagggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggtgagtgctgcggccaggcactgtgccctccctgcctcccgcctgccctgctgtgtttgtggcttgcatgtggttgtgtgccctgcagcatgcatctgtctgtctgtgaaaatgcttctaaccatcactctgcttggcctcccacccccctccctgttcttccctctcccagcattgtccgagctcccatgtgtgagtgacactgttgccaggaggggcctggcccggcctgagagctctgacgggtctcggtccagtgctggatgggggtcccctgggggagtatgggtcacggctggcagctacccgcgggaggatgctggctccaccaggcccccctgttgccattccacctgcttcgaaaggtggtaggtgtgtgtggccaagggcactgggtgtgtggggggtggggcagcaagcctggtgggtgatgcttaggtgcctcctctttcactagctgatgcctcctcccgcgggggtcacactaaggtaagtgacagaaacaaggagatggtgggacaggctctctgccatgtgccgcctgcagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtggaaaaatcacagcttgatccctacaaccctctggcaagctgggagtttgttttcctttgatgtcctagggcagagtttctcagaatggggttgccaggatttctgggatggggtgctccttactgaataagaatttctgggggcagagcctggaaatctatatgttgaacatgagccctgagcgcttctaatgcacacccgagcatggaatgagacccgctgctgtagggatagtatttcaccacagccccataccccacccaggacctcacacaccataggcaattgatgttttttgtgtaattcagaagcatcatggtgctgcagaaagagtacaggtctgggaagcacaaggcctgagtcccagctctgctgccaactcacagtgagaccttaggcaagtcttgtccttcaagaacctctgtttccacatctgaggttggtagggtacagttctggccttagcattccattagcctgtaaatgaattcaggaggaaggtctcttaaacctgcaggagaggccgggcgtggtggctcacgcctgtaatcccagcactttgggaggccgaggcaggtggatcacgaggtcaggagatcgagaccatcctggctaatacggcaaaaccccgtctctactaaaaaatacaaaaaattagctgggcgtggtggcgggtgcctgtagttccggctactcgggaggttgaggcaggagaatggcatgaacccaggaggcagagcttgcagtgagccgagatcgtgccactgcactccagcctgggcgacagagcgagactccatctcaaaaaaaaaaaaaaaaaaaaagaaagaaaagaaaagaaaaaaacctgaaggagagatggcattcacattaaccatttcttaggaagaatgatcgcccagtaagagccttgggctgtccagtccagccctgagagtgtggccagagagcagactggaagccccggctcaaacatgcacatttaccaatcgtgattgttgactgtgggcaaggccatgtgctaggtgttgttgggatgtggagggatgtgaggtagaggaaagatttagaaatgactaaaggcctaatcactgctctgaagaagctcttagccttgtattaaaactcagctggtttggccgggcgcggtggcttatgcctataattgcagcactttgagaggccaagacgggtgggtcacttgagttcaggaattcgagaccagcctggccaatatggtgaaaccccatccctactaaaaatacaggtgcatggtggcacacacctgtagtcccagctacttgggaggctggggcaggagaatcgcttgaacccaggaggtggaggttgcagtgagccgaggtggtgccatcgcactccagcctgggcaacaaggctgaaactccatctaaaaaaagaaaaaaaaaaaactcagctggtttccctaagtcccatgggccaatcaggaagtgggttccagacagtgcaagggaaggcatttggtcatttcactgttcaaattagttccctacccaggacctggtggccatttggaagagtgacaaatcccgcctcttgagggagacccatcctcggaggtcgttagggttgtggtgtgcagaggtctggggaccagcctggctgggatccctcagcggcgcagggtctgggaatggtggtcggcagtcaggctggcctgggtgagaggcatggcggctaggagctgctcaggaagtgccaggctgaaggagcaaaggcatctgtgtgaaggaggctgagacaatgcagcaacccaggaacactttcagagggattcacaagggacttatcttctaagtcagggatgatgggaaatgaagggtttcctggggaagacctgccccatctccccaacaccccaccccatcaagttggaaggaattcgtgtctggggatgagcaattccttcccgtttggtaggctgtccgcagtgtgagggatgatgcccatgtcccattaaggtttctgaggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttcccttccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagagtattggtccagttcacggactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgtcctgtcttcacctctacccacccgccccacatctctaaacaccccacacatgcacagatattccttccagtccactccatggccacacacctatttaccttcatgtgtttacacatccaccccgccatgcacctgcaggaagacggtgatttctcactcacccccataaagtacacacacctagccccacattcacatctccaggcccctcacatgtaaacacattctcctagcactccaggtaactccattcacatggtctctccagaacacatatccacatacccacacggtctgtgtactccacgtctgcaccccgcagatggctctcaccctccgcatgtacacacacacatgctcatatacttctccccatgtctctgtagccacatctacaccgatacccacgatgcatacacacccacactcacactttacccccatatttacagcccacacaaaaacctacaccctgcacatccatgtccacaccaaactccacacatatacaccttaaatgtacataaatattccttccacccaccccccacaaatacctacacacgcccgtatccccctgcacaccctacttccacatccactttacacatccacctaccacacacacctgtccctcactatctcctcagaaacacaaacaaatattccccttccctacacacatatactcttacctgtttgtccacactgtcccaccccacacatacacagatactacacacacaccatatccacatctatatacatcccacacactgcccttatgtcattcccctacacatacattcccccacacacacatccacatatgcatgcacgcgtatacatgcgcacactcttccatatacagcctgtatatgtacacccagcacacacccatgcacttctcccctcaccccaccccacaaatatatacacatccgtgtacatggggctgcatctgtatccatacatgcacacacacctctacccaggcccaaccgcatcccccaagtctccccacacttccttaccccgtatatgcacacgtacacactctttgtactctaagcatgtcccctgcacactcccacccatcacacacatactcccatgcatatgcactcattgccgaaatgcctcctcatatgcacccatacacctccccacccccgcattctctgctgtgcacaagcttgtgtcagtcatttaggctgcccttgaaccctgtaccttccttggtgaccacccatgcctatctatggccaaggtcttgaggtaaacgagtgcctcagagagggtgactaagcacacagggccctgctcatgctcccccaagccccgcatccctgtagtggcatgaagaagccaacttcttcctggaggaagagtttcagcgggagtgtaggctcttggtcaggtctgtaggcatatgggtgctaaaccagcagttaggcgtggcttattccatggctaactaggggacacgaccatatttgattttattttcatttaatttttgagacagggtctcactcttgcccaggccagttttgaactcctgagctcaagtgatcatcctcccacctcaagggccttattttaatttgcttatttatttatttatttatttatttatttatttattatttttattttgtttttgaggcagagtctcactctgtcgcccaggctggagtgcaatggcaccatcttggctcactgcaacctccgcctcccgggttcaactgattctcctgcctcagcctcctgagtagctgggattacaggcacctgctaccatgccaggctaatttttgtatttttagtagagacagggtttcaccatgttggccaggctggtctcgaactcctgaccttaggtgatctgcctgcctcagcctcccaaagtgctgggattacaggcatgagccaccacgcctggcccttaattttctcttgactatattgctttgtcagttccaatctcagaggctccggggctgcatttcacttctgggtgcagttgtatgcccagaacggcaatcttctcttggtttacaattaatactatgtgagataggaagatactcttttggggttcaaactgcagaaatgatgctcctttaaaaaagcaaagtcggtgtccccttcattggcgcccgggagactgaatatggagcatgcaggccattcacgctggcctccccacggtctggtaggcttgggatgttgggatgtcatggttctgctcctgcccctctgtctttctgcatcacctcagacaccatggtgaggctcttgtaagctgttctgtcctgttgaatctcatggtaccatgaaggtggctggaaacccacacactagggctgcacactttctttttttaattaattaattaattaattaattaatttttgagacagagtctcactctgtcacccaggctggagtgcagtggtgcaatcatggctcatcgcagcctcgacctcccaggctcaagtgatcctcccacctcagcctcccgagcagctgggattatggattacaggtgtgcaccaccacacccagctaatttttgtatttttagtagagacaaggtctcactatgttggccaggctggtctggaactcctgatctcaagtgatccacttgccttggcctcccaaagtgctgggattacaggcgtgagccaccgcgcccggctgggctgcacagtttctagagaggaatgaacgcgcaaatgtgatcacaaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaatgagaggataatagagagtcagggagaggaagcagagaggagacagaaggagagacttaggatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactctcccctggaacaatgcacacatgcgtgtgtgcacacacatgcatgtgcgcacacacacacttaattttacagggccgggtgtggtggctcacgcctgtaatcccagcactttggaaggatgaggtgggtggatcacctgaggtcaggagttcaagaccagcctgggcaactaaaccctgtctctactaaaaatacaaaagtgagctgggcatggtggcatgcgcccgtagtcccagctactcaagaggctgaggcaggagaattgcttgaacctgggaggcggaagttgcaatgagccaagatcgtgccactgcactctagcctgggcaacagagtgagactccatctcaaaaaaaaaagaaaaggaaaaagaaaaagaaaagaaaagaaagaaagaaaaaacaattttacagatcccccttaagttcatccatgaaagtcaggttaagaactcgcacttgacagccccgtcatttggataaccagaacagcacatctagggggcaggaacattcttctttgggcttaagcagttgatgatcaaatatcaccgaaaactcagaaggagtcctacactgagatttgctcagaagttcctcaccacttcctgcacacccttcagttcctgttctggaacacaaatataatcaataagcccgtattggatgccgggtacatataagatgtttgtttttgtctcttgacaccagatgtagaacatgggtttgtccctgatgcttgggaattttcttttcttttttttttttaattgagacagagtcttgctctgtcacccaggctggagtgcagtggcacaatctcagctcactgccaacctctgccgccgggttcaagcgattctcgtgcctcagcctctggagtatctgggattacaggcgcgcaccaccacgcccagctattttttttttttttttttttttttagtagaggcgggggtttcgccatgttggccaggctggtctcgaactcccgatctcaggtgatccgccctcctcagccttccaaagtgctgggattacaggtgtgagccactgcacccggcggggaattttcctgtgtagtggggcctttgttgttttgttgcccaaagcatcccagaacaggtggtttgttttggaccccagtcacaggcattcattcactctccttcccatcagctttcctgagcactgaacccatcaggcggttcactctaaggtgcttatcttttttctttctttctttttttttttttttctttttgagacagagtctcgctctgtcgctcaggctggagtgcaatggcatgatctcggctcactacaacctccgcctccccggttaaagcaattctcctgcctcagcctcccaagtagctgggattacaggcgcctgccaccacacccggcatatttttgtatttttagtagagacggggtttcaccatgttggccaggctggtcttgaactcctgacctcaggtgatccacctgcctcggcctcccaaagtgctgggattacaggcatgagccatcacgcccagcctctaaggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacctctcccagaatgccagatattgtgtgcttgtggttggtcaggtttgctgtcatcttcctgagcctgttggagatagcatttcttttttcttttcttttctttcttttttttttttttttgagatggagtttcactcttgttgcccaggctgcagtgcaatggcgctatctcggctcaccgcaacctccgcctcccaggttcaagtgattctcctgcctcagcctccctagtagctgggattacagtcacatgccaccaagcccggctaattttgtatttttagtagagatggggtttctccatgttggccaggctggtctcgaactccagacctcaggtgatctgcccgccttggcctcccaaagtgctgggattacaggcatgagccaccacgcctggcctggagatagcatttcaagcaggactcttcatggagtagggatcattgacatggcatcatccacatgcttcagggccccttaaccagagactcataggatctgagagagcagagagtgatggtcaaatcctccatccaatcacctgaggtcaggagttcaagaccagcctggccaacatggcgaaaccccatctctattaaaaatataaaaattagccaggcatggtggcaggcacctgtaatcccagctactcgcaaggctgagacagaagaatcacttgaacctgggaggcggaggttgcagcgagccgagatcatgccattgcattccagcctgggcgacaagagtgaaactccttctaaaaaaaaataaataaataataaataaatcctccatccagccctttcaggcctttgttcctaacccaggaaattggtacattggagaaatctgctctactacatccaaatgcaggctttgcctgctgattaggccaggcatgtttgacacatttcagtaaatgatgccttggcaaaggctgaagccaagaccactattgcctaaatgaaagaaaaggaaaagagaatacaggggaaggagagaggagggaggactaaaagaaggacagtgatttctgccagagggtcccaaggcttgggcagctgggttggatcatggtcaacagagttggggttttgagggattttttttttttggttgcttttttagagatggagtctcattctgtcccccaggctggagtgcagtggggtaataacagctcactgcagccttcacacctaggctcaagtgatcctccagccccagcctcctgagtggctgggaccacaggcatgcaccaccacaactggctaatttgttttgttttaaaaacaaaaagggacagggtcttgctacactggccaggttggtctcaaacttctgacctcaagtgatcctcccacctcagcctcctaaagtgctgggattacaggtgtgagccaccatgcctggccaagtttttaagactcaaaggagcagcttcaatttctgaatgggccacgcaaaggaaaagctgatttccttgtctggaagagcaagggttccttcttcatcctcatgcaggctttctctaattcattctcatttcctcctctggaacctggggctaaagaggacttgtgactagggcccgggagaaataactaagtactttacatacttaattgtaccagaggtaaattaataacacacttgaagaggatgagatgagctcttttgcagaagctaggtacagaaggacttgagaaagacagtggtgaggtcttgtgactgtttgagtctatttgaattcagcctctgcctatggactgcaaggacgccagagaactccccatgagctctgggagtcttctccaacatggcctctcacaaagttgattccaggtgctgtgaatgagcttttaactggggagtaaaaaatactgatccaagtgtgggtttccaatgtgtaggagcttcacaattacccacctccaaagacttcttccaaaagcctagggcaggagaagacagagccttccaagggacccaaggattcagggaagagagatgaaataaggccgcaggctcagtctaaaatggaagcagagtaggggggaatataggacatctctgtgggatagccagcaggtgggcaggaaggtagtctccatggcaacaagtctccacagcagcaaatcccagcaggtgggtgggaaggtagtctccatggtgacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctttggagagagaagaaaggggaaagagaagtaactatagagctgcaatgtgcccagcatgttatagatgcttatgttcattttatccttgttacaaccctgtgaggtatttttatccccattttacagaagaggacactatggcccagagattttaaattaagtgcccaaggctacatgactaagatgtgatagagccaggattcaaatcaaggaccgtctgactccagggtttccattctatcttgccagatgttagggtaaggtccccaatagtacatcagggcagagaatgctgagttctggacatttgcagtttctgcagtttgtctcccacctggaggcatgcacttcaaatggtctgcagacccctccttccaagctggataacaggtgggaggcagggagctgacccctcctctgttgacgatgctggacattgcagaaaggagcactgctttaagttaactatgtgggaagaactacactgcgtgctcattctctattcccacctcccctgttgaccctgcctgccgtcatcacccaaatcctccatccctctgccttcattgtcttcatgccctttgttgaatccaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactgggtaaggagaaaatagggtttttttcctctttgagaccccagcatgccctcccctctgctcctctagctaaacctcttccatcatatcccttcctaagatattcccaaaatcttgcttggtaccccttcactcatcttcctatctccccttcctgagtctttcatgccatttttccttccttcaaaaatgttgttgaggcttagaactcagttagcatcgggactaggaaggaatgagggttactggaagaactatgggatttagccaggcccagtggctcacggctgtaatcccagcactttgggaggcaaaggcaggcagatcacttgagcccaggagttcaagaccagccacggcaacatagaaagaccctgtctctaaaagaaaaagcattagccaggcatggtagtgcatgcctgtagtcccaggtatttgggaggctgaggtgggaggatcgcttgagccccggagggtgaggctacactgagctgtgatcacgccactgtactctagcctgggtgacagagcgaaaccttatcttaaacacacacacacacacacatatacacacacacactatgggattcaaggttagctggtcacaggctatgtgaaataggaatgcagtgcttcagaaagagccttcagggccaggcgcggaggcttatgcctgtaatcccagcactttgggaggccaaggcaggtggattgcctgagctcaggagttcgaaaccagcctggccaacatggtgaaacaccgtctctactataatacaaaaaatttgccaggcgtggtggcgggtgcctgtagtcccggctacctaggcaggagaattgcttgaacccaggaggcagaggttgcagtgagccgaggttgccccaccgcactccagcctgtgcgacagagcgagactctgtctcaaaaaaaaaaaaagaaaaaaaaagagagaaagaaagagagagagagaaagaaaaagggaagaaagaaagaaagagagagaaagaaagaaagagaaaaaaaaaagaaagaaagaaagaaagaaagaaagaaagaaagaaagaaagaaagagaaagaaaagaaagagaaagaaagaaagaaagaaaaagagacttcgggttcagcaacttctgcttgcttaataaaagaaagaggctttattagggggctcctggcaaaattgggcagctgaaaagattgataaatgctcagtagcatgtgcaaagaaaaagcatctatagccttaatcttaaaggatgagcgccgggaaggaggatataggagttcaagccctggggaagaagcaggtgtgggcagagcaggggaccctgaaaaagatggaaatggtgggaagttctaaactgggaaagaggtttggctgtcagaggaaaaatgctgggccttttcctcatccagatagagtggtgaccccagatttccatgtggtatttcagggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaa

SEQ ID NO: 4690 - DNA, 22914 bp, human
ggcacagcagccaggctgccggagagctgatctcggggattcgggtgcggagcccttggcctggaggcgatatgggtggtccgtggcccggttcagtcgcttgcagcagcccggggaacaggtgaggccgcctgccccggtctctcatcctctagctgcccataccttgcccccatcctaacccctcccaatcccaggctcctccactccccagccagtggcccccatccctctcaaccccatgttctccatcggtacccctgacccccgatcctcccccgcttctgttctcccttctacctcctccctaaatcccgcatccctaacatcctcccgcccatggtccctctatttccacagcccatcccgcatgctcatcaaaatacccctattgagggcccccagccccatcccgggattgcacattgccagtcccccctcccctgcagtgcagccccatcccccttccatcatagcatctcatagccaggctccctcccccactatctgcagcccccccacccaatggaggcctttatcctatcctcccccattccagtgcaactccatcccccaatccattccaagccctcgtagcccccaatactgcagttctcaatattggtccattcctgcacaatgccccgcgcccagcaccgctgcagccccaaaagtaccccgagatgccattctcatccccggcattgctgcctccccttgtcttctcccaaattgcaagttggaccaggatggagatcttggccttggggattcacagtgggtcctagggtacagagggcgtttgggggtcggtccgattgtctaggtgttcacgggggaggggctgcagggaattgactcaaaggagaatttggcatttggcgccgaagggttactggagaggagggcatcccgaaagggttaatggaatttgtgggttgggggcagcaccgagggggttaatgtgggggggttgctggtggggaagctgtgtgaatgagcggtctgtgccctggagttgccatggagacggtgaatggggggattgtgtgaactcagctgcggactatgccccccccaatacacacacccacccactccctcctgccccacctccctactcctaccccttccttccccttcccctcctccccacacccgggtgcattctgggcagtgtctgggatcttaccccccatactttgctccccatttcctcatttcctctgagcccccacccctttagccactttacccgccctccctcctcttcctttttcttctctctctctctctctctctctctctctcacacacacacacacacagacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcagggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggtgagtgctgcggccaggcactgtgccctccctgcctcccgcctgccctgctgtgtttgtggcttgcatgtggttgtgtgccctgcagcatgcatctgtctgtctgtgaaaatgcttctaaccatcactctgcttggcctcccacccccctccctgttcttccctctcccagcattgtccgagctcccatgtgtgagtgacactgttgccaggaggggcctggcccggcctgagagctctgacgggtctcggtccagtgctggatgggggtcccctgggggagtatgggtcacggctggcagctacccgcgggaggatgctggctccaccaggcccccctgttgccattccacctgcttcgaaaggtggtaggtgtgtgtggccaagggcactgggtgtgtggggggtggggcagcaagcctggtgggtgatgcttaggtgcctcctctttcactagctgatgcctcctcccgcgggggtcacactaaggtaagtgacagaaacaaggagatggtgggacaggctctctgccatgtgccgcctgcagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtggaaaaatcacagcttgatccctacaaccctctggcaagctgggagtttgttttcctttgatgtcctagggcagagtttctcagaatggggttgccaggatttctgggatggggtgctccttactgaataagaatttctgggggcagagcctggaaatctatatgttgaacatgagccctgagcgcttctaatgcacacccgagcatggaatgagacccgctgctgtagggatagtatttcaccacagccccataccccacccaggacctcacacaccataggcaattgatgttttttgtgtaattcagaagcatcatggtgctgcagaaagagtacaggtctgggaagcacaaggcctgagtcccagctctgctgccaactcacagtgagaccttaggcaagtcttgtccttcaagaacctctgtttccacatctgaggttggtagggtacagttctggccttagcattccattagcctgtaaatgaattcaggaggaaggtctcttaaacctgcaggagaggccgggcgtggtggctcacgcctgtaatcccagcactttgggaggccgaggcaggtggatcacgaggtcaggagatcgagaccatcctggctaatacggcaaaaccccgtctctactaaaaaatacaaaaaattagctgggcgtggtggcgggtgcctgtagttccggctactcgggaggttgaggcaggagaatggcatgaacccaggaggcagagcttgcagtgagccgagatcgtgccactgcactccagcctgggcgacagagcgagactccatctcaaaaaaaaaaaaaaaaaaaaagaaagaaaagaaaagaaaaaaacctgaaggagagatggcattcacattaaccatttcttaggaagaatgatcgcccagtaagagccttgggctgtccagtccagccctgagagtgtggccagagagcagactggaagccccggctcaaacatgcacatttaccaatcgtgattgttgactgtgggcaaggccatgtgctaggtgttgttgggatgtggagggatgtgaggtagaggaaagatttagaaatgactaaaggcctaatcactgctctgaagaagctcttagccttgtattaaaactcagctggtttggccgggcgcggtggcttatgcctataattgcagcactttgagaggccaagacgggtgggtcacttgagttcaggaattcgagaccagcctggccaatatggtgaaaccccatccctactaaaaatacaggtgcatggtggcacacacctgtagtcccagctacttgggaggctggggcaggagaatcgcttgaacccaggaggtggaggttgcagtgagccgaggtggtgccatcgcactccagcctgggcaacaaggctgaaactccatctaaaaaaagaaaaaaaaaaaactcagctggtttccctaagtcccatgggccaatcaggaagtgggttccagacagtgcaagggaaggcatttggtcatttcactgttcaaattagttccctacccaggacctggtggccatttggaagagtgacaaatcccgcctcttgagggagacccatcctcggaggtcgttagggttgtggtgtgcagaggtctggggaccagcctggctgggatccctcagcggcgcagggtctgggaatggtggtcggcagtcaggctggcctgggtgagaggcatggcggctaggagctgctcaggaagtgccaggctgaaggagcaaaggcatctgtgtgaaggaggctgagacaatgcagcaacccaggaacactttcagagggattcacaagggacttatcttctaagtcagggatgatgggaaatgaagggtttcctggggaagacctgccccatctccccaacaccccaccccatcaagttggaaggaattcgtgtctggggatgagcaattccttcccgtttggtaggctgtccgcagtgtgagggatgatgcccatgtcccattaaggtttctgaggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttcccttccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagagtattggtccagttcacggactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgtcctgtcttcacctctacccacccgccccacatctctaaacaccccacacatgcacagatattccttccagtccactccatggccacacacctatttaccttcatgtgtttacacatccaccccgccatgcacctgcaggaagacggtgatttctcactcacccccataaagtacacacacctagccccacattcacatctccaggcccctcacatgtaaacacattctcctagcactccaggtaactccattcacatggtctctccagaacacatatccacatacccacacggtctgtgtactccacgtctgcaccccgcagatggctctcaccctccgcatgtacacacacacatgctcatatacttctccccatgtctctgtagccacatctacaccgatacccacgatgcatacacacccacactcacactttacccccatatttacagcccacacaaaaacctacaccctgcacatccatgtccacaccaaactccacacatatacaccttaaatgtacataaatattccttccacccaccccccacaaatacctacacacgcccgtatccccctgcacaccctacttccacatccactttacacatccacctaccacacacacctgtccctcactatctcctcagaaacacaaacaaatattccccttccctacacacatatactcttacctgtttgtccacactgtcccaccccacacatacacagatactacacacacaccatatccacatctatatacatcccacacactgcccttatgtcattcccctacacatacattcccccacacacacatccacatatgcatgcacgcgtatacatgcgcacactcttccatatacagcctgtatatgtacacccagcacacacccatgcacttctcccctcaccccaccccacaaatatatacacatccgtgtacatggggctgcatctgtatccatacatgcacacacacctctacccaggcccaaccgcatcccccaagtctccccacacttccttaccccgtatatgcacacgtacacactctttgtactctaagcatgtcccctgcacactcccacccatcacacacatactcccatgcatatgcactcattgccgaaatgcctcctcatatgcacccatacacctccccacccccgcattctctgctgtgcacaagcttgtgtcagtcatttaggctgcccttgaaccctgtaccttccttggtgaccacccatgcctatctatggccaaggtcttgaggtaaacgagtgcctcagagagggtgactaagcacacagggccctgctcatgctcccccaagccccgcatccctgtagtggcatgaagaagccaacttcttcctggaggaagagtttcagcgggagtgtaggctcttggtcaggtctgtaggcatatgggtgctaaaccagcagttaggcgtggcttattccatggctaactaggggacacgaccatatttgattttattttcatttaatttttgagacagggtctcactcttgcccaggccagttttgaactcctgagctcaagtgatcatcctcccacctcaagggccttattttaatttgcttatttatttatttatttatttatttatttatttattatttttattttgtttttgaggcagagtctcactctgtcgcccaggctggagtgcaatggcaccatcttggctcactgcaacctccgcctcccgggttcaactgattctcctgcctcagcctcctgagtagctgggattacaggcacctgctaccatgccaggctaatttttgtatttttagtagagacagggtttcaccatgttggccaggctggtctcgaactcctgaccttaggtgatctgcctgcctcagcctcccaaagtgctgggattacaggcatgagccaccacgcctggcccttaattttctcttgactatattgctttgtcagttccaatctcagaggctccggggctgcatttcacttctgggtgcagttgtatgcccagaacggcaatcttctcttggtttacaattaatactatgtgagataggaagatactcttttggggttcaaactgcagaaatgatgctcctttaaaaaagcaaagtcggtgtccccttcattggcgcccgggagactgaatatggagcatgcaggccattcacgctggcctccccacggtctggtaggcttgggatgttgggatgtcatggttctgctcctgcccctctgtctttctgcatcacctcagacaccatggtgaggctcttgtaagctgttctgtcctgttgaatctcatggtaccatgaaggtggctggaaacccacacactagggctgcacactttctttttttaattaattaattaattaattaattaatttttgagacagagtctcactctgtcacccaggctggagtgcagtggtgcaatcatggctcatcgcagcctcgacctcccaggctcaagtgatcctcccacctcagcctcccgagcagctgggattatggattacaggtgtgcaccaccacacccagctaatttttgtatttttagtagagacaaggtctcactatgttggccaggctggtctggaactcctgatctcaagtgatccacttgccttggcctcccaaagtgctgggattacaggcgtgagccaccgcgcccggctgggctgcacagtttctagagaggaatgaacgcgcaaatgtgatcacaaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaatgagaggataatagagagtcagggagaggaagcagagaggagacagaaggagagacttaggatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactctcccctggaacaatgcacacatgcgtgtgtgcacacacatgcatgtgcgcacacacacacttaattttacagggccgggtgtggtggctcacgcctgtaatcccagcactttggaaggatgaggtgggtggatcacctgaggtcaggagttcaagaccagcctgggcaactaaaccctgtctctactaaaaatacaaaagtgagctgggcatggtggcatgcgcccgtagtcccagctactcaagaggctgaggcaggagaattgcttgaacctgggaggcggaagttgcaatgagccaagatcgtgccactgcactctagcctgggcaacagagtgagactccatctcaaaaaaaaaagaaaaggaaaaagaaaaagaaaagaaaagaaagaaagaaaaaacaattttacagatcccccttaagttcatccatgaaagtcaggttaagaactcgcacttgacagccccgtcatttggataaccagaacagcacatctagggggcaggaacattcttctttgggcttaagcagttgatgatcaaatatcaccgaaaactcagaaggagtcctacactgagatttgctcagaagttcctcaccacttcctgcacacccttcagttcctgttctggaacacaaatataatcaataagcccgtattggatgccgggtacatataagatgtttgtttttgtctcttgacaccagatgtagaacatgggtttgtccctgatgcttgggaattttcttttcttttttttttttaattgagacagagtcttgctctgtcacccaggctggagtgcagtggcacaatctcagctcactgccaacctctgccgccgggttcaagcgattctcgtgcctcagcctctggagtatctgggattacaggcgcgcaccaccacgcccagctattttttttttttttttttttttttagtagaggcgggggtttcgccatgttggccaggctggtctcgaactcccgatctcaggtgatccgccctcctcagccttccaaagtgctgggattacaggtgtgagccactgcacccggcggggaattttcctgtgtagtggggcctttgttgttttgttgcccaaagcatcccagaacaggtggtttgttttggaccccagtcacaggcattcattcactctccttcccatcagctttcctgagcactgaacccatcaggcggttcactctaaggtgcttatcttttttctttctttctttttttttttttttctttttgagacagagtctcgctctgtcgctcaggctggagtgcaatggcatgatctcggctcactacaacctccgcctccccggttaaagcaattctcctgcctcagcctcccaagtagctgggattacaggcgcctgccaccacacccggcatatttttgtatttttagtagagacggggtttcaccatgttggccaggctggtcttgaactcctgacctcaggtgatccacctgcctcggcctcccaaagtgctgggattacaggcatgagccatcacgcccagcctctaaggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacctctcccagaatgccagatattgtgtgcttgtggttggtcaggtttgctgtcatcttcctgagcctgttggagatagcatttcttttttcttttcttttctttcttttttttttttttttgagatggagtttcactcttgttgcccaggctgcagtgcaatggcgctatctcggctcaccgcaacctccgcctcccaggttcaagtgattctcctgcctcagcctccctagtagctgggattacagtcacatgccaccaagcccggctaattttgtatttttagtagagatggggtttctccatgttggccaggctggtctcgaactccagacctcaggtgatctgcccgccttggcctcccaaagtgctgggattacaggcatgagccaccacgcctggcctggagatagcatttcaagcaggactcttcatggagtagggatcattgacatggcatcatccacatgcttcagggccccttaaccagagactcataggatctgagagagcagagagtgatggtcaaatcctccatccaatcacctgaggtcaggagttcaagaccagcctggccaacatggcgaaaccccatctctattaaaaatataaaaattagccaggcatggtggcaggcacctgtaatcccagctactcgcaaggctgagacagaagaatcacttgaacctgggaggcggaggttgcagcgagccgagatcatgccattgcattccagcctgggcgacaagagtgaaactccttctaaaaaaaaataaataaataataaataaatcctccatccagccctttcaggcctttgttcctaacccaggaaattggtacattggagaaatctgctctactacatccaaatgcaggctttgcctgctgattaggccaggcatgtttgacacatttcagtaaatgatgccttggcaaaggctgaagccaagaccactattgcctaaatgaaagaaaaggaaaagagaatacaggggaaggagagaggagggaggactaaaagaaggacagtgatttctgccagagggtcccaaggcttgggcagctgggttggatcatggtcaacagagttggggttttgagggattttttttttttggttgcttttttagagatggagtctcattctgtcccccaggctggagtgcagtggggtaataacagctcactgcagccttcacacctaggctcaagtgatcctccagccccagcctcctgagtggctgggaccacaggcatgcaccaccacaactggctaatttgttttgttttaaaaacaaaaagggacagggtcttgctacactggccaggttggtctcaaacttctgacctcaagtgatcctcccacctcagcctcctaaagtgctgggattacaggtgtgagccaccatgcctggccaagtttttaagactcaaaggagcagcttcaatttctgaatgggccacgcaaaggaaaagctgatttccttgtctggaagagcaagggttccttcttcatcctcatgcaggctttctctaattcattctcatttcctcctctggaacctggggctaaagaggacttgtgactagggcccgggagaaataactaagtactttacatacttaattgtaccagaggtaaattaataacacacttgaagaggatgagatgagctcttttgcagaagctaggtacagaaggacttgagaaagacagtggtgaggtcttgtgactgtttgagtctatttgaattcagcctctgcctatggactgcaaggacgccagagaactccccatgagctctgggagtcttctccaacatggcctctcacaaagttgattccaggtgctgtgaatgagcttttaactggggagtaaaaaatactgatccaagtgtgggtttccaatgtgtaggagcttcacaattacccacctccaaagacttcttccaaaagcctagggcaggagaagacagagccttccaagggacccaaggattcagggaagagagatgaaataaggccgcaggctcagtctaaaatggaagcagagtaggggggaatataggacatctctgtgggatagccagcaggtgggcaggaaggtagtctccatggcaacaagtctccacagcagcaaatcccagcaggtgggtgggaaggtagtctccatggtgacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctttggagagagaagaaaggggaaagagaagtaactatagagctgcaatgtgcccagcatgttatagatgcttatgttcattttatccttgttacaaccctgtgaggtatttttatccccattttacagaagaggacactatggcccagagattttaaattaagtgcccaaggctacatgactaagatgtgatagagccaggattcaaatcaaggaccgtctgactccagggtttccattctatcttgccagatgttagggtaaggtccccaatagtacatcagggcagagaatgctgagttctggacatttgcagtttctgcagtttgtctcccacctggaggcatgcacttcaaatggtctgcagacccctccttccaagctggataacaggtgggaggcagggagctgacccctcctctgttgacgatgctggacattgcagaaaggagcactgctttaagttaactatgtgggaagaactacactgcgtgctcattctctattcccacctcccctgttgaccctgcctgccgtcatcacccaaatcctccatccctctgccttcattgtcttcatgccctttgttgaatccaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctca

SEQ ID NO: 4691 - DNA, 26368 bp, human
cctcggtgcgcgggcacagcagccaggctgccggagagctgatctcggggattcgggtgcggagcccttggcctggaggcgatatgggtggtccgtggcccggttcagtcgcttgcagcagcccggggaacaggtgaggccgcctgccccggtctctcatcctctagctgcccataccttgcccccatcctaacccctcccaatcccaggctcctccactccccagccagtggcccccatccctctcaaccccatgttctccatcggtacccctgacccccgatcctcccccgcttctgttctcccttctacctcctccctaaatcccgcatccctaacatcctcccgcccatggtccctctatttccacagcccatcccgcatgctcatcaaaatacccctattgagggcccccagccccatcccgggattgcacattgccagtcccccctcccctgcagtgcagccccatcccccttccatcatagcatctcatagccaggctccctcccccactatctgcagcccccccacccaatggaggcctttatcctatcctcccccattccagtgcaactccatcccccaatccattccaagccctcgtagcccccaatactgcagttctcaatattggtccattcctgcacaatgccccgcgcccagcaccgctgcagccccaaaagtaccccgagatgccattctcatccccggcattgctgcctccccttgtcttctcccaaattgcaagttggaccaggatggagatcttggccttggggattcacagtgggtcctagggtacagagggcgtttgggggtcggtccgattgtctaggtgttcacgggggaggggctgcagggaattgactcaaaggagaatttggcatttggcgccgaagggttactggagaggagggcatcccgaaagggttaatggaatttgtgggttgggggcagcaccgagggggttaatgtgggggggttgctggtggggaagctgtgtgaatgagcggtctgtgccctggagttgccatggagacggtgaatggggggattgtgtgaactcagctgcggactatgccccccccaatacacacacccacccactccctcctgccccacctccctactcctaccccttccttccccttcccctcctccccacacccgggtgcattctgggcagtgtctgggatcttaccccccatactttgctccccatttcctcatttcctctgagcccccacccctttagccactttacccgccctccctcctcttcctttttcttctctctctctctctctctctctctctctcacacacacacacacacagacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcagggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggtgagtgctgcggccaggcactgtgccctccctgcctcccgcctgccctgctgtgtttgtggcttgcatgtggttgtgtgccctgcagcatgcatctgtctgtctgtgaaaatgcttctaaccatcactctgcttggcctcccacccccctccctgttcttccctctcccagcattgtccgagctcccatgtgtgagtgacactgttgccaggaggggcctggcccggcctgagagctctgacgggtctcggtccagtgctggatgggggtcccctgggggagtatgggtcacggctggcagctacccgcgggaggatgctggctccaccaggcccccctgttgccattccacctgcttcgaaaggtggtaggtgtgtgtggccaagggcactgggtgtgtggggggtggggcagcaagcctggtgggtgatgcttaggtgcctcctctttcactagctgatgcctcctcccgcgggggtcacactaaggtaagtgacagaaacaaggagatggtgggacaggctctctgccatgtgccgcctgcagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtggaaaaatcacagcttgatccctacaaccctctggcaagctgggagtttgttttcctttgatgtcctagggcagagtttctcagaatggggttgccaggatttctgggatggggtgctccttactgaataagaatttctgggggcagagcctggaaatctatatgttgaacatgagccctgagcgcttctaatgcacacccgagcatggaatgagacccgctgctgtagggatagtatttcaccacagccccataccccacccaggacctcacacaccataggcaattgatgttttttgtgtaattcagaagcatcatggtgctgcagaaagagtacaggtctgggaagcacaaggcctgagtcccagctctgctgccaactcacagtgagaccttaggcaagtcttgtccttcaagaacctctgtttccacatctgaggttggtagggtacagttctggccttagcattccattagcctgtaaatgaattcaggaggaaggtctcttaaacctgcaggagaggccgggcgtggtggctcacgcctgtaatcccagcactttgggaggccgaggcaggtggatcacgaggtcaggagatcgagaccatcctggctaatacggcaaaaccccgtctctactaaaaaatacaaaaaattagctgggcgtggtggcgggtgcctgtagttccggctactcgggaggttgaggcaggagaatggcatgaacccaggaggcagagcttgcagtgagccgagatcgtgccactgcactccagcctgggcgacagagcgagactccatctcaaaaaaaaaaaaaaaaaaaaagaaagaaaagaaaagaaaaaaacctgaaggagagatggcattcacattaaccatttcttaggaagaatgatcgcccagtaagagccttgggctgtccagtccagccctgagagtgtggccagagagcagactggaagccccggctcaaacatgcacatttaccaatcgtgattgttgactgtgggcaaggccatgtgctaggtgttgttgggatgtggagggatgtgaggtagaggaaagatttagaaatgactaaaggcctaatcactgctctgaagaagctcttagccttgtattaaaactcagctggtttggccgggcgcggtggcttatgcctataattgcagcactttgagaggccaagacgggtgggtcacttgagttcaggaattcgagaccagcctggccaatatggtgaaaccccatccctactaaaaatacaggtgcatggtggcacacacctgtagtcccagctacttgggaggctggggcaggagaatcgcttgaacccaggaggtggaggttgcagtgagccgaggtggtgccatcgcactccagcctgggcaacaaggctgaaactccatctaaaaaaagaaaaaaaaaaaactcagctggtttccctaagtcccatgggccaatcaggaagtgggttccagacagtgcaagggaaggcatttggtcatttcactgttcaaattagttccctacccaggacctggtggccatttggaagagtgacaaatcccgcctcttgagggagacccatcctcggaggtcgttagggttgtggtgtgcagaggtctggggaccagcctggctgggatccctcagcggcgcagggtctgggaatggtggtcggcagtcaggctggcctgggtgagaggcatggcggctaggagctgctcaggaagtgccaggctgaaggagcaaaggcatctgtgtgaaggaggctgagacaatgcagcaacccaggaacactttcagagggattcacaagggacttatcttctaagtcagggatgatgggaaatgaagggtttcctggggaagacctgccccatctccccaacaccccaccccatcaagttggaaggaattcgtgtctggggatgagcaattccttcccgtttggtaggctgtccgcagtgtgagggatgatgcccatgtcccattaaggtttctgaggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttcccttccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagagtattggtccagttcacggactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgtcctgtcttcacctctacccacccgccccacatctctaaacaccccacacatgcacagatattccttccagtccactccatggccacacacctatttaccttcatgtgtttacacatccaccccgccatgcacctgcaggaagacggtgatttctcactcacccccataaagtacacacacctagccccacattcacatctccaggcccctcacatgtaaacacattctcctagcactccaggtaactccattcacatggtctctccagaacacatatccacatacccacacggtctgtgtactccacgtctgcaccccgcagatggctctcaccctccgcatgtacacacacacatgctcatatacttctccccatgtctctgtagccacatctacaccgatacccacgatgcatacacacccacactcacactttacccccatatttacagcccacacaaaaacctacaccctgcacatccatgtccacaccaaactccacacatatacaccttaaatgtacataaatattccttccacccaccccccacaaatacctacacacgcccgtatccccctgcacaccctacttccacatccactttacacatccacctaccacacacacctgtccctcactatctcctcagaaacacaaacaaatattccccttccctacacacatatactcttacctgtttgtccacactgtcccaccccacacatacacagatactacacacacaccatatccacatctatatacatcccacacactgcccttatgtcattcccctacacatacattcccccacacacacatccacatatgcatgcacgcgtatacatgcgcacactcttccatatacagcctgtatatgtacacccagcacacacccatgcacttctcccctcaccccaccccacaaatatatacacatccgtgtacatggggctgcatctgtatccatacatgcacacacacctctacccaggcccaaccgcatcccccaagtctccccacacttccttaccccgtatatgcacacgtacacactctttgtactctaagcatgtcccctgcacactcccacccatcacacacatactcccatgcatatgcactcattgccgaaatgcctcctcatatgcacccatacacctccccacccccgcattctctgctgtgcacaagcttgtgtcagtcatttaggctgcccttgaaccctgtaccttccttggtgaccacccatgcctatctatggccaaggtcttgaggtaaacgagtgcctcagagagggtgactaagcacacagggccctgctcatgctcccccaagccccgcatccctgtagtggcatgaagaagccaacttcttcctggaggaagagtttcagcgggagtgtaggctcttggtcaggtctgtaggcatatgggtgctaaaccagcagttaggcgtggcttattccatggctaactaggggacacgaccatatttgattttattttcatttaatttttgagacagggtctcactcttgcccaggccagttttgaactcctgagctcaagtgatcatcctcccacctcaagggccttattttaatttgcttatttatttatttatttatttatttatttatttattatttttattttgtttttgaggcagagtctcactctgtcgcccaggctggagtgcaatggcaccatcttggctcactgcaacctccgcctcccgggttcaactgattctcctgcctcagcctcctgagtagctgggattacaggcacctgctaccatgccaggctaatttttgtatttttagtagagacagggtttcaccatgttggccaggctggtctcgaactcctgaccttaggtgatctgcctgcctcagcctcccaaagtgctgggattacaggcatgagccaccacgcctggcccttaattttctcttgactatattgctttgtcagttccaatctcagaggctccggggctgcatttcacttctgggtgcagttgtatgcccagaacggcaatcttctcttggtttacaattaatactatgtgagataggaagatactcttttggggttcaaactgcagaaatgatgctcctttaaaaaagcaaagtcggtgtccccttcattggcgcccgggagactgaatatggagcatgcaggccattcacgctggcctccccacggtctggtaggcttgggatgttgggatgtcatggttctgctcctgcccctctgtctttctgcatcacctcagacaccatggtgaggctcttgtaagctgttctgtcctgttgaatctcatggtaccatgaaggtggctggaaacccacacactagggctgcacactttctttttttaattaattaattaattaattaattaatttttgagacagagtctcactctgtcacccaggctggagtgcagtggtgcaatcatggctcatcgcagcctcgacctcccaggctcaagtgatcctcccacctcagcctcccgagcagctgggattatggattacaggtgtgcaccaccacacccagctaatttttgtatttttagtagagacaaggtctcactatgttggccaggctggtctggaactcctgatctcaagtgatccacttgccttggcctcccaaagtgctgggattacaggcgtgagccaccgcgcccggctgggctgcacagtttctagagaggaatgaacgcgcaaatgtgatcacaaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaatgagaggataatagagagtcagggagaggaagcagagaggagacagaaggagagacttaggatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactctcccctggaacaatgcacacatgcgtgtgtgcacacacatgcatgtgcgcacacacacacttaattttacagggccgggtgtggtggctcacgcctgtaatcccagcactttggaaggatgaggtgggtggatcacctgaggtcaggagttcaagaccagcctgggcaactaaaccctgtctctactaaaaatacaaaagtgagctgggcatggtggcatgcgcccgtagtcccagctactcaagaggctgaggcaggagaattgcttgaacctgggaggcggaagttgcaatgagccaagatcgtgccactgcactctagcctgggcaacagagtgagactccatctcaaaaaaaaaagaaaaggaaaaagaaaaagaaaagaaaagaaagaaagaaaaaacaattttacagatcccccttaagttcatccatgaaagtcaggttaagaactcgcacttgacagccccgtcatttggataaccagaacagcacatctagggggcaggaacattcttctttgggcttaagcagttgatgatcaaatatcaccgaaaactcagaaggagtcctacactgagatttgctcagaagttcctcaccacttcctgcacacccttcagttcctgttctggaacacaaatataatcaataagcccgtattggatgccgggtacatataagatgtttgtttttgtctcttgacaccagatgtagaacatgggtttgtccctgatgcttgggaattttcttttcttttttttttttaattgagacagagtcttgctctgtcacccaggctggagtgcagtggcacaatctcagctcactgccaacctctgccgccgggttcaagcgattctcgtgcctcagcctctggagtatctgggattacaggcgcgcaccaccacgcccagctattttttttttttttttttttttttagtagaggcgggggtttcgccatgttggccaggctggtctcgaactcccgatctcaggtgatccgccctcctcagccttccaaagtgctgggattacaggtgtgagccactgcacccggcggggaattttcctgtgtagtggggcctttgttgttttgttgcccaaagcatcccagaacaggtggtttgttttggaccccagtcacaggcattcattcactctccttcccatcagctttcctgagcactgaacccatcaggcggttcactctaaggtgcttatcttttttctttctttctttttttttttttttctttttgagacagagtctcgctctgtcgctcaggctggagtgcaatggcatgatctcggctcactacaacctccgcctccccggttaaagcaattctcctgcctcagcctcccaagtagctgggattacaggcgcctgccaccacacccggcatatttttgtatttttagtagagacggggtttcaccatgttggccaggctggtcttgaactcctgacctcaggtgatccacctgcctcggcctcccaaagtgctgggattacaggcatgagccatcacgcccagcctctaaggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacctctcccagaatgccagatattgtgtgcttgtggttggtcaggtttgctgtcatcttcctgagcctgttggagatagcatttcttttttcttttcttttctttcttttttttttttttttgagatggagtttcactcttgttgcccaggctgcagtgcaatggcgctatctcggctcaccgcaacctccgcctcccaggttcaagtgattctcctgcctcagcctccctagtagctgggattacagtcacatgccaccaagcccggctaattttgtatttttagtagagatggggtttctccatgttggccaggctggtctcgaactccagacctcaggtgatctgcccgccttggcctcccaaagtgctgggattacaggcatgagccaccacgcctggcctggagatagcatttcaagcaggactcttcatggagtagggatcattgacatggcatcatccacatgcttcagggccccttaaccagagactcataggatctgagagagcagagagtgatggtcaaatcctccatccaatcacctgaggtcaggagttcaagaccagcctggccaacatggcgaaaccccatctctattaaaaatataaaaattagccaggcatggtggcaggcacctgtaatcccagctactcgcaaggctgagacagaagaatcacttgaacctgggaggcggaggttgcagcgagccgagatcatgccattgcattccagcctgggcgacaagagtgaaactccttctaaaaaaaaataaataaataataaataaatcctccatccagccctttcaggcctttgttcctaacccaggaaattggtacattggagaaatctgctctactacatccaaatgcaggctttgcctgctgattaggccaggcatgtttgacacatttcagtaaatgatgccttggcaaaggctgaagccaagaccactattgcctaaatgaaagaaaaggaaaagagaatacaggggaaggagagaggagggaggactaaaagaaggacagtgatttctgccagagggtcccaaggcttgggcagctgggttggatcatggtcaacagagttggggttttgagggattttttttttttggttgcttttttagagatggagtctcattctgtcccccaggctggagtgcagtggggtaataacagctcactgcagccttcacacctaggctcaagtgatcctccagccccagcctcctgagtggctgggaccacaggcatgcaccaccacaactggctaatttgttttgttttaaaaacaaaaagggacagggtcttgctacactggccaggttggtctcaaacttctgacctcaagtgatcctcccacctcagcctcctaaagtgctgggattacaggtgtgagccaccatgcctggccaagtttttaagactcaaaggagcagcttcaatttctgaatgggccacgcaaaggaaaagctgatttccttgtctggaagagcaagggttccttcttcatcctcatgcaggctttctctaattcattctcatttcctcctctggaacctggggctaaagaggacttgtgactagggcccgggagaaataactaagtactttacatacttaattgtaccagaggtaaattaataacacacttgaagaggatgagatgagctcttttgcagaagctaggtacagaaggacttgagaaagacagtggtgaggtcttgtgactgtttgagtctatttgaattcagcctctgcctatggactgcaaggacgccagagaactccccatgagctctgggagtcttctccaacatggcctctcacaaagttgattccaggtgctgtgaatgagcttttaactggggagtaaaaaatactgatccaagtgtgggtttccaatgtgtaggagcttcacaattacccacctccaaagacttcttccaaaagcctagggcaggagaagacagagccttccaagggacccaaggattcagggaagagagatgaaataaggccgcaggctcagtctaaaatggaagcagagtaggggggaatataggacatctctgtgggatagccagcaggtgggcaggaaggtagtctccatggcaacaagtctccacagcagcaaatcccagcaggtgggtgggaaggtagtctccatggtgacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctttggagagagaagaaaggggaaagagaagtaactatagagctgcaatgtgcccagcatgttatagatgcttatgttcattttatccttgttacaaccctgtgaggtatttttatccccattttacagaagaggacactatggcccagagattttaaattaagtgcccaaggctacatgactaagatgtgatagagccaggattcaaatcaaggaccgtctgactccagggtttccattctatcttgccagatgttagggtaaggtccccaatagtacatcagggcagagaatgctgagttctggacatttgcagtttctgcagtttgtctcccacctggaggcatgcacttcaaatggtctgcagacccctccttccaagctggataacaggtgggaggcagggagctgacccctcctctgttgacgatgctggacattgcagaaaggagcactgctttaagttaactatgtgggaagaactacactgcgtgctcattctctattcccacctcccctgttgaccctgcctgccgtcatcacccaaatcctccatccctctgccttcattgtcttcatgccctttgttgaatccaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactgggtaaggagaaaatagggtttttttcctctttgagaccccagcatgccctcccctctgctcctctagctaaacctcttccatcatatcccttcctaagatattcccaaaatcttgcttggtaccccttcactcatcttcctatctccccttcctgagtctttcatgccatttttccttccttcaaaaatgttgttgaggcttagaactcagttagcatcgggactaggaaggaatgagggttactggaagaactatgggatttagccaggcccagtggctcacggctgtaatcccagcactttgggaggcaaaggcaggcagatcacttgagcccaggagttcaagaccagccacggcaacatagaaagaccctgtctctaaaagaaaaagcattagccaggcatggtagtgcatgcctgtagtcccaggtatttgggaggctgaggtgggaggatcgcttgagccccggagggtgaggctacactgagctgtgatcacgccactgtactctagcctgggtgacagagcgaaaccttatcttaaacacacacacacacacacatatacacacacacactatgggattcaaggttagctggtcacaggctatgtgaaataggaatgcagtgcttcagaaagagccttcagggccaggcgcggaggcttatgcctgtaatcccagcactttgggaggccaaggcaggtggattgcctgagctcaggagttcgaaaccagcctggccaacatggtgaaacaccgtctctactataatacaaaaaatttgccaggcgtggtggcgggtgcctgtagtcccggctacctaggcaggagaattgcttgaacccaggaggcagaggttgcagtgagccgaggttgccccaccgcactccagcctgtgcgacagagcgagactctgtctcaaaaaaaaaaaaagaaaaaaaaagagagaaagaaagagagagagagaaagaaaaagggaagaaagaaagaaagagagagaaagaaagaaagagaaaaaaaaaagaaagaaagaaagaaagaaagaaagaaagaaagaaagaaagaaagagaaagaaaagaaagagaaagaaagaaagaaagaaaaagagacttcgggttcagcaacttctgcttgcttaataaaagaaagaggctttattagggggctcctggcaaaattgggcagctgaaaagattgataaatgctcagtagcatgtgcaaagaaaaagcatctatagccttaatcttaaaggatgagcgccgggaaggaggatataggagttcaagccctggggaagaagcaggtgtgggcagagcaggggaccctgaaaaagatggaaatggtgggaagttctaaactgggaaagaggtttggctgtcagaggaaaaatgctgggccttttcctcatccagatagagtggtgaccccagatttccatgtggtatttcagggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactccc

SEQ ID NO: 4692 - DNA, 25431 bp, human
cggagagctgatctcggggattcgggtgcggagcccttggcctggaggcgatatgggtggtccgtggcccggttcagtcgcttgcagcagcccggggaacaggtgaggccgcctgccccggtctctcatcctctagctgcccataccttgcccccatcctaacccctcccaatcccaggctcctccactccccagccagtggcccccatccctctcaaccccatgttctccatcggtacccctgacccccgatcctcccccgcttctgttctcccttctacctcctccctaaatcccgcatccctaacatcctcccgcccatggtccctctatttccacagcccatcccgcatgctcatcaaaatacccctattgagggcccccagccccatcccgggattgcacattgccagtcccccctcccctgcagtgcagccccatcccccttccatcatagcatctcatagccaggctccctcccccactatctgcagcccccccacccaatggaggcctttatcctatcctcccccattccagtgcaactccatcccccaatccattccaagccctcgtagcccccaatactgcagttctcaatattggtccattcctgcacaatgccccgcgcccagcaccgctgcagccccaaaagtaccccgagatgccattctcatccccggcattgctgcctccccttgtcttctcccaaattgcaagttggaccaggatggagatcttggccttggggattcacagtgggtcctagggtacagagggcgtttgggggtcggtccgattgtctaggtgttcacgggggaggggctgcagggaattgactcaaaggagaatttggcatttggcgccgaagggttactggagaggagggcatcccgaaagggttaatggaatttgtgggttgggggcagcaccgagggggttaatgtgggggggttgctggtggggaagctgtgtgaatgagcggtctgtgccctggagttgccatggagacggtgaatggggggattgtgtgaactcagctgcggactatgccccccccaatacacacacccacccactccctcctgccccacctccctactcctaccccttccttccccttcccctcctccccacacccgggtgcattctgggcagtgtctgggatcttaccccccatactttgctccccatttcctcatttcctctgagcccccacccctttagccactttacccgccctccctcctcttcctttttcttctctctctctctctctctctctctctctcacacacacacacacacagacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcagggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggtgagtgctgcggccaggcactgtgccctccctgcctcccgcctgccctgctgtgtttgtggcttgcatgtggttgtgtgccctgcagcatgcatctgtctgtctgtgaaaatgcttctaaccatcactctgcttggcctcccacccccctccctgttcttccctctcccagcattgtccgagctcccatgtgtgagtgacactgttgccaggaggggcctggcccggcctgagagctctgacgggtctcggtccagtgctggatgggggtcccctgggggagtatgggtcacggctggcagctacccgcgggaggatgctggctccaccaggcccccctgttgccattccacctgcttcgaaaggtggtaggtgtgtgtggccaagggcactgggtgtgtggggggtggggcagcaagcctggtgggtgatgcttaggtgcctcctctttcactagctgatgcctcctcccgcgggggtcacactaaggtaagtgacagaaacaaggagatggtgggacaggctctctgccatgtgccgcctgcagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtggaaaaatcacagcttgatccctacaaccctctggcaagctgggagtttgttttcctttgatgtcctagggcagagtttctcagaatggggttgccaggatttctgggatggggtgctccttactgaataagaatttctgggggcagagcctggaaatctatatgttgaacatgagccctgagcgcttctaatgcacacccgagcatggaatgagacccgctgctgtagggatagtatttcaccacagccccataccccacccaggacctcacacaccataggcaattgatgttttttgtgtaattcagaagcatcatggtgctgcagaaagagtacaggtctgggaagcacaaggcctgagtcccagctctgctgccaactcacagtgagaccttaggcaagtcttgtccttcaagaacctctgtttccacatctgaggttggtagggtacagttctggccttagcattccattagcctgtaaatgaattcaggaggaaggtctcttaaacctgcaggagaggccgggcgtggtggctcacgcctgtaatcccagcactttgggaggccgaggcaggtggatcacgaggtcaggagatcgagaccatcctggctaatacggcaaaaccccgtctctactaaaaaatacaaaaaattagctgggcgtggtggcgggtgcctgtagttccggctactcgggaggttgaggcaggagaatggcatgaacccaggaggcagagcttgcagtgagccgagatcgtgccactgcactccagcctgggcgacagagcgagactccatctcaaaaaaaaaaaaaaaaaaaaagaaagaaaagaaaagaaaaaaacctgaaggagagatggcattcacattaaccatttcttaggaagaatgatcgcccagtaagagccttgggctgtccagtccagccctgagagtgtggccagagagcagactggaagccccggctcaaacatgcacatttaccaatcgtgattgttgactgtgggcaaggccatgtgctaggtgttgttgggatgtggagggatgtgaggtagaggaaagatttagaaatgactaaaggcctaatcactgctctgaagaagctcttagccttgtattaaaactcagctggtttggccgggcgcggtggcttatgcctataattgcagcactttgagaggccaagacgggtgggtcacttgagttcaggaattcgagaccagcctggccaatatggtgaaaccccatccctactaaaaatacaggtgcatggtggcacacacctgtagtcccagctacttgggaggctggggcaggagaatcgcttgaacccaggaggtggaggttgcagtgagccgaggtggtgccatcgcactccagcctgggcaacaaggctgaaactccatctaaaaaaagaaaaaaaaaaaactcagctggtttccctaagtcccatgggccaatcaggaagtgggttccagacagtgcaagggaaggcatttggtcatttcactgttcaaattagttccctacccaggacctggtggccatttggaagagtgacaaatcccgcctcttgagggagacccatcctcggaggtcgttagggttgtggtgtgcagaggtctggggaccagcctggctgggatccctcagcggcgcagggtctgggaatggtggtcggcagtcaggctggcctgggtgagaggcatggcggctaggagctgctcaggaagtgccaggctgaaggagcaaaggcatctgtgtgaaggaggctgagacaatgcagcaacccaggaacactttcagagggattcacaagggacttatcttctaagtcagggatgatgggaaatgaagggtttcctggggaagacctgccccatctccccaacaccccaccccatcaagttggaaggaattcgtgtctggggatgagcaattccttcccgtttggtaggctgtccgcagtgtgagggatgatgcccatgtcccattaaggtttctgaggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttcccttccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagagtattggtccagttcacggactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgtcctgtcttcacctctacccacccgccccacatctctaaacaccccacacatgcacagatattccttccagtccactccatggccacacacctatttaccttcatgtgtttacacatccaccccgccatgcacctgcaggaagacggtgatttctcactcacccccataaagtacacacacctagccccacattcacatctccaggcccctcacatgtaaacacattctcctagcactccaggtaactccattcacatggtctctccagaacacatatccacatacccacacggtctgtgtactccacgtctgcaccccgcagatggctctcaccctccgcatgtacacacacacatgctcatatacttctccccatgtctctgtagccacatctacaccgatacccacgatgcatacacacccacactcacactttacccccatatttacagcccacacaaaaacctacaccctgcacatccatgtccacaccaaactccacacatatacaccttaaatgtacataaatattccttccacccaccccccacaaatacctacacacgcccgtatccccctgcacaccctacttccacatccactttacacatccacctaccacacacacctgtccctcactatctcctcagaaacacaaacaaatattccccttccctacacacatatactcttacctgtttgtccacactgtcccaccccacacatacacagatactacacacacaccatatccacatctatatacatcccacacactgcccttatgtcattcccctacacatacattcccccacacacacatccacatatgcatgcacgcgtatacatgcgcacactcttccatatacagcctgtatatgtacacccagcacacacccatgcacttctcccctcaccccaccccacaaatatatacacatccgtgtacatggggctgcatctgtatccatacatgcacacacacctctacccaggcccaaccgcatcccccaagtctccccacacttccttaccccgtatatgcacacgtacacactctttgtactctaagcatgtcccctgcacactcccacccatcacacacatactcccatgcatatgcactcattgccgaaatgcctcctcatatgcacccatacacctccccacccccgcattctctgctgtgcacaagcttgtgtcagtcatttaggctgcccttgaaccctgtaccttccttggtgaccacccatgcctatctatggccaaggtcttgaggtaaacgagtgcctcagagagggtgactaagcacacagggccctgctcatgctcccccaagccccgcatccctgtagtggcatgaagaagccaacttcttcctggaggaagagtttcagcgggagtgtaggctcttggtcaggtctgtaggcatatgggtgctaaaccagcagttaggcgtggcttattccatggctaactaggggacacgaccatatttgattttattttcatttaatttttgagacagggtctcactcttgcccaggccagttttgaactcctgagctcaagtgatcatcctcccacctcaagggccttattttaatttgcttatttatttatttatttatttatttatttatttattatttttattttgtttttgaggcagagtctcactctgtcgcccaggctggagtgcaatggcaccatcttggctcactgcaacctccgcctcccgggttcaactgattctcctgcctcagcctcctgagtagctgggattacaggcacctgctaccatgccaggctaatttttgtatttttagtagagacagggtttcaccatgttggccaggctggtctcgaactcctgaccttaggtgatctgcctgcctcagcctcccaaagtgctgggattacaggcatgagccaccacgcctggcccttaattttctcttgactatattgctttgtcagttccaatctcagaggctccggggctgcatttcacttctgggtgcagttgtatgcccagaacggcaatcttctcttggtttacaattaatactatgtgagataggaagatactcttttggggttcaaactgcagaaatgatgctcctttaaaaaagcaaagtcggtgtccccttcattggcgcccgggagactgaatatggagcatgcaggccattcacgctggcctccccacggtctggtaggcttgggatgttgggatgtcatggttctgctcctgcccctctgtctttctgcatcacctcagacaccatggtgaggctcttgtaagctgttctgtcctgttgaatctcatggtaccatgaaggtggctggaaacccacacactagggctgcacactttctttttttaattaattaattaattaattaattaatttttgagacagagtctcactctgtcacccaggctggagtgcagtggtgcaatcatggctcatcgcagcctcgacctcccaggctcaagtgatcctcccacctcagcctcccgagcagctgggattatggattacaggtgtgcaccaccacacccagctaatttttgtatttttagtagagacaaggtctcactatgttggccaggctggtctggaactcctgatctcaagtgatccacttgccttggcctcccaaagtgctgggattacaggcgtgagccaccgcgcccggctgggctgcacagtttctagagaggaatgaacgcgcaaatgtgatcacaaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaatgagaggataatagagagtcagggagaggaagcagagaggagacagaaggagagacttaggatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactctcccctggaacaatgcacacatgcgtgtgtgcacacacatgcatgtgcgcacacacacacttaattttacagggccgggtgtggtggctcacgcctgtaatcccagcactttggaaggatgaggtgggtggatcacctgaggtcaggagttcaagaccagcctgggcaactaaaccctgtctctactaaaaatacaaaagtgagctgggcatggtggcatgcgcccgtagtcccagctactcaagaggctgaggcaggagaattgcttgaacctgggaggcggaagttgcaatgagccaagatcgtgccactgcactctagcctgggcaacagagtgagactccatctcaaaaaaaaaagaaaaggaaaaagaaaaagaaaagaaaagaaagaaagaaaaaacaattttacagatcccccttaagttcatccatgaaagtcaggttaagaactcgcacttgacagccccgtcatttggataaccagaacagcacatctagggggcaggaacattcttctttgggcttaagcagttgatgatcaaatatcaccgaaaactcagaaggagtcctacactgagatttgctcagaagttcctcaccacttcctgcacacccttcagttcctgttctggaacacaaatataatcaataagcccgtattggatgccgggtacatataagatgtttgtttttgtctcttgacaccagatgtagaacatgggtttgtccctgatgcttgggaattttcttttcttttttttttttaattgagacagagtcttgctctgtcacccaggctggagtgcagtggcacaatctcagctcactgccaacctctgccgccgggttcaagcgattctcgtgcctcagcctctggagtatctgggattacaggcgcgcaccaccacgcccagctattttttttttttttttttttttttagtagaggcgggggtttcgccatgttggccaggctggtctcgaactcccgatctcaggtgatccgccctcctcagccttccaaagtgctgggattacaggtgtgagccactgcacccggcggggaattttcctgtgtagtggggcctttgttgttttgttgcccaaagcatcccagaacaggtggtttgttttggaccccagtcacaggcattcattcactctccttcccatcagctttcctgagcactgaacccatcaggcggttcactctaaggtgcttatcttttttctttctttctttttttttttttttctttttgagacagagtctcgctctgtcgctcaggctggagtgcaatggcatgatctcggctcactacaacctccgcctccccggttaaagcaattctcctgcctcagcctcccaagtagctgggattacaggcgcctgccaccacacccggcatatttttgtatttttagtagagacggggtttcaccatgttggccaggctggtcttgaactcctgacctcaggtgatccacctgcctcggcctcccaaagtgctgggattacaggcatgagccatcacgcccagcctctaaggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacctctcccagaatgccagatattgtgtgcttgtggttggtcaggtttgctgtcatcttcctgagcctgttggagatagcatttcttttttcttttcttttctttcttttttttttttttttgagatggagtttcactcttgttgcccaggctgcagtgcaatggcgctatctcggctcaccgcaacctccgcctcccaggttcaagtgattctcctgcctcagcctccctagtagctgggattacagtcacatgccaccaagcccggctaattttgtatttttagtagagatggggtttctccatgttggccaggctggtctcgaactccagacctcaggtgatctgcccgccttggcctcccaaagtgctgggattacaggcatgagccaccacgcctggcctggagatagcatttcaagcaggactcttcatggagtagggatcattgacatggcatcatccacatgcttcagggccccttaaccagagactcataggatctgagagagcagagagtgatggtcaaatcctccatccaatcacctgaggtcaggagttcaagaccagcctggccaacatggcgaaaccccatctctattaaaaatataaaaattagccaggcatggtggcaggcacctgtaatcccagctactcgcaaggctgagacagaagaatcacttgaacctgggaggcggaggttgcagcgagccgagatcatgccattgcattccagcctgggcgacaagagtgaaactccttctaaaaaaaaataaataaataataaataaatcctccatccagccctttcaggcctttgttcctaacccaggaaattggtacattggagaaatctgctctactacatccaaatgcaggctttgcctgctgattaggccaggcatgtttgacacatttcagtaaatgatgccttggcaaaggctgaagccaagaccactattgcctaaatgaaagaaaaggaaaagagaatacaggggaaggagagaggagggaggactaaaagaaggacagtgatttctgccagagggtcccaaggcttgggcagctgggttggatcatggtcaacagagttggggttttgagggattttttttttttggttgcttttttagagatggagtctcattctgtcccccaggctggagtgcagtggggtaataacagctcactgcagccttcacacctaggctcaagtgatcctccagccccagcctcctgagtggctgggaccacaggcatgcaccaccacaactggctaatttgttttgttttaaaaacaaaaagggacagggtcttgctacactggccaggttggtctcaaacttctgacctcaagtgatcctcccacctcagcctcctaaagtgctgggattacaggtgtgagccaccatgcctggccaagtttttaagactcaaaggagcagcttcaatttctgaatgggccacgcaaaggaaaagctgatttccttgtctggaagagcaagggttccttcttcatcctcatgcaggctttctctaattcattctcatttcctcctctggaacctggggctaaagaggacttgtgactagggcccgggagaaataactaagtactttacatacttaattgtaccagaggtaaattaataacacacttgaagaggatgagatgagctcttttgcagaagctaggtacagaaggacttgagaaagacagtggtgaggtcttgtgactgtttgagtctatttgaattcagcctctgcctatggactgcaaggacgccagagaactccccatgagctctgggagtcttctccaacatggcctctcacaaagttgattccaggtgctgtgaatgagcttttaactggggagtaaaaaatactgatccaagtgtgggtttccaatgtgtaggagcttcacaattacccacctccaaagacttcttccaaaagcctagggcaggagaagacagagccttccaagggacccaaggattcagggaagagagatgaaataaggccgcaggctcagtctaaaatggaagcagagtaggggggaatataggacatctctgtgggatagccagcaggtgggcaggaaggtagtctccatggcaacaagtctccacagcagcaaatcccagcaggtgggtgggaaggtagtctccatggtgacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctttggagagagaagaaaggggaaagagaagtaactatagagctgcaatgtgcccagcatgttatagatgcttatgttcattttatccttgttacaaccctgtgaggtatttttatccccattttacagaagaggacactatggcccagagattttaaattaagtgcccaaggctacatgactaagatgtgatagagccaggattcaaatcaaggaccgtctgactccagggtttccattctatcttgccagatgttagggtaaggtccccaatagtacatcagggcagagaatgctgagttctggacatttgcagtttctgcagtttgtctcccacctggaggcatgcacttcaaatggtctgcagacccctccttccaagctggataacaggtgggaggcagggagctgacccctcctctgttgacgatgctggacattgcagaaaggagcactgctttaagttaactatgtgggaagaactacactgcgtgctcattctctattcccacctcccctgttgaccctgcctgccgtcatcacccaaatcctccatccctctgccttcattgtcttcatgccctttgttgaatccaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactgggtaaggagaaaatagggtttttttcctctttgagaccccagcatgccctcccctctgctcctctagctaaacctcttccatcatatcccttcctaagatattcccaaaatcttgcttggtaccccttcactcatcttcctatctccccttcctgagtctttcatgccatttttccttccttcaaaaatgttgttgaggcttagaactcagttagcatcgggactaggaaggaatgagggttactggaagaactatgggatttagccaggcccagtggctcacggctgtaatcccagcactttgggaggcaaaggcaggcagatcacttgagcccaggagttcaagaccagccacggcaacatagaaagaccctgtctctaaaagaaaaagcattagccaggcatggtagtgcatgcctgtagtcccaggtatttgggaggctgaggtgggaggatcgcttgagccccggagggtgaggctacactgagctgtgatcacgccactgtactctagcctgggtgacagagcgaaaccttatcttaaacacacacacacacacacatatacacacacacactatgggattcaaggttagctggtcacaggctatgtgaaataggaatgcagtgcttcagaaagagccttcagggccaggcgcggaggcttatgcctgtaatcccagcactttgggaggccaaggcaggtggattgcctgagctcaggagttcgaaaccagcctggccaacatggtgaaacaccgtctctactataatacaaaaaatttgccaggcgtggtggcgggtgcctgtagtcccggctacctaggcaggagaattgcttgaacccaggaggcagaggttgcagtgagccgaggttgccccaccgcactccagcctgtgcgacagagcgagactctgtctcaaaaaaaaaaaaagaaaaaaaaagagagaaagaaagagagagagagaaagaaaaagggaagaaagaaagaaagagagagaaagaaagaaagagaaaaaaaaaagaaagaaagaaagaaagaaagaaagaaagaaagaaagaaagaaagagaaagaaaagaaagagaaagaaagaaagaaagaaaaagagacttcgggttcagcaacttctgcttgcttaataaaagaaagaggctttattagggggctcctggcaaaattgggcagctgaaaagattgataaatgctcagtagcatgtgcaaagaaaaagcatctatagccttaatcttaaaggatgagcgccgggaaggaggatataggagttcaagccctggggaagaagcaggtgtgggcagagcaggggaccctgaaaaagatggaaatggtgggaagttctaaactgggaaagaggtttggctgtcagaggaaaaatgctgggccttttcctcatccagatagagtggtgaccccagatttccatgtggtatttcagggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacaca

SEQ ID NO: 4693 - DNA, 26278 bp, human
gtgcgcgggcacagcagccaggctgccggagagctgatctcggggattcgggtgcggagcccttggcctggaggcgatatgggtggtccgtggcccggttcagtcgcttgcagcagcccggggaacaggtgaggccgcctgccccggtctctcatcctctagctgcccataccttgcccccatcctaacccctcccaatcccaggctcctccactccccagccagtggcccccatccctctcaaccccatgttctccatcggtacccctgacccccgatcctcccccgcttctgttctcccttctacctcctccctaaatcccgcatccctaacatcctcccgcccatggtccctctatttccacagcccatcccgcatgctcatcaaaatacccctattgagggcccccagccccatcccgggattgcacattgccagtcccccctcccctgcagtgcagccccatcccccttccatcatagcatctcatagccaggctccctcccccactatctgcagcccccccacccaatggaggcctttatcctatcctcccccattccagtgcaactccatcccccaatccattccaagccctcgtagcccccaatactgcagttctcaatattggtccattcctgcacaatgccccgcgcccagcaccgctgcagccccaaaagtaccccgagatgccattctcatccccggcattgctgcctccccttgtcttctcccaaattgcaagttggaccaggatggagatcttggccttggggattcacagtgggtcctagggtacagagggcgtttgggggtcggtccgattgtctaggtgttcacgggggaggggctgcagggaattgactcaaaggagaatttggcatttggcgccgaagggttactggagaggagggcatcccgaaagggttaatggaatttgtgggttgggggcagcaccgagggggttaatgtgggggggttgctggtggggaagctgtgtgaatgagcggtctgtgccctggagttgccatggagacggtgaatggggggattgtgtgaactcagctgcggactatgccccccccaatacacacacccacccactccctcctgccccacctccctactcctaccccttccttccccttcccctcctccccacacccgggtgcattctgggcagtgtctgggatcttaccccccatactttgctccccatttcctcatttcctctgagcccccacccctttagccactttacccgccctccctcctcttcctttttcttctctctctctctctctctctctctctctcacacacacacacacacagacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcagggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggtgagtgctgcggccaggcactgtgccctccctgcctcccgcctgccctgctgtgtttgtggcttgcatgtggttgtgtgccctgcagcatgcatctgtctgtctgtgaaaatgcttctaaccatcactctgcttggcctcccacccccctccctgttcttccctctcccagcattgtccgagctcccatgtgtgagtgacactgttgccaggaggggcctggcccggcctgagagctctgacgggtctcggtccagtgctggatgggggtcccctgggggagtatgggtcacggctggcagctacccgcgggaggatgctggctccaccaggcccccctgttgccattccacctgcttcgaaaggtggtaggtgtgtgtggccaagggcactgggtgtgtggggggtggggcagcaagcctggtgggtgatgcttaggtgcctcctctttcactagctgatgcctcctcccgcgggggtcacactaaggtaagtgacagaaacaaggagatggtgggacaggctctctgccatgtgccgcctgcagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtggaaaaatcacagcttgatccctacaaccctctggcaagctgggagtttgttttcctttgatgtcctagggcagagtttctcagaatggggttgccaggatttctgggatggggtgctccttactgaataagaatttctgggggcagagcctggaaatctatatgttgaacatgagccctgagcgcttctaatgcacacccgagcatggaatgagacccgctgctgtagggatagtatttcaccacagccccataccccacccaggacctcacacaccataggcaattgatgttttttgtgtaattcagaagcatcatggtgctgcagaaagagtacaggtctgggaagcacaaggcctgagtcccagctctgctgccaactcacagtgagaccttaggcaagtcttgtccttcaagaacctctgtttccacatctgaggttggtagggtacagttctggccttagcattccattagcctgtaaatgaattcaggaggaaggtctcttaaacctgcaggagaggccgggcgtggtggctcacgcctgtaatcccagcactttgggaggccgaggcaggtggatcacgaggtcaggagatcgagaccatcctggctaatacggcaaaaccccgtctctactaaaaaatacaaaaaattagctgggcgtggtggcgggtgcctgtagttccggctactcgggaggttgaggcaggagaatggcatgaacccaggaggcagagcttgcagtgagccgagatcgtgccactgcactccagcctgggcgacagagcgagactccatctcaaaaaaaaaaaaaaaaaaaaagaaagaaaagaaaagaaaaaaacctgaaggagagatggcattcacattaaccatttcttaggaagaatgatcgcccagtaagagccttgggctgtccagtccagccctgagagtgtggccagagagcagactggaagccccggctcaaacatgcacatttaccaatcgtgattgttgactgtgggcaaggccatgtgctaggtgttgttgggatgtggagggatgtgaggtagaggaaagatttagaaatgactaaaggcctaatcactgctctgaagaagctcttagccttgtattaaaactcagctggtttggccgggcgcggtggcttatgcctataattgcagcactttgagaggccaagacgggtgggtcacttgagttcaggaattcgagaccagcctggccaatatggtgaaaccccatccctactaaaaatacaggtgcatggtggcacacacctgtagtcccagctacttgggaggctggggcaggagaatcgcttgaacccaggaggtggaggttgcagtgagccgaggtggtgccatcgcactccagcctgggcaacaaggctgaaactccatctaaaaaaagaaaaaaaaaaaactcagctggtttccctaagtcccatgggccaatcaggaagtgggttccagacagtgcaagggaaggcatttggtcatttcactgttcaaattagttccctacccaggacctggtggccatttggaagagtgacaaatcccgcctcttgagggagacccatcctcggaggtcgttagggttgtggtgtgcagaggtctggggaccagcctggctgggatccctcagcggcgcagggtctgggaatggtggtcggcagtcaggctggcctgggtgagaggcatggcggctaggagctgctcaggaagtgccaggctgaaggagcaaaggcatctgtgtgaaggaggctgagacaatgcagcaacccaggaacactttcagagggattcacaagggacttatcttctaagtcagggatgatgggaaatgaagggtttcctggggaagacctgccccatctccccaacaccccaccccatcaagttggaaggaattcgtgtctggggatgagcaattccttcccgtttggtaggctgtccgcagtgtgagggatgatgcccatgtcccattaaggtttctgaggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttcccttccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagagtattggtccagttcacggactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgtcctgtcttcacctctacccacccgccccacatctctaaacaccccacacatgcacagatattccttccagtccactccatggccacacacctatttaccttcatgtgtttacacatccaccccgccatgcacctgcaggaagacggtgatttctcactcacccccataaagtacacacacctagccccacattcacatctccaggcccctcacatgtaaacacattctcctagcactccaggtaactccattcacatggtctctccagaacacatatccacatacccacacggtctgtgtactccacgtctgcaccccgcagatggctctcaccctccgcatgtacacacacacatgctcatatacttctccccatgtctctgtagccacatctacaccgatacccacgatgcatacacacccacactcacactttacccccatatttacagcccacacaaaaacctacaccctgcacatccatgtccacaccaaactccacacatatacaccttaaatgtacataaatattccttccacccaccccccacaaatacctacacacgcccgtatccccctgcacaccctacttccacatccactttacacatccacctaccacacacacctgtccctcactatctcctcagaaacacaaacaaatattccccttccctacacacatatactcttacctgtttgtccacactgtcccaccccacacatacacagatactacacacacaccatatccacatctatatacatcccacacactgcccttatgtcattcccctacacatacattcccccacacacacatccacatatgcatgcacgcgtatacatgcgcacactcttccatatacagcctgtatatgtacacccagcacacacccatgcacttctcccctcaccccaccccacaaatatatacacatccgtgtacatggggctgcatctgtatccatacatgcacacacacctctacccaggcccaaccgcatcccccaagtctccccacacttccttaccccgtatatgcacacgtacacactctttgtactctaagcatgtcccctgcacactcccacccatcacacacatactcccatgcatatgcactcattgccgaaatgcctcctcatatgcacccatacacctccccacccccgcattctctgctgtgcacaagcttgtgtcagtcatttaggctgcccttgaaccctgtaccttccttggtgaccacccatgcctatctatggccaaggtcttgaggtaaacgagtgcctcagagagggtgactaagcacacagggccctgctcatgctcccccaagccccgcatccctgtagtggcatgaagaagccaacttcttcctggaggaagagtttcagcgggagtgtaggctcttggtcaggtctgtaggcatatgggtgctaaaccagcagttaggcgtggcttattccatggctaactaggggacacgaccatatttgattttattttcatttaatttttgagacagggtctcactcttgcccaggccagttttgaactcctgagctcaagtgatcatcctcccacctcaagggccttattttaatttgcttatttatttatttatttatttatttatttatttattatttttattttgtttttgaggcagagtctcactctgtcgcccaggctggagtgcaatggcaccatcttggctcactgcaacctccgcctcccgggttcaactgattctcctgcctcagcctcctgagtagctgggattacaggcacctgctaccatgccaggctaatttttgtatttttagtagagacagggtttcaccatgttggccaggctggtctcgaactcctgaccttaggtgatctgcctgcctcagcctcccaaagtgctgggattacaggcatgagccaccacgcctggcccttaattttctcttgactatattgctttgtcagttccaatctcagaggctccggggctgcatttcacttctgggtgcagttgtatgcccagaacggcaatcttctcttggtttacaattaatactatgtgagataggaagatactcttttggggttcaaactgcagaaatgatgctcctttaaaaaagcaaagtcggtgtccccttcattggcgcccgggagactgaatatggagcatgcaggccattcacgctggcctccccacggtctggtaggcttgggatgttgggatgtcatggttctgctcctgcccctctgtctttctgcatcacctcagacaccatggtgaggctcttgtaagctgttctgtcctgttgaatctcatggtaccatgaaggtggctggaaacccacacactagggctgcacactttctttttttaattaattaattaattaattaattaatttttgagacagagtctcactctgtcacccaggctggagtgcagtggtgcaatcatggctcatcgcagcctcgacctcccaggctcaagtgatcctcccacctcagcctcccgagcagctgggattatggattacaggtgtgcaccaccacacccagctaatttttgtatttttagtagagacaaggtctcactatgttggccaggctggtctggaactcctgatctcaagtgatccacttgccttggcctcccaaagtgctgggattacaggcgtgagccaccgcgcccggctgggctgcacagtttctagagaggaatgaacgcgcaaatgtgatcacaaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaatgagaggataatagagagtcagggagaggaagcagagaggagacagaaggagagacttaggatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactctcccctggaacaatgcacacatgcgtgtgtgcacacacatgcatgtgcgcacacacacacttaattttacagggccgggtgtggtggctcacgcctgtaatcccagcactttggaaggatgaggtgggtggatcacctgaggtcaggagttcaagaccagcctgggcaactaaaccctgtctctactaaaaatacaaaagtgagctgggcatggtggcatgcgcccgtagtcccagctactcaagaggctgaggcaggagaattgcttgaacctgggaggcggaagttgcaatgagccaagatcgtgccactgcactctagcctgggcaacagagtgagactccatctcaaaaaaaaaagaaaaggaaaaagaaaaagaaaagaaaagaaagaaagaaaaaacaattttacagatcccccttaagttcatccatgaaagtcaggttaagaactcgcacttgacagccccgtcatttggataaccagaacagcacatctagggggcaggaacattcttctttgggcttaagcagttgatgatcaaatatcaccgaaaactcagaaggagtcctacactgagatttgctcagaagttcctcaccacttcctgcacacccttcagttcctgttctggaacacaaatataatcaataagcccgtattggatgccgggtacatataagatgtttgtttttgtctcttgacaccagatgtagaacatgggtttgtccctgatgcttgggaattttcttttcttttttttttttaattgagacagagtcttgctctgtcacccaggctggagtgcagtggcacaatctcagctcactgccaacctctgccgccgggttcaagcgattctcgtgcctcagcctctggagtatctgggattacaggcgcgcaccaccacgcccagctattttttttttttttttttttttttagtagaggcgggggtttcgccatgttggccaggctggtctcgaactcccgatctcaggtgatccgccctcctcagccttccaaagtgctgggattacaggtgtgagccactgcacccggcggggaattttcctgtgtagtggggcctttgttgttttgttgcccaaagcatcccagaacaggtggtttgttttggaccccagtcacaggcattcattcactctccttcccatcagctttcctgagcactgaacccatcaggcggttcactctaaggtgcttatcttttttctttctttctttttttttttttttctttttgagacagagtctcgctctgtcgctcaggctggagtgcaatggcatgatctcggctcactacaacctccgcctccccggttaaagcaattctcctgcctcagcctcccaagtagctgggattacaggcgcctgccaccacacccggcatatttttgtatttttagtagagacggggtttcaccatgttggccaggctggtcttgaactcctgacctcaggtgatccacctgcctcggcctcccaaagtgctgggattacaggcatgagccatcacgcccagcctctaaggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacctctcccagaatgccagatattgtgtgcttgtggttggtcaggtttgctgtcatcttcctgagcctgttggagatagcatttcttttttcttttcttttctttcttttttttttttttttgagatggagtttcactcttgttgcccaggctgcagtgcaatggcgctatctcggctcaccgcaacctccgcctcccaggttcaagtgattctcctgcctcagcctccctagtagctgggattacagtcacatgccaccaagcccggctaattttgtatttttagtagagatggggtttctccatgttggccaggctggtctcgaactccagacctcaggtgatctgcccgccttggcctcccaaagtgctgggattacaggcatgagccaccacgcctggcctggagatagcatttcaagcaggactcttcatggagtagggatcattgacatggcatcatccacatgcttcagggccccttaaccagagactcataggatctgagagagcagagagtgatggtcaaatcctccatccaatcacctgaggtcaggagttcaagaccagcctggccaacatggcgaaaccccatctctattaaaaatataaaaattagccaggcatggtggcaggcacctgtaatcccagctactcgcaaggctgagacagaagaatcacttgaacctgggaggcggaggttgcagcgagccgagatcatgccattgcattccagcctgggcgacaagagtgaaactccttctaaaaaaaaataaataaataataaataaatcctccatccagccctttcaggcctttgttcctaacccaggaaattggtacattggagaaatctgctctactacatccaaatgcaggctttgcctgctgattaggccaggcatgtttgacacatttcagtaaatgatgccttggcaaaggctgaagccaagaccactattgcctaaatgaaagaaaaggaaaagagaatacaggggaaggagagaggagggaggactaaaagaaggacagtgatttctgccagagggtcccaaggcttgggcagctgggttggatcatggtcaacagagttggggttttgagggattttttttttttggttgcttttttagagatggagtctcattctgtcccccaggctggagtgcagtggggtaataacagctcactgcagccttcacacctaggctcaagtgatcctccagccccagcctcctgagtggctgggaccacaggcatgcaccaccacaactggctaatttgttttgttttaaaaacaaaaagggacagggtcttgctacactggccaggttggtctcaaacttctgacctcaagtgatcctcccacctcagcctcctaaagtgctgggattacaggtgtgagccaccatgcctggccaagtttttaagactcaaaggagcagcttcaatttctgaatgggccacgcaaaggaaaagctgatttccttgtctggaagagcaagggttccttcttcatcctcatgcaggctttctctaattcattctcatttcctcctctggaacctggggctaaagaggacttgtgactagggcccgggagaaataactaagtactttacatacttaattgtaccagaggtaaattaataacacacttgaagaggatgagatgagctcttttgcagaagctaggtacagaaggacttgagaaagacagtggtgaggtcttgtgactgtttgagtctatttgaattcagcctctgcctatggactgcaaggacgccagagaactccccatgagctctgggagtcttctccaacatggcctctcacaaagttgattccaggtgctgtgaatgagcttttaactggggagtaaaaaatactgatccaagtgtgggtttccaatgtgtaggagcttcacaattacccacctccaaagacttcttccaaaagcctagggcaggagaagacagagccttccaagggacccaaggattcagggaagagagatgaaataaggccgcaggctcagtctaaaatggaagcagagtaggggggaatataggacatctctgtgggatagccagcaggtgggcaggaaggtagtctccatggcaacaagtctccacagcagcaaatcccagcaggtgggtgggaaggtagtctccatggtgacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctttggagagagaagaaaggggaaagagaagtaactatagagctgcaatgtgcccagcatgttatagatgcttatgttcattttatccttgttacaaccctgtgaggtatttttatccccattttacagaagaggacactatggcccagagattttaaattaagtgcccaaggctacatgactaagatgtgatagagccaggattcaaatcaaggaccgtctgactccagggtttccattctatcttgccagatgttagggtaaggtccccaatagtacatcagggcagagaatgctgagttctggacatttgcagtttctgcagtttgtctcccacctggaggcatgcacttcaaatggtctgcagacccctccttccaagctggataacaggtgggaggcagggagctgacccctcctctgttgacgatgctggacattgcagaaaggagcactgctttaagttaactatgtgggaagaactacactgcgtgctcattctctattcccacctcccctgttgaccctgcctgccgtcatcacccaaatcctccatccctctgccttcattgtcttcatgccctttgttgaatccaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactgggtaaggagaaaatagggtttttttcctctttgagaccccagcatgccctcccctctgctcctctagctaaacctcttccatcatatcccttcctaagatattcccaaaatcttgcttggtaccccttcactcatcttcctatctccccttcctgagtctttcatgccatttttccttccttcaaaaatgttgttgaggcttagaactcagttagcatcgggactaggaaggaatgagggttactggaagaactatgggatttagccaggcccagtggctcacggctgtaatcccagcactttgggaggcaaaggcaggcagatcacttgagcccaggagttcaagaccagccacggcaacatagaaagaccctgtctctaaaagaaaaagcattagccaggcatggtagtgcatgcctgtagtcccaggtatttgggaggctgaggtgggaggatcgcttgagccccggagggtgaggctacactgagctgtgatcacgccactgtactctagcctgggtgacagagcgaaaccttatcttaaacacacacacacacacacatatacacacacacactatgggattcaaggttagctggtcacaggctatgtgaaataggaatgcagtgcttcagaaagagccttcagggccaggcgcggaggcttatgcctgtaatcccagcactttgggaggccaaggcaggtggattgcctgagctcaggagttcgaaaccagcctggccaacatggtgaaacaccgtctctactataatacaaaaaatttgccaggcgtggtggcgggtgcctgtagtcccggctacctaggcaggagaattgcttgaacccaggaggcagaggttgcagtgagccgaggttgccccaccgcactccagcctgtgcgacagagcgagactctgtctcaaaaaaaaaaaaagaaaaaaaaagagagaaagaaagagagagagagaaagaaaaagggaagaaagaaagaaagagagagaaagaaagaaagagaaaaaaaaaagaaagaaagaaagaaagaaagaaagaaagaaagaaagaaagaaagagaaagaaaagaaagagaaagaaagaaagaaagaaaaagagacttcgggttcagcaacttctgcttgcttaataaaagaaagaggctttattagggggctcctggcaaaattgggcagctgaaaagattgataaatgctcagtagcatgtgcaaagaaaaagcatctatagccttaatcttaaaggatgagcgccgggaaggaggatataggagttcaagccctggggaagaagcaggtgtgggcagagcaggggaccctgaaaaagatggaaatggtgggaagttctaaactgggaaagaggtttggctgtcagaggaaaaatgctgggccttttcctcatccagatagagtggtgaccccagatttccatgtggtatttcagggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacact

SEQ ID NO: 4694 - DNA, 8701 bp, human; identical to SEQ ID NO: 3465

SEQ ID NO: 4695 - DNA, 10006 bp, human; identical to SEQ ID NO: 3466

SEQ ID NO: 4696 - DNA, 10304 bp, human; identical to SEQ ID NO: 3467

SEQ ID NO: 4697 - DNA, 8701 bp, human; identical to SEQ ID NO: 3465

SEQ ID NO: 4698 - DNA, 10006 bp, human; identical to SEQ ID NO: 3466

SEQ ID NO: 4699 - DNA, 1992 bp, human
tatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 4700 - DNA, 10304 bp, human; identical to SEQ ID NO: 3467

SEQ ID NO: 4701 - DNA, 2758 bp, human; identical to SEQ ID NO: 3472

SEQ ID NO: 4702 - DNA, 1273 bp, human; identical to SEQ ID NO: 3473

SEQ ID NO: 4703 - DNA, 9259 bp, human; identical to SEQ ID NO: 3474

SEQ ID NO: 4704 - DNA, 468 bp, human; identical to SEQ ID NO: 3476

SEQ ID NO: 4705 - DNA, 884 bp, human; identical to SEQ ID NO: 3477

SEQ ID NO: 4706 - DNA, 3911 bp, human; identical to SEQ ID NO: 3478

SEQ ID NO: 4707 - DNA, 2016 bp, human; identical to SEQ ID NO: 3479

SEQ ID NO: 4708 - DNA, 468 bp, human; identical to SEQ ID NO: 3480

SEQ ID NO: 4709 - DNA, 884 bp, human; identical to SEQ ID NO: 3481

SEQ ID NO: 4710 - DNA, 2016 bp, human; identical to SEQ ID NO: 3482

SEQ ID NO: 4711 - DNA, 3911 bp, human; identical to SEQ ID NO: 3483

SEQ ID NO: 4712 - DNA, 70 bp, human; identical to SEQ ID NO: 3484

SEQ ID NO: 4713 - DNA, 232486 bp, human; identical to SEQ ID NO: 3487

SEQ ID NO: 4714 - DNA, 232486 bp, human; identical to SEQ ID NO: 3487

SEQ ID NO: 4715 - DNA, 232486 bp, human; identical to SEQ ID NO: 3487

SEQ ID NO: 4716 - DNA, 232486 bp, human; identical to SEQ ID NO: 3487

SEQ ID NO: 4717 - DNA, 4791 bp, human; identical to SEQ ID NO: 3490

SEQ ID NO: 4718 - DNA, 4800 bp, human; identical to SEQ ID NO: 3491

SEQ ID NO: 4719 - DNA, 2556 bp, human; identical to SEQ ID NO: 3492

SEQ ID NO: 4720 - DNA, 232486 bp, human; identical to SEQ ID NO: 3487

SEQ ID NO: 4721 - DNA, 17566 bp, human
ttaatgcctttttcagtttgattgtctacatggagatcagggtgataagtttcaataaacatatagacgcccccccacccacccccattagctagaaaagaccaggactgggttgctttaaatgaaccaagcttgaccaacaaacaagacagccatttgttcactcagatctagccgaggtaactcacaagtgcaccttgagatcctccatgtgtctgtcaacagcgataggcaggatctgcgcccagctcatgctgcattctaagaactctcatttcatttgcatataaaattcattacaggaagtaattaactgaaggaacagcatcatcaaaggctcaaggataatggaaagtaagtgcatcttgccccccaccagtcaattcagatcgtggtttgtggttggtttggttttgtttaaaggaagtccgactctgttccaaaaaccaagaacatataaactaaaaggatctatccaaaatctaaaaggcagtcttgccagttgctatggcccataatgcacacacacacacacacacacacacacacacacacacacacaaaagggctactttttgccatttaggttctgtgtttgaccagctttcaattaaccttgctgggggagagcataagaacctgggtaaatggcatactgaaagagcttcagaataatcattgcgacccctccctgcccccaccccccacgaagcttataggcactaactattcttgtcagctcaattttctaagcagagcaagagcagtgattcatttgatttttgtatgcctgatttctgggaggttggggaggaagacaaagcactgagcaaagaaaacctgctgaccaatgatggaaagttaattgtctactgtcttcaagaggcaaaaagaacagttgaatgaaattgtagcctgcttcacaaagagagttccccagccccttcctacttcacccctcacccaatagattcaatggtcaacctcctggaggatgcagtaaggttccagagacaagcagatctcaactttgataggtcgtattgcccaatgagaagccaccttttagctcaactgcccacactccagctggacagagcagctgaaaaaccacactaagtactgagaaaacttgggcctctcacaagagaagccctaggcctaggccctttgttgttatagttctgaatctgagacttctggaaacaggccaggcccaccaactcccttgcaaccagcacttcgacacttaaaataataaaacagctaggctcagttgcttttgaaagtactagaactacttggtgtgaagttcttaaccaaattccaaattccagggattttgcccaaaataaaatcaattcatccctggcctcagtttatatatgaatgccacatttgtctgctccagacttagaattccaaaaaacagacattttcctctgtagtaaatgaaggagcgtttgtgcttttgcttagcaaaaatgaaaggacaccagggtctccttgggaaccattatgactggttgaacgttaaagctgagtatgggactcacatagtataggccttgttacttctgtggacttttctggaagtttcttgtttactacttctaatgggttttgcctctcccctcaccttgctacctctggaggttttcccaaaagattctgaacctgaattctcagacaccttgatgtttgtcagttacctttagtcttgttttcctctacaatactctatatgcctggaatttttagaatatcttctacatcatcactgtggcccacgcagtggtgttcccattagcacaagaggatttggggcagaaatcatatggtcagagagaacatttaagaccggaagtattcatttaattttttaaattaattttttgtaaagatgggggttttgctatgttgcccacgctggtcttgaactcctgagctcaagcgatcctctcgccttggcctcccaaagtgctgggattaaaggagtaagccactgcacctggcctcatttaatattttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaagtaatatcagtttatcttcttcctatgaacaagtatagtccttctgatttggggtcgggggttaactccctatctcttgttgcaccaaatattttattgctacctatttttccattgctataagtctttgtgtgcctatacattaaagaatctttaatagtgttaatatcggaaaacatagttgatttctaagtaatatgctccaggtggcaagttaacacccatttcagcagggatgctcccaaggccagcccttcaacaaaagagtgactgagttgacggtctgtcaccaggatcctccctctcctctttctgctccattctcctaaaccttgcttcccagcaccaactctcttcagtgcctcctacttccttctcctcctaagaaaaacctgctctcaggaaagggataaattcatttactttgagattataaggcttaatgctacctcttttgagggtcagttgcattttaacaagggaaaagccttaagccaatggaatgaagttctacttgcagaatgttaggcatcaactagttgtagaagtgtatttttcaccatggaaaggccaaattccctgacgcctaactccagaatatagaaaatatcttaatcgcctggaatcatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtattggtggtgattattaaacttattggaggtacaactttacctccaataagcttacctttacaagcttctgctttccctgcttcatctctgttatgggctatcagtccagcttggtgtgaaaatgagactatatctataccacagcccccaatcctttcaaaggctttgcatgtatttcagctacaagtgacaaggatattagggatttaaaaggataagagagtgggaaagatgtataaggaagtgcctttgtcaaaaggcagcaaaaagtataatgatataaacataatatgaaataagcaaattttagaatactttgaaacagatttatagaggaatacatagtaaatagttatagacacacatttggggcatttttaataaggttagcaagaagaaatttgcatgagtaatgagcaatgtgaaatgggcattatacttttgttcagtaaagcccaaaatctaggccaatggttctcaaagtgcagttccaggagcagcaacagcagcatccctggagagggagaaagagagagagagagagtgtatgtgtgtgtgtgtgtgtgtgtgtgtgtgtgtgtgtgtgtatgtgcattccagtgatgttactccttcaagcccctgaatcactatagccacgactctccaactgattccaacctttaccattattctggctctcatcataaggaccagtctctggccaagaggtgtatattgttatcttggtcaggcatatgtttgcttggttttaagaaattatcagattgaggagtctcatgttttatgggactccggtgcatatgctcgaaaaaaattaaaaagaacttatcatattggatcaacaaattgctcaacctgcaaaatctttgattagacttagccagcccatctggcctgctttgggtttaaaaaaaaaaaaaagattttttttaactcacaaatggaaaaaagggaaaggtgttaagtttgtttggtattgccagctcttaaatacctgtctttaccgtggtggctgttctccagtaaggctctggcagaagtatatttgattttaagatttttgcctaaatagtagaatttgatagcaacgaactccaaaacaaaatctgaactggaacaactagttaacccctctcagcctctttgtaatgccaagctttatagacatttattccttaggtggtcttgagctttttctaacatccaattttataaaatgttgtgcatgcaaacgcagcattgtgctcattgtacaagtcacctcaaactcattccttcccccatgtgtatcatggcgaagaaatatcaatatatgtatgtgctgaggtcttctgatgaattgtaaattacaaaccttttcattcatttttaaatgagatatatttaccctggctagtggttaaagttttattctttttattatatttcactgctacttttttctactgactccaaagcttactttgggctatatttcttatttctagattgttgtatttatcttatttctatatttatctgcagtcttggaatgttagagctgaaagggaccaacctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatcattttctgtttcaccctctggttttcattgtagcaatgatacttttattcagacactcagcccagttttgagcatgtttaaccatccacacgagtatggggcccacacacattggctttgatgctcacgaacctgagagctcaaaacagctatgtggcacagaatgtcctgcagaaacctggcccactgagccatgggcctaaaggcaggtaacccatgttctgggacttcatttcagggatttgagtccagctgttcatggagtcaacaagggggagtgagcagccatcaccaggcctgaggggaggaggcagccttagcaactatccccagggcaaaaactccctctgtgttctctagctcaataaagtcacccagcaaggcagaccagagtgagtctgggctgggagggaaaaatcccaaaccaaatgtggtccagatcatttccatccctcaagaagggtatggtcccaccatgcagatggtgacagccatatttgagagtcaaatctcatcaaaagaagaaaggaactttgttctctattcccaactgtcccaggcctctaaggctgaggttcttgtagccagcatccctgtctccccaggcccctgacaccacccggctgctcttccaaaagatacaccagaactggaaatagctagaaaacctacaagggaagggagaggggccagggccaccctcagacaatagcatgtgtttaagttggagatgaaggtcagaaaaggaagctagcttgaggtgggcctcatggcaagcagtcccttggtagaaccctgcagttcagggtctggtgttcactccagcaggttcagaactcctttgtacctgtcttagttcattttctgttgctataacagaataccatagaccgagtaattaataaagaaaagaaatccacttgtttcttacagttctggaggctgaaaagtccaaggacacgttgctgcatctggagagggccttcttactgagtcataacagggtgggggacatcacatggcaagagagcaagagcatgccatcctaggtctctcttcttcttataaagccaccagtccatcatgcccgcaccacccccccgcactgccaccgaagaccaacacacaaattttgaaggacacattcaaaccacagcagtgccacaccaccataagctgatgaagcttttaaggatttactcacactgaccaaactcacaaaagacaggtcctggtatgttaattaacagaagagagaatatacctctcaaacaaaggtcataaacaggagggctgcaggctgaattgaattcacatacattatctagagtacacagtgctgtttgtcaatttttaaaaatttaggggactgggcatggtggctcacacctgtaatcctagtactttggaaggccgaggcagttggatcacctgagatcaggagttcgagaccagcctgaccaataaggtgaaaccccatctctactaaaaatacaaaaattagccgggtgtggtggcaggtgcttgtagtcccagctactcgggaggctgagagaggagaattgcttgaacctggcaggtggaggttgcagtgagctgagatcacgctgcagcattccagcctgggtgacagagcaagactccgtctcaaaaaaaaaaaaaatttagatggagcacagtctctccaatttacctcccaccactctctgttgcatcaaacccaaccagcttcattcccttatattatctgtcaggtccctgaaggcatatgagtttttgacccttacattaagttgtcatcacaggttgaagtacccaggaagcacatgcttagatggagtttactgtgtgggatgtttactagggaatgctctagggatcaatatctgtggaagagaaaggaaggaaacaagattagacaggaggcagctgggcaaggtggctcacacttgtaatcccagcactttgggagccgaggcgggcagatcacctgaggtcaggagttcgagaccagcctgaccaacaaggtgaaaccacatctctactaaaaatacaaaaattagccgggtgtggtggcaggcgcctgtagtcccagctgcttgggaggctgagagaggagaattgcttgaacctgggaggcagaggttgtagtgagctgagatcacgccacagcattccagcgtgggtgacagagcaagactccgtctcaaaaaaaaaaaatttagatggagccgtctctccaatttacctcccaccactccctgttgcatcaaacccaaccagcttcattcccttatattatctgtcaggtccctgaaggcatatgagtttttgacccttaccttaagttgtcatcacaggttgaagaacccaggaagcatatgcttagatggagtttactgtgtgggatgtttactagggaatgccctaggaatcaacatctgtggaagagaaaggaaggaaacaagattagacaggaggcagctgggcaaggtggctcacgcttgtaatcccagcactttgggagccgaggcgagcggatcacctgaggtcaggagttcaagaccagcctggacaacatggcgaaaccccatctctattaaaaatacaaaaattagccaggtgtggtggtgtgcacctgtagtcccagctactcgagaggctgaggcatgagaactgaacccaggaggcagaggttgcagtgaaccaagattgcaccactgtactccagcctgggtgactcagcaagactctatctaaaaaaaaaaaaattaggaggagaaaagagtagcaatgcaggtgtcacaaagcttctgctcactcaatggctggctctggcattcacatgacctgtccattgtcctgcattgggccaaagggcaggccttcatatctccgcttcaataagtcattggctctaggccatgccatgaagggcttgaccttgggtgagatgtctgtctcaagctgaggcaatctctgaaggaactgatagctgaagaaggctctttgctgacaccactttcagcagctggcagtaaatcctcccttgaagggggatcttggtgacacagttctttgtccatcacaggtgtctttctcccatgaatagtgcaggcgaaacacttacaaatccttattctgattccacccccacctttctttttttgagacagggtcttgctctgttacccaaactggaatgcagtggcacaatcatggctcactgcagccttgaacatctgggctcaagcaatcctccctcttcagcctcctgaatagctgggatcgcaggcatgcaccactacacctggctaattttcaaatttttttgtagagatggagtttcgctatattgcacaggctggtctcaaactcctcggcccaagtgatcctcctgcctcagcctcccaaagtgctaagattacaggcgtgaaccaccacgcccatcccaattccctcacctcctccttacttaagaccaattacacttcattttattaggtttgtagctttcttcaattgtcaccatcttaggacacgtgctagtagactttaaatagacttcagtgtttcataagcctcattagtgcctattaataaactctctccaaggacatgtcatgtcacatatgcaaatggctaaatcagtccatcacaaaataccatgaataaaatgtcactagcatctatcaggcacctacaattggccaggcatcgtgtgctcctccatccacttgttttatgcttccattcaacaaacgtctaatgagctcctacaacatgctgggcagagcattaggagctgagggtagagtagtgactgagggagacaccatgcctgcctttatggagcttaccatccagtggagccactgctgagaccaattcacatggcatccctgggaaccaggaccaatggtcctcatgttcctgttatctaagggccactaccctggctatgaactcctctggtcagcacttacttcgtactctgctctgctacccaattttccctgctcctcttcctcccatcgttttcaactgtgccttcctggaaccccagttccagggtgtcttagtccattttgtgttgatagaatatatgagactgggtaatttataaagaaaggaggtttctttagctgacagttctgcaagctgagaaattcaagggcatggccttggcttctagcaagggcttttgtgctgtgtcacaacatggtgaagaaggtccaaggggaagtggatacgtgcaaagaagacaaaacctgagtggcatcctggctttataacaacacactgtcacaagaattgatccattcctgagagaactcatccagtctcaccagagtgagaacttactatcaccagatcagcaccaagccattcatgatggagctgctcccacgattcacacacctcccactagccccacctcccaacatttggagatcaaatttcaacatgagttttggtgcagacaaacaaactacatctaaatcgtaatattccaaccctgggccccccaaaactagtgtccttctcacatgcaacctacaataattctatcccaatagccccaaaagtcttaacttgttccagcaccaatgtaaaagtccagtctcatctgagacccaaggcaagttcctaacagctataagtctgtaaaattaaaaatcaagttattggccagccgcggtggctcacacctgtaatcccagcactctgggaggctgaggtgggtggatcacgaggtcaggagatcgagaccatcctggctaacatggtgaaaccctgtctctactaaaaatacaaaacaaaattagccgggcatggtggcaggtgcctgtagtcccagctacttgggaggctgaggcaggagaatggcatgaacccgggaggcggagcttgcagtgagccaagatcgcgccactgcattccagcctgggcgacagagcgagactccgtctcaacaaaaaaaaaaaaaaaaaaaaatcaagttatttacttccaagatacaatggttgtacaagcattgggcaaacacacccattccaaaagagagaaattggacccaaaaaggggggtaacaggcccatacaagttcaaaatccagcagggcagacattaaatcttaaagctccaaactaatcttttactctgtgtaccacttcctaggcacactggtgcaaggagtgggctcccaaggcctcgagcagccttgccccatggctttgctgaataccacccatgtgggtgctctcacaggttggagttgaatgcctgtggcttttccaggctgaagttgcacactgccaggtgggtctataattgtggggtccccatggcagccctactcccatggctccactaggcattgcctcatgaacactttctgtggaggttctgcccctgcagcagtcttctgcagaggctttccaatacatcctctgaaatctaggtggaaactgccaagcctccatggctcttgcattctgggctctcacagacttaataccacatggaagtcaccaaggcttatggcttacactctctgaagtgatggcccaagcagtaccgggagccattgaacttcaaccagagtcagaaacaatgtagcagtgatgtgaggagcagcgtcctgaggtggagcaggggcagcagtgttcaggccttaccccagaaaccattctgtcctcttaggcctccaggcatgtgatgggaaaagcagcctcgaagatttctgaaatgccttcagggtctttttctccattgtcttggctttagcacctggcaactttggtttcctctcctgaaaatgctcttttcttctatgccatttggccaggctatgcattttccaaatttttctgctgtgtttcccttttctccagaaattcaccataagcagttggaagtaatcatgcagcagcctgaatactttgctgcttagaaatttcttccaccaggtattctattaaattccatctgagatggagcagggatttcctgcccctgccagttcaattctataataagccttccacagagcatttgggcatagatgtagttcgtccaagttctttgtcaatttaagacaaggatggcctttactccagtttccaacatgttgttcctcatttccatctggaacctcactagaatggcctttactgtccatatttccatcaacattctggtcaggaccatttaaccaatctctgaggagttccagaccttccatagtcatcttgtctaataagccctcatcagaatcttggttttttctagcctgctcttccaaattcttccaacctctgcccattacccatttccaaagctgcttccacatttttaggcatttcttatcaccaacactgtacttctcagtatcaattttctgtcttagtctgttttgtgttgctataaaagaatacctgagtttttccgtccactacccccatccccccagcaccactttggctgccctgcgctcactctgagctctgggctcctgctaatctagcgccgccattgtctcccttcagccgtcatcatgattatctactgggacctcatcagccacagtgagatgttctctgacagttacatgagccaggaaattgcagacgggctgcgcctggaggtggaagggaagatagtcagtaggacagaaggtaacatttttgactcgctcattggtggaaatgcctccgctgaaggccctgagggcaaaggtaccgaaagcacagtaatcactggtgtcgatagtgtcatgaatcatcacctgcaagaaacaagcttcacaaaagaagcctacaataagtgcatcaaagattacatgaaatcaatcaaaggcaaactggaagaacagagaccaaaaagagtaaaaccttttatgacaggagctgcagaacagatcaagcacatccttgctaatttcaaaaactaccagaaaacatgaatccagatggcatggttgctctgcggactactgtgaggatggtgtgacccgatatatgattttctttaaggatggtttagaaatggaaaaatgttaacaaatttggcaattactttggatctatcacctgtcatcataactggcttctgtttgtcatccacataacaccaggacttaagacaaatgggactgatatcatcttgagttcttcattattttgactgatttatttggagtggaggcattgttttttagaaaaacatgtcatgtaggttgtctaaaagtaaaatgcatttaaacttaaaaaaaaatacctgagactgggtaatttagaaaaacaatagatttctttatcttgtggttctataggctgagaagttcaagggcatggccctggtttctggcaagggcttttgtgctgtgtcacaacatagtggagaagatcaaagagaaagtggacacatgcaaagaggggaaaacctgagtggcatcccggctttataacaacccactgtcacaggaactaatccattcctgagagaactaatccagtcttgtgagactgagaattcactcactcctgcaagactgccaccaagccattcacgaaggatccatccccatgacccagacacctcccactaggacccaccttccaacatttggggatcaaatttcaacatgagttttgatggagacaaataaaccacatccaaaccatagcacagggactgctaaataccccaacaacagaaatagaaagctcccctaaacaccttctttaactgagacctggctgtctcctgagaaccccacttcgcctgtaggcctctcctcagagattctttccctcccgcaaatacttctgcatctggaggtggagtgggccccttctttgctccccactgcaccttccagaccatgaccactgtacctctcaggcacttccctccattctatccttttgcccaccccctagtcttgcccaaatccaaatcacttcaacattcatgtgaaagatctatcccacttcccacacttcttgtttcttcggcctactcacctctgttgccctccctttctgctccagtcacccactctcagggccccaagtggatcttgcgatggcccagaactgctgcaccattgaaatcttaacttcaatccccacaacctcacatctttctaactttcccatctgattacttcattacactgttcagctttgttgagacttgtatgagctcatcacaaaagaagaaatcccaatgtccaataaacatggaaatgtgcttaacctcatctactgtcagggaaacgaagaatgagggagaatggggcatgaggaaggagcatgagaaaactttttgaggtaatagatatgtgcattatcttgattgtggctctggtttcaaggatgtttactaatcaaatcgtcacttaaaacgtgcagtttgttgtacatcaattatatatcaataaagttgtaaaatataca

SEQ ID NO: 4722 - DNA, 5337 bp, human; identical to SEQ ID NO: 3496

SEQ ID NO: 4723 - DNA, 4274 bp, human
gagtccctgcttcgcagagcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggc

SEQ ID NO: 4724 - DNA, 4274 bp, human; identical to SEQ ID NO: 4723

SEQ ID NO: 4725 - DNA, 5512 bp, human; identical to SEQ ID NO: 3497

SEQ ID NO: 4726 - DNA, 4701 bp, human; identical to SEQ ID NO: 3498

SEQ ID NO: 4727 - DNA, 5540 bp, human; identical to SEQ ID NO: 3499

SEQ ID NO: 4728 - DNA, 135364 bp, human
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccacatttcagactcgaaaggcttcagccaccgcttaccccttattcaagatagtatttgcaaagggcacaaagtttcagttataagatgagtaagttctggggatctgatgtacagcagcatggtgactgtagttaatcatactgtactgtatacttgaaatttactaagagagtagatcttaagtattctcaccacaccaaaaaaaaaggtagctgtgaggtaatagatgtgttaataaacgtcattttggtaattttccaatgaatacataaatcatcatgttgtactccctaaatatacacaatttttaatgtgttgaatatagctcagtaaagcttgggaaggtgggaagatagcatttgcctgcaataggtcagaagaagaggaggttataaaactcaagagtggagaagtagaagaaagaccaaagtccctaaaaaacccatttggaagattctgtttcctgatgttaacacctatggttaccttcctgccctctttttcttgaccttgcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcaggtactcaaaataaaaatacaaagagatctggagctatgtgtgattgggggttgggggcagagtggggactgaaggaagtgaaacccaccaaaagctaagagaactgtattttgcctttccctctttcatcatctttctgaaattatattccagaaagctttcctgtattgtactgaagtggtattcttgcagtggaaacttgaaacttgctgatttgagggagagggaacagtctgttctgttacagtggaaaatcctatcctgggatctttcctaaaatgcatgactctctaagttaatctatcttgtagtcaccactgtatttattctcattgagaaaatgtttgggagcaggtatctactattttatttcatttttaaaaattgtggtgtttgtatgagggtaaatgacatgaatcagcaaaccttctggactagacacagtaaagactttatctgttgatttttatagctgtggccactgtttcagagcctgttgcttcctccctcccccaactcctgggcaaaatgaggtcagagtcagcagatgcctttaagccaacttttaaggcacttcccctcagtaaaccagcatcctttatagaactgttgagacgcaaaggtagctgcatcctcttcaacgaccaagaaaataatattaagaaaacaatattctgggctatggtgggagttgaagtactctgttgtcagttataagatgcatgtgcattcatttccattagtgggaaaaattctctctataccagccattttctccagtggtctctccaagacttaggcaatctgagctccagtcttcatctataaatcagaatattgatatttggttattttacgagtatcaatataatgtggggttgcactgtgttgtccttagcaacagcaggcatttgttgttctttcaagccattattgagagatacataggtccaccaaaaaaaaaaaaattattcaagtttttgctccacaccaggtagtacagatcattatttttatgactttttttgttgttgttgagacggagtctcactctgtccccaggctggagtgcagtggcacgatctcagctcactgcaacctccacctcctgtgttcaagcgattctcctgcctcagcctcccgagtagctgggactacatgcgcgtgccaccacgcctggctaattttttgtatttttagtagagacggggtttcaccatgttagccaggatggtctcaatctcctgaccttgtgatctgcccgcctcggcctcccaaagcgctaggattacaggcgtgagccaccgcgcccagccttttatgacttttataaaaataccattgtagaaatttggaaaatatagaagagtgtttaaaaaaattcacctgtaatcctgcccactcccctcccccaaatcctacatcctactcaacgttttctagtttgagctcagtgttttgtttgttgctatttttactagaaattaatatcagtagaattggaatttcatatctggtacaatttgaccaattttttcaattctattagaagaaatctgttatctccctgtaatgttaacactttttcttatttggcccagttataaagaatttaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaataaaaaataaaaataaaaataaaaaaaaaaataaaaaaataaaaaataaagaatttaacagaggaagggggaatagtagggaaacattgaattgcccattctaaaattttaatattccattaaataatttttcacatagccaaaaaatacctttcataccaccttaatagtaattaggaatgtttcaaaacattatagcaatgggaaacatctttcaaaaagaaaagattttgtgggaatttttaaatttatatgaactttccttattaattgcaacaggtttttattattaggtctcaatttttttctcaaacctgattcagtgttaatcaaggaccagaaaatcatatctttttttgtcattagggttgtaggtcacatgtggtctctatctaactactcagctctgtgattgtggtgcaaatgcagccagagacaatgcagtcatccctcagtatatgtgcaggatggattccagtacaggctgcttataaccaaatctctgcatactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacaccagtctgttgattcatataatttctcttgaatctatcccctcttttctcttcccttctgcctcaaccttagtctaagcccttatttcctaacacttctgtgaaaaccacatttaaattatgttatttccatcctcgacaatctttctgtggccctcatttctccacaagtaaagtcgaaacattttggattgatagacaaggccctctatgggttggtcccagcttatttttttcaatattatatcacgctggtgccctccattatacccccagttccagccaggctgatgtctttattactcctctaatcccttaataaaaatacctaacatttgtataaatactttccattgtacaacacacttccccataattaccagtattttattctcacaataccctgtgaatcaagtattatcctcaatttccaagtgaagggactgaggcccagagatgaagctggaatttgatggtaccatgaatgcaacctgggtcttatgacttcggaatcagtattgtttgaatttttgcctccgtgggagccatagacattgccacctgcaaaaatttttatgggcttcttcttctacctgcctattccctttcaatctaaactaatatcctttgaaagcctagcaccaatcccactttttctgtggtccctgtccttcctcacagaccactcacttgtacagtgatcacttctttctcaggactcctttcttggaacttctagatcacttaccatctgtgccattcaacatcttcatttttttaaatttaaaagactgtgtaatcatcatgtgccaggccctataatagatgttaaaaagaaaatggtacaaaatgtttatatgtaaccctcaacttttttttatggaaaatttcaaacttacaggaaagttgcaagaatagtaaaataaacatatttgcatatactctatctaaattcgctagttgttaacactttgtcatatttgcgtacccacccctccacacacacacacacacacacacacacacacacacacgattttttgataagccttttgagagttacttgcagacatgagtttgttttttaattcaacttccttcgtccattgacttgaaggtctttttctgaacctggcctctgcccctttttctcagggagttcattgtctgatgggggagacagatatataagcaagtagttacagtacattaagataggtactataggtactgatttatatatttgagataactactaagctctgtgggaacacacagaggtgggaatgtctaaacttctttgggacgaggcaaggaagacttcagagaggagttgggttttaaaggataattaggaaatgctgggtagactatgctgtagttagtttttaaaacatatctgtcccatttcccttttctttatgttctacaaaacctgatagaggttcaataaatatctgattgcacatatacctgggggtagagagaaagaggtacacagatatggttgtgtagttatatattcttataaagtcagttcacagatatatattgatttatgtcgtcaaaaagaataggcaagagggagagtcacttggtatggggtagaagccctgatgtatgaatgtacatgtataattaatgccatctagcacacctggatcagaaaacagttagtttggggaacacagagtacagatacctcccatcattcctacctcccgatacttcctactaattttatcttgccttggaaattagaacttgaggatagaaatggctgacaatggccactaattgagatcctccactgagtccttgattccccagatttgctgtttaaagaaaatttagatgggagtagtggggctagagggtaaagggagttgatgggtttgcaagagaaaagatgactaaggcagtaaaatagtgaagaagccaatgacatgagcccaggattcttacagaatagtataaatgctgagttctatattggtcgactagaggcccttaatatgtttttttaaaatgagttcctttaggccattgatataaagacaagactattcaagcccctccctctgcttcccattctaattcattgacttttagaaaagacagaatatggtagaaacctttgagtatgtggtgacatgtatcagaattgaataaagtttccccacagaagaggttgtgttaaatactttccataacaggtatattaaagagatggactctttcattagcatcaaagtcatatagatgtcttcttgtaggggttacagtaagtttccttgctttataataaatgtttcaggctttaaaatgtgacaagatcatgcactgcctattctttctctctttttaaaatttcttcttttgatctgtaaggggaggggaccatttatagacagaaatgacttaagaaaggggactctcccacagaaaccatttttattcttatttttccctcaataaaaggcttcataaagagttggaacttaataggtacttatccttatcatgactattgcttgtagtcccatttgaatatgttttgaagaaataacagaatcatgtggcttccaagtagattagttttcagaggtgtcctgaagttacctctgagccagcataccctggagtaacctggttggatttcttttggactgtgaaacagaaagctttttggagaaatagagaaactgttcagtgctatgttcttccaaaacacatttctacccatgccacgattgatgggccctttagtgtcatgtagtatatagttggtgatcagaattttgagatgttatgattggaaaacaaactactttaaattatcaagccccagtaagagaaatagtgatgacttgaaacttaagaatttgtgactttctttcaaggaaaacgggttgagtcaaatgaacagatcccctttatacttattctttattaaaattcactttattctttagaggacatgtccagataaatatttctgtggactcttgaagataagtcttggctagcttagaaaaaatgaaagcaatgttgtagtgaagtctttctaggccataggatgtattttagaatatcctcagagccttaggatttttgagctgacttgcccctttctccaggtggaatgtcctctaataggatggttggcttatttttacataaaccagttgaagcttggatgatttttttgacttgaaggaatcataaagtgtagcttttgattccacttttagctgtaatctgctcttctgtgtaccaataaagtaaatgtcatgtaaataggaacacaggatagggttacttgttctcaaaaggtcatgtaccatctgcagttgctgagtaagtgttcctgtatctagggatgtttataactgtcttgtttccatttatttctgcagagtgtagtgaagctgatgagaggactactgcactgcatgatcagacaggtatggtattgataacaccttcctctctaataaaagcacattgtaatagtatctctaccctttagggaatgtttatagcttatattttctttcagtttcacaaatagtacacactaattttagaaaattttgaaaattggagagggataatgtcacccataatctcacaatgtaattaccactggaatgtttctttccagtcttttttgaccctctacaaatgattttcaatgtgtttcatcattactgtacatgcaattgtgtatgtagggtgaaaagatgatacaggtttaaaaaccctcatttgaccaggcactggtggctcatgcctgtaatcccggcattctgggaggccaaggcggatggattgcttgagtccataagttcgagaccagcctgggcaacatggcgaagcgttgtctctacaaaaaatataaaaattagccgcgcatggttgtgtgttcctgtagtcccagctacttggggttagcgggggtgaagtgggaggatcacttgagcctgggaggtcaaggctgcagtgagccaagatggtgccactgcactccagcctgaaacccagtctcaaaaacaagtaaacaaaatgcacacacacacacacacatgcacatacacaaaaccctcatttgaaacccttggggccatcaactttagaatttaaagtttttcagattttaaaaaggcagtacagtgcatactcctgccaacctttaattatatggtgtatggtatatatacaccatatattaccttatgccttctgcgggtctagaacagcactctataatcagaaacattaatatctctgtagggaaacatgcaatttcatactaagtagaataaataaagacttaatttgaatctggtgttgccaacaaatgaattttaatgcaaaatttaggggaaaagccttttcaaagtgtttcagattttaagattggagataagaaaccttgaatttgcatctccttgcagtaatttgcattttcctgacctccagtgaagttgagcatccttttatgtgtagattgaaaatttgcatttcctcatggatgaattgtctgctaagtcctttgcctatcatctaggttctctttcctgcctgttgaaaagttattgtacattatagacattagtcctttgtcatatgcattgcgaattttttagcagtctatcatttatttttgaggcttgtttgtgatatttttgcatacaagagtgtttttactttaaaaaattgttttatcctaggagatcttaaagcattttgcccacactcaatcttacctgtcttttctgaagatcaagattgtgttttattagaagaagaaattgaggcccggattgctaaagtgactgcctacaggcacagaagtctatagtagaaggaaatatatagtagatagaaagtagtacatagaaatatatgatagatagaaagtctttgctactttattttgtattttagatatttgcactttcgtttttttctttttagataggggtctcactttgtcgctcaggctggagtgcagtgatatgatcatagctcactcactgcagccttggcctctgggctcaagtgatccccccacctcagcctcccgcatcactgggactacaggtgtgcaccaccatgccttgctaattaaaaatttttttttgtagggatggaatctcactatgttgcccaggctggtctcaaactcctgggctcaagcgatcctcccaccttggcctcctaaaatgccaggattataggcatgagccaccttgcctggccaatatttgaactttttaccttaccaaataggtttaaggtcactaatttcaggaaccaaatttaaggtataacggttactgtcatacatcagaggcattaattatcaaatttaaatttcaggaactaagtctttcagttgtcctttgcacaatatttccttctgacttctagttttagctttctgttttgaacccaggaaatctgagacagatctcagttaatttagaaagtttattttgccaaggttgaggacccacccatgacacagcctcaggaggtcttgaagacatgtgcccagggtgattggggcacaacttagttttatacattttagggagacatgagacatcaatcaatatatgtaagaagtatagtatattagttccatccagaaagggtgagacaactgaaagcaaggcctccctccactatgggcttccaggtcacaggtaggtaagagacagatggttgcattctcttgagtttctgataagtctttccaaaggaggcaatcagaatatgcatctatctctgtgatcagagggatgactttgaatagaatgggaggcggattttccctgaccagttcccagcttgtaggggcccaagttattttcctttcacatccccccacctttgttttttcaaatcttttggagaaagcattttacaagaaaatgaatctctgatctcaggtttcgcctgatctctcatgagtaggacagtttatttctagatgggtaggtcccaaaagctcatttttagcaggttgtgaagtctcatatcctgtgaagagaaaatggggggaggtaagggagaaaaaacaataacaaacaaaagaacaatcctggaaaaatcagtataggccctattactctgaagtccatacattattaggcaggtatgaaagtggcttatgaatgtaaataggttactgttgttttttgagatgaagcctctttctgtcacccaggctggagtgcagtggtgtgatctcggctcactgcaacctccgcctcccgggttcaagtgatcctcctgccttagcctcctgagtagctgggattacagatgtgcgccaccacactcggctaatttttgtatgtttttagtagatatggggtttcaccatgttggccaggctggtctcaaactcctgacctcaagtgatccaccagcctcggcctcccaaagtgctgggattacaggcataacccaccgtgctggccaattactgttatttttttctgaagtttgagttgtctggcttcagttcccagggttttaagaaagcacagctgagttttcagggactccaaattaggaaaaatgggggaaaaaaaggaaggaaaaagttgaaaacattattttgaagacttgtagccaaaaaaaattagaattccatccaaactgtagaaactaataaaaattgaaacaaaaattaggcaagactagaatctaacaatgggtgtcctatcgttttgaaatataattttttctctctccggtttccccttttactaaagacaaatcatggtaggactggtttgcttattatacttggcctaattatttgtatacagtgcagcaagaataattattttttacataggcttttaaatgggctttgatggaattttgttccataggaggaatctcagataagatttttttcttgagatggagtcttgctctgtcacccaggctagagtgcagtggcacgatctcagctcactgcaacctccacctcctgggttcaagtgattctcctgcctcagcctcccgaggagctggggttacaggcgcccaccactgtgcccggctaatttttgtatttttagtagggacggtgtttcaccatgttggccaggctggtctcgaactcctgacctcatgatccacctgcctcagcctcccaaaatgctgtgattataggcgtgagccaccacacccagccattagttaagacttcttgaaagccgagcccagccatgaatttatgccatcaaatatctatgagttgtttgaatttctcctcctcttggggttccaagataaacctgaggcttctgtgcctgtcggaaagtgacattctttacttaccaagggtcagaaaccctatatgtggtctgtgtacatgaaatatgaggccagtttttccaagggctttattggcttcacaagtcaagtttgattctttaaaggaaagcacaccattccagtcaaagccttggtaaaattaccagtttctccaactgtgtcccgttacaaatgaaaacagattcttattgcacttacgcaaataactgtattgccataagttaagaatactcacaaatagtttccaaattctagagaaaatcaggtagagagaaataaatatgctccaaatcttttttatggcagtatactaaattgttaaaagctgtcagtagctcaaaagaaaagttttaagtatctgaaaaacaaaacaaaggatcagcaaacattttaagcaaaaagtccaaaaaattagttcagtccatgcagttatttcttgttctgcttgatattcatgaacattttagttctccatgagtcctggaaatttttcctctattctgatgtcacaatcttcaaaagttatcagaaacctgcatttaagagcacctattggaattttatagctgattataaaaccgtcttctaaaaaggaccaaaacaagacaacaattgtccatggatgaaaaaaaagttttaaggcagccataatcaaaagacacaattgacaaagaaatttgttacctctgtggcacacaataattttaacataacaattaggaatattactgataatgtacactaagttatatcagaatttcaggagtttctcataattttggaacacataccaataacatatttatacaaatacagcccaaagaaaaccaaacaacatttcatatttgacagtgcttcctgtataatttttataccaaataagccaaattatgacatttttggacttcagggaacctaatgtcttaaaggattaattaggttagaaaaagacataatttataatttgattttggaaaatttgtcaaatataaaagtttgaaatgcttgatattacaaaagaatattacaggtcattgtttaaccaaagtgataattcaaggacttcaaaaaaagtgaaaaccttaattctttgagagaagagacttaattttctaaacaagaagccctaataaaaacagcatgaagccaattacatttgtttttcaaaattttgtaaacaatctataaagtttaaccttgattataaaatataacttccataaggcttttataacctttattaaggagttggaggagttggttaatgctttaagaaaaacctgttaatctgacacaggggtccatatactggttttgcatcagtgtgcctttcatactaatgattaatttatagagaaactgaacttattttatctttaaaaattggcctttacaatctgtgcactgtcttcttccacgatagtccctggctcatgaggaatcaaatagctttaattgttttttgccctgtatttcaggaatgcagcttattttgattggcatcttccatggggcctgaagatgaggctttaattgctgttagtgtttaagatttagcaggacttgatgtcctttttagacccaggagttaaagccctctaactcaatgtcacaaggactttaaaagcccatataggaagatacatggatgtaataaccttagtttaaaaaaatttttttttgttaatctcagtttttttcctaagcaaaaccaaaacttaataataatatttggactttctggtttgtcctgaacatccctctttttttttttttttttttttttttgagatggagtcttgctctgtggccaggctagagtgcagtggcgcgatctcggctcactgcaacctccacctcctgggttcaagcaattctcctgcctcagcctcctgagtagctgggactacaggcaagcacgccaccacacccagctaatttttttttgtatttttagtagagacagggtttcaccatgttggccaggatggtctcaatctcttgaccccctccacctgcctcggcctcccagagtgctggtattacaggcatgagccactgcgcctggcctctttattcttataactttctttacatctccttttgtttcctggttgtttttaccttgttttatacataacctttaaataagctttgaattagacaaaacttgttcaccttttattttttagcaagaatgttttcctacaatatatatttattggaaaatacccaaataattaaatatctattatttaatataactttatatcctaaattatgaccagtttttctgcaagtacttatcctattacatttacgtaattattttaattgttttaccctgattatttatgaaaactgtgatagtcgtgatttaaagttatgaaactgccattgaaaattatgactgagacagtgaaaaaagatttgacctaactgactccatcttgctcttagccccaagccgtccttgttcactcctgggcataggccaaactaactttgggaggaatttagcttatagattagctttgaaacaaagagaataacagtcctttcccaaaacaaacctccttattgtctgtgcatactgcctaaagccacaagattcgaagttacggtaatattactaaattcaagatgcagctattttcattaagcccatatcaatgtcttatttattaaaaattacacaagcaaagaatcgttctgttttgggctgggcttatagtttgtaacccctatgccaaattttgacacctgatagtatttggcagggataagtatgaaattgcttgattcataaatgtaaaacaaaagaatgtatactggcaaatcttaagacatttctaatgttactttaccaaataattttaaaactagcttatttattacagattttacttaagttacataaacttcaaaaagcatttgacaattcttttttagtatctgatttaaatgcttttatttttctttaagccaattaattagatctcttatatatgtttagtagtgaaacagtgtgtacacaacacataattacatataaggacacattaggcatgccaatggatttataaagaccccctcttttttttttcttagattttcatattcttgataacctgtttcacaaccctacacagttgtcagctaaacagctttaaatttgcacattgaaggaaacagttcaggtgaaatcaaatagcaaaatttacatcataatgtacagagagaaaggtctggtggtgcagaactacagggagatgcttttacagtgcacttaaaaaaaatttttttttttttgagacagagtctcgctctgtcacccaggctggagtgcagtggcgcagtctcggctcattgtaacctccacctcccaggttcacgccattctcctgcctcagcctcccgagtagctgggactacaggcacccgccaccatgcccggctaagtttttgtatttttagtagagacagggtttcaccgtgttagccaggatggtctcgatctcctgacctcgtgatccacccgcctccgtctcccaaagtgctggtattacaggcgtgagccaccgcacccggccaaaatttttttaaacaaagacatttctgagtgtcttccttaaaaacccaagtgtagcctctgttgcgataactattttagtcaaaaaatcaggtgaaaacagaattcagtcaactgagaagaaaaaaaaaaaaacttttgctcaaaaaaaagacaaggtcttaggagaccttgtttttttttctcaaagaaaatcaacctcaaaacatgaaggccttttaaatacaaacatgcccacatgcacacatatacacacacatcttggatgttaaccttttaattaagccgacttttaaccattgagctcttttaaaaaaaatcttttaaaatcttattactgtatttcagctaggacaaaatgctgctaaactaacaatcatcacacaaattctatgatttctgagcactctaagtgtaagcagaatttaacaccagctggttgttaatgctaacttcagtcatttaaaaagaattttcaagacagaatcccaaaccagtttcttacataatgatgggtctcaggctgtagactgctctctacggtcctagaaacaggaaaaacaaaaacaaaactcatcttccccgttagaagcgtgttcaaactccataaaggagttacctgccttccatcgacatggaggcaggaaaacttgctttccttgtgttggaagcaagtaaaactccaaaaaaagaggagttgtaacagcaaaataagctttagatctcaaccaaattttgagagatcagggattctgttgagggggtgctctcaggcctcagcaaattgtcctgttggtttgagccatcaagttagctcatgctggtaccaagcaccaacaggagatttgtcaaaggtcaggggcatctccactcagaatccaccccaccttgaggttaccaaaatgtgaaccctgaaaatctgagacaggtctcagttaatttagcaagtttattttgccaaagttgaagatgcgcccatgacacagcttcaggaggtcctgaggacctgtgcccaaaatagttggggcacagcttggttttatacatttttgagagacatgagacatcaatcaatatatgtaagaagtacattagttcagaaaagctgagacaactcaaagcaacgccccacaactgggggcttccaggtcacaggttggtgagagacagatggttgcattctcttgagtttttggtaagtctttccaaaggaggcaatcagaatatgcatctgtctctgtgagcagagggatgactttgaatagaatgggaggcagattttccctgagcaattcttagcttgaaggggcccaagatattttcctttcagactgtcatacctttactccctcactctatgtgtctctcagcagctcttttcattactccttcaaaatatatcctcttattctaatttacttcgaaatttctacctcagtttcaggaacaaatgtatcttttcacattcagttacctcttactaagctgttctcactcaagcactctgaatctcagtttatctacaatgtgcagtgtggcaaagcaaccatatgaagagtaaacaagaggcaatgaataggaaagagctgtttttgactatttggtattattttctgattaaatcacctaaattgaaaaacaacaataacagactttccagttatattagtgcagggaaaaacaggtaacgagtattttaaatattcacaattgcctgaagatagtgtatcttcacattgcaataatgtatgttagagtattacagaagtgtggcatatgggttgatttttcagtatatccttcttttaatgtttttgttcttttcaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggtcagtacaaggagagaagtgctgggagcccctgagcatggagtctggggtactaattaatattcttttaaattgagaaccgggaaggctggggtagatcttcatgaaacaggtattttttattatttattaattctcagatatcatgagatggcaaagaagggctaggtttcattgcttgttctcattacagtacattgacaagcctgccagttagtataaatacaaactcaatcacctactttatgctactctttatgaatatattataaacaaggcatctgtctataggcatctaaattatattaagaaaattaacttaggaatcagaatccaaattttttaattattgaatactatatccttttcagatggttctcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactagttaggaagttagtgaaatactttaaggcaagattgattcagaatttatgtaaggcagttaccttgagaatgaaagggcatatgtgagatttaagtggtagtatgcaagatcttcacagagtatttagcaatgctctacacatttttgaatacacaaatctccaccttggttaaaagagaggcttagacagaacttgactgcaacttacagaatgggggcaggaggggctccatggaacctcccccagcaaaacaaccataaatgttgaaaattattttttaaaaaccagccactacattattggaaattgtctgaaggacatacagcaggtagagaaacatttactccaggaaatctaccaagtattggtaaaagcagtgagggagtgtggcatttgagtctaaatctactcccccctccaccccacctcagcatggcagaagcaatattcaaggcgggtacaaccaagagcacaatctccccagctagttcccagtttagggacactgtatctctctgagggaggtaaggagatacatcctctccagctccatgttgcaaaagctagttcaggcaagaatagctgacaggcctggagttcccctcctccccaggaaaaggcagggtgagaatgctaggccctgattaaccttggcccacttcactattagggtggaggttccccactgggaggggcaaactaagaagatcaaaggctaccatcccttcccagcactcaatttgtaaagcaggggtgtcactccaaaagaagtgggccactgttctcaccactagctctggagcactggcacggaaattttgctggggagagaggcaggctgtaaggacacaaagctctgtagcttttcccaaaggaattgactttatttaacagagtgtggaaaagttaaagcctaaaggcaatctcaaaaaacaatggagatttgggttctaagcaattaagaggaggctagtagctcaataagagcaagaagctaaaccatatactagctcaatggcacatggaacatttttcaggatagattatatggtataccataaaactagcctcaataaatttgaaagatttcaaaatcacacaaagtatgttctatgaccaaaatggaatgaaattaggaacagaaagaaacctaggaatctcacaaatatatggaaattaagcaatacacacctaaatgaccaatgagtcaaattgagaaaatactttgagctaaatgaaaaagaaaatacaacataccaaaacttataggaagcagagaaaacagtgcttagagggaagtttatacctgtaaacaccaatgtaaaaaaaaaaaaaagaaagaaaaatcagtaacctaacctcccaccttaaggcactggaaaaagacaagcaaactaaacccaaagcaaagagaaaggatgaagtaataaacattacagcagaaattaatgaaacagaaaatggaaaaaacaatagagaaaatcaacaaaaccaaaagttcattctttaaaaagatcaacaaaattgataaatctttagctacattgaccaagagaaaaagagaggatactcaaattactaaaactaggaataaaagaggggacatcactacaaccttacaaaaatataaagaactaaaggggaatactatggacaactggttaccaaaaattagataattttgatgaaatgggaaaatttcttgaaagataaactactgaatctgactcaagaagcaaaggaaatctgagtagacttactacaatcgaagagaattagtaatataaaatctttccacagagaagtaagcccgggtgcagatagctttactgataaatctaccaaataaagaagagtgaacaccaattatttacaaacacttccaaaaatagaagaggtgacacttgcaacctcattctgtgaagccattactctgatgctaaaaccagacaaagatatcacaacaaagtacaattatagatcaatatctcttattaatatagacataaaaataaacaaaatactaggtaactgaatccagcaatatattaacaagtttatataccttgaccaaaccatatatattccaggaatgcaaggttgttttattatctgaaaattaatgcaatacatcatgtcagtggaataaaggacaaagatatattattgtctcagtagacacagaaaaacatttgacaaattcaacaccttatcatgataaatacttaccaaataaggaatagaggagaattttttcaacctgataaatggcatctttgaaaatccacagctaacatgacatttgatggtgaaagaatgaatgcttttccccatagatcagaataagacaaggacatcaactcttgccaccagtatctaaaattgtactggcagtttagcaagggcaaatagccaataaaaagaaataaaaggcatcaaataaatgaaggagtataattatctccatttgcagatgatacgttcttacatagagaaatcctaaggaattcattaaaactctagaataaacaaagttcagcaaggtaacaacgtacaagataaaaatgcaaaaatgagttatgtttctaaacagtagcagtgaataaccaaaatgaaatttaaaaataatttctattacaataggatcaaaaatgaaataatgaggaataaatttaacagaagaaatataaaatttgtactttgaaagatatgaaacattgttgaaagaaagtaaatatctaaataaatggaaagacatctatattcaaggatcagaagatttattgttaatgtggcaacatttcccaaattaatctacagatttaacatcaactgactttgcagaaattgacaggctgtttctaaaatttatatggaaatttaaaggacccagaagagctaaaacaatcttaaaaaagaagaaagttgaaggactcaaatttcctaatttcaaaacttactacaaagctatattaattaaaacagtacaggtactggcataactatagacatgtagctctttggaatagaattgagaggttagaaataagccatcactttatgctcagttgatttttgacaaaggtgccaagataattcaatggggaaagaatagtctcttcaacaaatggtgctgggacaactgtatgtccacatgcaaaagaatgaaattggacttcttcctcacaccatatataaaaattaactcaaggctgggcgcggtggcccatgcctgtaatcccagcactttgggaggctgaggtggcaggatcacttaaagtcaggagtttgagaccagcctggccaacatggcaaaaccccgtctctactaagaatacaaaaattagccaggcgtggtggtgtgttcctgtaatcccaactactcaggaggctgaggcaggagaatcgcttgaacccgggaggcggaggttgcagtgagccaagatcacgccattgcactccagcctgggcaacagaatgagactccatctcaaacaaacaaacaaaaaaagaaattaaatttaaaaaattaactcaaaataaattgtaggcctaaatgtaagaaggaaaactaaaacactatattagtctgccacaacagaataccacagaataggtggcttaaacaacagaaatttattttctcacagttctggaggctggaagtccaagagcaaggctggtagggttggtttctggtgaggcctcatcttgcctttcagatggctaccctttctgtgtttttacatggccttttctctatgtgtgtgcactcctggtgtgtcttcctcttcttataaggacggcagccctattgggttagggccaccctcatgacctcatttatcttcttaattatctccttgaagtccctatctccaaatatagtcatattaggggttagggcttcaatatacaaatttttggggggaggacacaattcaatacataacaaacacttagagaaaaatacaggagtaaatgtttctggccttgggttaagaaaaagcctcttagatatggcacgaaaagcataagctactgaagaaaaaatagataaactggaatgtatcaaaattaagaacttttgtgcttcaaaggaccccatcaagaaactaaaaaagcaaccaatagtatagaagaaaatattcacaagtcatatatctgataaggtacctgtatctaaaagaactcgcagaacttaatataaaagataaataacctaattaaaaatggtcaaagaatcagaattgacattcctccaaaaagatgttcagataaccaataagtacatgaaaggatagtgaacatcattaattttgaaagaaatataggtccaaaccacaatgagataccacttcacacccatcaggatgactgtaatcaaaaagacagataataagtgttgctgaggatgtggagaaattggaaccctcatacactgctggtggaaatgtaaaatggtgcggctgccttggaaaagagtctggtagttccttaaaaggcttaaaaaagagataccatatgatctagcagtttcactcctaagtatatatatacccaagagaaatgaaaacatatgttcactcaaaagcttatacattaatgtttatagcagcattacttatgatagccataaatgaaaataacccaaatgtttatcaactgataattggataaataaaatatgatacatctgcacaatggaatttttaaattttttttcatgttactgctacctctcaagatggaatattttgggcaataaaaaatgaattacaggtacatgccacaacactgacaaaccttgaaaatattatgctaagtgaaagaacccagacataaaaggccacatattgtatgattccatttatatgaatgtcaactaaggcaaatcatagagacaagaagtagattagtgattacttaggctggggggcaactgtagaagggaagtggggagtgactgctaaggggcacaaggtttcttttggagtgatgacagtgttctaaaattgattgtggtgatggtcgcataactgtgcatacactaaaaaccgttgaatatatacttcttatgcatgctttttacatatctcaataaggttgtttctaaaaatgagagaaagaggcttaatgttatacagatgagtgcagaatataagtgcaatagaccactgatttagctccatttctggagccctgtatgccttagtattctttatatagtcacctttggtctaatccagccctatctcattttatgtgtactcacctctgcattctttgttcgacaagcagtgtctgggctctacaggaggcacaggatccagaggtcctccatttatgacctttcctcaagaggctgatccctttcctgtggttaacagaggtgtttaaaatcacttaataaattttcaaacatctactgttcaatgctatttaataccgttcagaatactacgtgagatacttttagtggctatgtgagataattttagaagatgcagatataaataagatgtagttctttccttaaaattcaagtacacatttgtctataatacagagtaaaaaaataagttcataaaagtaagaaaaacaaaattctgtgaatcacaaaataggagaatcaatgatagcatcacagaggacatagcatttgagctgagccttgaaagaacagtaggatttcaagatctggagagaagaaggccatttaaatggagaatataacaagcaaaaggacataaatggtagaaatgtctggcatttgtatgatatagctgtgatgcaagtctaacagatgaataataccagtttcatacttttgccttctctgtctctgctcaatcgcattgtcacacaaagatgacaagataaagctatgaagctgatgtcccatgtcactatcatctcttctctttaccggcgtctttccaagaagttagtgtcattacgattgcaagaaaaaacacactttgccactttgcttctgcagcttccctgtgctatggatgctattttgacagagccatggatcaggaggagtttgcaatctgataataccaatcatatagttctttttaattataaagttacacagttccatgatttaaaatatatgttaatagatcaaagatttagatgtggccaggcgcagtggctcaaacctgtaatcccagcactttgggaggcttaggcgggcggatcacaaggtcaggagttcaagaccagcctggccaacatggtgaaaccccttctttactaaacatacaaaaaaattagccgggcatggtggtgggtgcctgtaatcccagctactcaggaggctgagacaggagaatcacatgaacctaggaggcagaggttgcagtaagccaggatcatgccacagcactccagcctgggcaacagagcgagactctgtctcaaaaaaaaaaaaaaagtttctgataataaaaaaatactataaacaagtccaaattccaacaaactagcaaaaatacttgcaacacatatgatgtgcaacggactaatttccttaatatttgttaaaatatcaataatagagaaagaagttttttttaaagtttaatgctgagcaaatacacacacacaaacacacacacacagtatgtttgtgtgaaccacagaaaaggggaagcaatgacagcatcacagaggagatagcatttgagctggaacttgaaagaacagtgagatttcaagatatgggaaggaagggaaggccatatgaatggagattatgagcaaaaggacataagtggtagaaatatgtggcatttgtatggtatggctgtgatacaaatctaagagatgaataaggccagtttcatacttctgccttctctcagcctctgatttctattgaattgccagtctttctggcaatatatacttacaatgcatactttttatgtatctcaataaagtttttaaaaatgacagagaatgaggcttaatattatacagatggtgcatgtatatatatgtatataccaagaccatacatatgccattttatatatatatactaagaccatacatatgcaaagactggtatatgtatgtaccaggaagaccagcaattcagtaaaaatctgaaggacatgaccaaacagttcataggaaaagaaatatgaaacacagatagcttataaatatatcaaaagatttacaaccttactcataataaaaaactggaaattaaactacaaggggcttctatttcttatccactaaagtgagacaaagattaaaaattttttttaaagcctgtgtttgcaaagatgtagggaaacaggcagtcagtgttggtatataaactgtagaatttctttgaagaataacttggagatgattatcaaaatttaatatacatgatgaagtatttagagggaagtgtacggatatctgcagcttactctgaaatgtatcaaaaaggaagatggatagatatatgatgaacaaagtatactaaaatgttaatggtggagttcagatggtgagtatacaggggtcctctgtaaaattgttccatatttttctgtttgtttgaaagtgttcataataaaacattggaaaataatatgcatacatctttgggtcagcaattccaagaatctgccctgatatactggcacatgtgcataaagatatatttccacaaatactcattgcaacattgtagtgaggaaagatttgatacaaccgaaatgtccttccgtagggaactggttacatgagtaaccgttcagtgaaatgttctgtagctattaaaaaaatgagacagatgtatttgaaattatctccaagttacttatatatgaaaaagcaaaatgcagtataatatacagtactaccctttgtgtaatgtttgtacatgcataatatatctctgaaaggatacagaagaaactggtaaaacaggtttctccagagagatttggcagtggtgaaggtgatgtggttctgggtaggaggaagactcactggttatccttcggcacagtttgatttttttcatgaaagagtattactaagtgctgacttacgaagggcgtgttaggtcttagaattctttctgaactggaatgggtgttcaggatattcacagtggagttcatttgaaagctgacattaagaaacatttgacaatcattttacatcatgcttctaagaatgtgagaggactttttccattctcaagtccttttaaggaagtttttttcatctagatctaattgctctagatatgcccactgttcagcaaactagaatttcttggctttttctggctaacacaactacatagctggcacatgtactcatttccattaaaccaacacatctgtttttgtgacaaatgcgaacaaaaaatgttttgtttaaatagaatagcctccaccaagtaaatatgagaagcttaaaagtttagtctctatagctaacctgatgttcactttttcctcctgtttgttatagaccagaaaggaaaaattagcttcctgatttttaaattctgaaatgatttcttagtttagaatcaaatagtccaaaccaagtctttcatatgtaaacagtaatatttattgttataaaagaggtatattaaaagttaactgcttagtaaattttaggtgtataaaaacttttagtgctcaggattaagtaattttgtataaaattttatgaaatatatcctgcagttttctgatttattatgattttgctttttaatataactttaaattacaaaaaattacaaaagtagcacctgtttcttgtagaatactgtaaaattgcaaaaatgtccagaaaagataaaataaaactaccttgaatctcaccaccaaagataactgctattaactaacatcctcctggttatatatttgtgtagttctgtatgtttgaggggggagatataaagagaggagtttttaagcaaaaatggatcatattatacatattaggaggcagtatagcatcttacctcctaatgaaactgcattcagcattctctgaaatgaaactgaaatcaacagtcaattgagtcccggttccactatttgttagttacatgaccttaggaaaatttttaactcctttaagcctcatggagaaaatagaggtgcttacctcttagggtggttgttgaaaaattaaatggataattcatgtaaaacattctgtgtgtaagttataatatctttgtatggcttacatttagaataattatcatttttacttaaaaatgcaatttaagtcctttttaaaatcataattttatctatttcttgcttagtatttagaccccttccagctcagttttgaaatatttgtcttttattccccaagtgcttaggtttgtacatttaagcatattataaattagttacctatagaatcagattttactttttggtaaaatctgtaaataacagttaaaattcttccatgttgaaatatgcttatatctcgcttagttggagactagcctaggacttgtttgtggtcttgtttttatagtttaagatcaaagtgccttccattgttcctaggcaggagtaggattgcttgggattagtgagatcagttagtcactatggctgcctataaagcttatagtgataattgaccagttctgtatctttattccctctttcctcaggactccatatcatccacagcctagatgaagtcaatttcatacagaaccttgtgttttacattgaagctgcatataaaactgctgtaagtactgattttagaatggattttagacatatgatgtttttgttttctaaatactgggcaactcagttgttttcttaatgctactgctcatagtgaaccaacctaaaaggcttctggcagaaattgtctttagcctctttctttattaagacctgtcatcctgtgtcttctcttcaagggggttacagagacaagagggtcaggatgctatactttcattcctttcaaactctgtgatatctcatggtatgtatttggcaatctgggctaaattgtggtcttattttaatgatttaagttcttaagagcaagatagctaggttgtattgtgggtcagttagctacttagaaataaaatttagtcatgtttgtaatattatctgtaggtgttgattcagtgcttacaatgcaaataagttatttttccttacaactaccatatgaggtaggtttctgttaaatcataatatatttaacatcttctctgtataaaatgttaagttagacactatacaggaatgcgatttttttcttcttcagtctaacatagacaacttttctttgttgttcattgaagctttattcataatctccaaaactggaaataacccaaatatctatcaacaagtaaatggataaacaaactgtggtatatccataaaatagaatactactcatcaataaaaaggaatgaactgttgattcatgcatcagtgggtgaatctcaaaggcattatgcttagtgaaagaagttagacaaaaaatgtacagactgtatgattctactcacataaaattctagaaatctatagtgacagaaagcagatccatgattgcctcaggagaggagcagagggagagataaattacagaagagtatgaggagacttttggaaattttacaaatattcattattatgatgatagtttcacgcatgaaaacatatcaaaattaatcaagttgtacactttaaatatgtgcagttctttgtatatcatttatacctccataaaaatacaaaagttgttattatttgttgaatctgtgtttccatttctgtttctgtttttgtctgttgcccaggctgaagtgcagtggcatgatcgaggctcactgcagcctcaaactcccaggctcaggtgatcctcccacctcagcctcctgagtagttgtgactaaaggtatacgccaccacatccagctaatttttgtattttttatagagacgaggtttcgctatgttgcccaggcaggtctcaaactccttgactcaagcaattcaccctcctaggcctctcaaagtgctaggattacaggcatgagccaccacacctggcctgttttccacttcttactaaccaccctcctcctttgtgaccaacacattattttttatttctgttaattggacagttatcttttaagtatatttaaataaaaattagaaattcatttaccatttctggtgtacttcttttcttcatgtagattcagatttccaactggcattatttccttctgcctgaaaaactttcttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcccggacggggcggctggctgggcaggggggctgaccccccccacctccctcccggacggggcggctggccgggcggggggctgaccccccaacctccctcccggacggggcggctgacccccccacctccctcccggacggggcggctggccgggcagaggggctcctcacttcccagtaggggcggccgggcagaggcgcccctcacctcccggacggggcggctggccgggcggggggccgaccccccccacctccctcccggacggggcggctggccgggcggggggccgacccccccacctccctcccggacggggcggctggccgggcagaggggctcctcacttcccagtaggggcggccgggcagaggcgcccctcacctcccggacggggtggctggccgggcaggggggccgacccccccctcaacctccctcccggacagggcagctggccgggcggggggctgacccccccacctccctcccggacggggcggctggccgggcagaggggctcctcacttcccagtaggggcggctgggcagaggcgcccctcacctcccagatggggcggctggccgggcggagggctgacccccccacctccctcccggacggggcggctggccaggtggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccaggcggggggctgacccccccacctccctcccggatggcacggctggccgggcgggggggctgacccccccacctccctcccggatggggcggctggccgggcggggggctgacccccccccacctccctcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtcttggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagcgcgccaaccaccagccgcggccaccatggccagacgggctccctcgaaaaactttctttaacatttcttcattcttctagtgatgaactatttcagcttttgtatgcctgaagaaatctttatttcatcttcatatttgaaaaatattttcactaggtttagaattttatgatggcagatgtttttgtctttcagtactataaaaatgttgttccactttcttcttgcctgtattgtttctgatgacaaatttgttgtcaaccttatgtttgttccgctacatgaatgtgcctttttctgctgtctgcttttaaaagtttcttttatggctgggcatggtggctcatgcctgtaatcccagcactttgggaggccgaggtgggtggatcacctgaggttgggagtttgagaccagcctgaccaacatggagaaaccttgtctctactaaaaatacaaaattagctgggcgtggtggcgtgtgcctgtaatcccaggtacttgggaggctgaggcaggagaatcgcttgaaccccggaggtagaggttgcggtgagccaagatgatcacaccattgcactccagcctgggcaacaagagtgagactctgtctcaaaaaaaaaaaaaaagtttcttttattactgactttaaacacttcgattatgatatcccttggtgtcattttcttcacgtttcttctatttagggtccatttagctccatagatctgtgcatatatcgctttcatcaaaagttttcagcaattatttcttcatattgtttttatgttcccccccttccttcgagtattcaataacatgtgtattaggctgtgtgatgttgtcccacagctcacagatgtactgtttagttttttaattcttttttccctctgtgtttcattttggatagcttctattactatgccttcgacttcactaatctttttatttacaatgtctaatttgtcactaatcccacccaatgtatttttcaggtcagatacagttttatcgctaaaagttgaatttgagtctatttttctatattccatgtatctactaagctttctgaatgtatggaatatagttataatacatgctttaatgtccttgtctgagtattctaacatctgtgtcagttccaggttggtttcagttgattgatttgtctcattatgggctatattttcctgcttcttggcatgcctagtaattttttactggatgaaagacatcatgaatcttatcatgttgcatcctagatattgttgtattcctgtaaatattcccgagctttgttcagggacctagttaatttagttgaaaacagtttaatccattattacttttaaaatgtgttttgtgggaccagagtcatgtctagtctggggctagttattctccactacataggtaagacacttctgaatactctaccccatgccccctgaattatgaagttttctagtctggctagttgaaacaggcactatttcttgtcctgtgtgagcactaggtattttttccctttaattctttgggtggttctttccctagcctcaagtagttttctcacttacatgcattcttcattattctgctgaatatttgagggggaccctctgcagatttctgtggttttctgtgtagctttctcttctccgttagtctgtcctgcaaattatggttaccttggtgtatctgtacttagcgccatttcctcaactcagggagtctgccaggctctgtttagttttctccttcctgtatagtggcctgcaaactcttacaacagtaagctgggacagtcataggactcatcctatttgctgccctttctcagaaatcactgtccttcattgtgtagtgttcattgtattgaaaaccattatgttataaatagttttttagttgttgcaggtgggaaggtaaatctggaacctgtgacttcatattcaccagaagcacaaacctaacatagataattttatgcaagcagacattatttgttgactgatggctttgcttctgacaccacaggcctgctgtggttcagtgcggaagttagggttctttggcctctccattatatccaatgattataacagtagaattattgatatttctgtattctcatactctaacctttgctgcacaaactagaatggagctggattgggggacagataaggccagtcatgggttaaacatggcttaccttcctgaaacttcactttaactcagagatttggcatgaaaagtaattaaaggtagatacagagatacagatgtgtgtgggagggtgtgtgtttgtgtgtatgcacatacacatttgcacatgtctgtttccaagttccatttaatgagagggcctagaagcaatgacacctcagtgacaatgagtgtacccagtgcccaggtcttggattctgactctcattttctgatcaagtaaaccaggacttcttatgaaagtggttgattccagggctatggcggggaaaatatgagataagattggagcatcttacagtgccaaaaagtgaagaaacgttcaaaaagggagtgttttattttgttatgttttgttttgagacagggcctctctttgtcacccacactaggattcagtggcgcaatcatggcttacttcagcttcaacctcctggactcaagctatcttgccacttcatcctccctagtagttggaactatagaagcaccatcatgcctgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaacaaaaaaatagtaacagtggaattgagaaacccagcagacatcacgttaaccaagtgatgagggttaatatcaccagtaataagacgtatcagcattgtatatccctgctatgatgcactgagaaggacacagcataatgtctgtaatacatattcttgcctaaaatgcataatctcagtctagtctaatgagaaaacattaagcaaacccaaattgaggaaaatctactaaatacctgatcactaatcttcaaagagtgtcaaggtcacaaaagacaagacttgaggaactgtcactgattagaagagacttaaagaaacatgacaaatgcagcatgaaattctggattggatcctggaatgtaaaaaggccattggtggaaaaagtggtaaaatccaaataaagtccatagtttggttaatagtattgtgccaattttaatttcttagctttaactattacactgtggttatgttagacgttaacatcaggggaagctaagtgaaaggcatatgggaactccttgtagtgtttttgcaacttttgtataagtctaaagttattccaaaataaaaagtttttaaaagtaattttaaaggctatatgattcaggggatttatagagctctggctaagagggtaggctttggagtgagattccttggattctaatcctggctctgtcacttattaactgtgtgactttgagtgagtcacttaacttctctttgcatcatcagtttcatcatctataaaatgtaaggattaagaaagataatgtaaaatgcgtaaattagtgcatggtacgttgtcagtaccaatagagagtaaaattagaatgaatgtttacaataaaatattgggctgctatttaggctccatcttgcagatctactgggtatttgctttaatgaaaaattttgagaaacacctctccagatagacagagttatagttcttagccctcctgattaactgttgaggagtcttccaatggcttggaggccccagtagaatttaaagctattggcaaagtagctgcaggggccaccccacacattagcatctccttaataagcattgtgggtatatatatatatatatggcaaattagttactcctagtgtcttttattcaagggtaaacacttcctgcatctaggaagtatttagtagttatgacttgctaattgtatattggttattttatgccaggacttcgggatatgggaacgtggagacaagaccaaccaagggatctcagagttgaatgccagttcagttggaatggcaaaggtaattttcctttcctgtttgtactaagtatgggatgaggaagtctggtatccctttgtcacagataaaacttaatgtgactgtggaccataatcaaattaattattattttaaaccacaggcaacattcagattctcctgtagaaccatggatatgtagatgaaaactttcataagctgcagatttgatatccaactgcttttgtggcatgtctctacttatattatatgccataaggacttgaaaggacttaaactaaacttatcatctctaccattacaaaaacaagcaaaagaaggcttttattcctttcgtttaccagttgaccaagctttatatcaaggaatcatctttcaatcctctatcctctttattttcctccatcccccaaatcatcatcatcatcatcatcattagcagcagcagcattactattcaacttggctctactttttcatcctacccactattgtcttctctggaaacagcaagaagacatacaataagatagcaggaataagatcaaacatatccattatgagaaatatgcatgatttagtctgtcctactaatatgcaaagatatagattgattttaaaaaataaaaggaaatccaatatatgctgtctataagagctctaatataacaaaatgatacagaaaggttaaaaacagaaggatgagcaaaatacagtctgacaagcataaaatgagctagggtgactgtgaatgtcaagtgaagtagaattcaaagtaaaaaatattgcatggaacagagaggacaaagggagtcacaatagaattttattccatttttttattttatttatttttattttatttatttatttatttatttattattattattattattttttgagacggagtctcaccctgctgcccaggctggagtgcagtggcacgatcttggctcactgcaacctccacctcctgggttcaagagattctcctgcttcagcctcccgagtagctgggactacaggcatctgccaccatgcccagctaatttttttttttttttttagtagagacagggttttgccatgttgacgaggctggtctcgaactcctgacctcaggtgatccatctgccttggcctcccaaagtgctgggattacaggcatgagccactgcacccagcctaacaatctcatagtgcactgaacaacataaccaaacatccttctatgtcatttcacacagacaaatttagttcattcttttcagctgctatacagtatttaataattgctccattgacagaattgtctttattttttaacattctagataatgctttagtgaagatccttgtacatacatccaggtaaatttacacaaatatttttataggaaaaattcctcaaagtggaacccttaggttaagggatgtatacttttaaattgcccttcagatatgaacagacacttctcaaaagaagacatttatgcatccaaaagacacatgaaaaaatgctcatcatcactggccatcagagaaatgcaaatcaaaaccatagtgagataccatctcacaccagttagaatggcgatcattaaaaagtcaggaaacaacaggtgctggagaggatgtggacaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccacatgtccaacaatgatagactggcttaagaaaatgtggcacatatacaccatggaatactatgcagccataaaaaatgatgagttcatgtcctttgtggggacatggatgaagctggaaaccatcattctcagcaaactatcccaaggacaaaaatccaaacaccacatgctctcactcataggtgggaattgaacaatgagaacacatggacacaggaagggggaacatcacacaccggggcctgttgtggggtggggggaggggggagggatagcattaggagatatacctaatgttaaatgacgagttaatgtgtgcagcacaccaatatggcacatgtatacatatgtaacaaacctgcacgttgtgtacatgtaccctaaaacttaaagtataataaaaaaaaatttcaaatgaaaaaaaaaataaattgcccttcaaaaatatttccactagtttacatttcccatcctcatatgatagatatacgtcattatgtaccatagatgtcatttttcttttcttttttttttaatcatatgctgtttctttcagtgaatgaaagtgtttgacagagaaatacctttggaaacaaatattgagaacatgttattacaacttgtttctttttgcactggtacttattattacaaatttacatatagagcttttttgccacttttctcaaactctcactacctggatattatcaatatttttgtatatttgatttaaagttttttaccatttaaacttttttactttttattttgtaatcatttgtgacttagaggaaagttataataattgtacaaagaattcctatatagtacccttcactcaagttccctacttgttaatatttgctttatctttttctctgattaaacaaaacaaacacacaaacacacaattgtttttttctgaaccagtagagagtacattgcagacatgatgccccattactcctaaatatttcagtgtgaatttcctcaaggactcttttataaccatgatacaagcatcaaaatcaggaaatgaacactggcattatactgccacctaattgatatagcccattcaaatttatttagttgtcccaataatgtgatttatagcaaaaaaaaaaaatccttttgatccaggatccagtctaagataacatattacatttaattgtaatgtctctttaggcttcttccgtctgaaacagtgcctcagtccttacttgtctttcatgaccttagcatttttgaagagcataggccagttattttacagaatgttcctcgatttgattttgtgtgatatttcctcacgatataggttcaggttatgtgtttttggcaagaataccacagaggtgatgctgtgtccttagtttatcatcaggaagcacatgatgtgaatttgtcccattactgttgatgttatcttttatgacttcattaaggtggtatctgccaggtttctccactgtaaattttctattttccctttgtaattgctatgacttgaatgtttgtggtcccccctcaccaaaattcgtattgaaacttaattaccaatgtagcagtattgagaggtggagcctttaagccgtgactggatcataagggttcttccatcatgaatgcattaatcaattcatggattaatggattagtgagttatcatgggaatgggactggtggctttataagaaaaggaagagacacttgagctagcacactcaggccccctcatcatctgataccccattccaccttgggactctgcagagtttctacccgccagaagccctcaccagatggggccccttgacattggactttatcagcatgatgaacgggagccaggtgctattcctcaagacaatggaggaaagaccccaaggcatttcagagatcttagatgctgccttttccatcacaggtccaaaggcctaggagggcagaatagtttcaggggacaggcctggggtgttctttatgggctgtgcccaggactgccttggaactgtactcccggcacccctgcttcagtgttcactcagctcatgccactactccaaaaggtccaagtgataaaccttgaaggtatccatgtggtgttaattctgcaggcccacagaatgcaagagctgcagaagcatgacagtttccacctggatctcaaaggatatataaaacagcttctgttctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccatcggtctatatctctgttttggtaccagtaccatgctgttttggttactgtagccttgtagtatagtttgaagtcaggtagcgtgatgcctccagctttgttcttttggcttaggattgacttggcgacgcgggctcttttttggttccgtatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttctatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtcagagagggcatccctgtcttgttccagttttcaaagggaatgcttcctgtttttgcccattcagtatgatactggctgtgggtttgtcatagatagctcttattattttgagatacgtcccatcgatacctaatttattgagagtttttagcatgaagcgttgttgaattttgtcaaaggccctttctgcatctattgagataatcatgcggtttttgtctttggttctgtttatatgctggattgcgtttattgatttgcgtatattgaaccagccttgcatcccagggatgaagcccacttgatcatggtggataagctttttgatgtgctgctggatttggtttaccagtattttattgaggatttttgcatcgatgttcatcagggatattggtctaaaattctcttttttggttgtgtctctgccaggctttggtatcaggatgattctggcctcataaaatgagttagggaggattccctctttttctattggttggaatagtttcagaaggaatggtaccagctcctctttgtacctctggtagaattctgctgtggatccatctggtcctggactttttttggttggtaagctatccttcacgtctaaaacaccaaaagcaatggcaacaaaagccaaaattgacaaatgggatctaattaaactaaagagcttctgtacagcaaaagaaactaccatcagagtgaacaggcaacctatagaatgggagaaaatttttgcaacctactcatctgacaaagggctaatatccagaatctacaatgaactcaaagaaatttacaagaaaaaaacaaccccatcaaaaagtgggcaaaggatatgaacagacacttctcaaaagaagacatttatgccaccaaaaaacatgaaaaaatgctcatcatcactggccatcagagaaatgcaaatcaaaaccacaacgagataccatctcacgccagttagaacggtgatcattaaaaagttaggaaacaacaggagctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacgtgcacccgtatgtttatagccgcactattcacaatagcaaagacttggaaccaacccacatgtccaacaatgatagtctggattaagaaaatgtggcacatatacaccatggaatactatgcagccataaaaaatgatgagttcatgtcctttgtagggacatggatgaaactggaaaccatcattctcagcaaactatcacagagacaaaaaaccaaacaccgcatattctcactcataggtgggaattgaacaatgagaacacatggacacaggaaggggaacatcatacaccggggcctgttgtggggtggggggaggggggagggatagcattaggagatatacctaatgctaaatgacaagttactgggtgcagcacaccaacatggcacatgtatacatatgtaactaacctgcatgttgtgcacatgtaccctaaaacttaaagtataatagtaataaaattaaaaacaacaacaacaacaacaacaaaaaaaaagaaaaacagcttctgggcccaggcagagacttgtcacaggggtggaaccacaacagagagcccccgctagagcaacactgaagcagaaacatggggttgcagcttccacagagagttcccactagggcaggaccaccactgggatgccagaactgtggagtcactggcagcatgcaaggtctgcctgagaaagcttcagataccagactgcaacccatagaagcagccacctgtgctgtacccatcaaagccacaggggcagggctgcctgaggccttagagacccaatcccaacctgcgcgcagagtcaaaagggattattcttcagctttcacatttaatgtctgctatgctgggtttaagacttgctttaagcctgttactgctttctttttgcctgtttctctcttttagaatgggaatatctctgtctgtcttatgcctgtaccaccattgtatcttgaaagttgataacttgttttgatttcagactcacggatgagattttggacttttgagtcttatccttggtgctggaatgaattaagactttgaggctatggggttagaatgaatgtatttatatgtgagaaggacatgagtttggtgagggtaaggagtagaatagtaaggcagtaattaatgagtattttgtgcctggccaacttctacttaccctataggtctcagtttaggtgtcatttcttcagggaagactttcaaaactggcttctacccccaagactaggtcaagtctgccctttaattgaggaattacagataactaataaatactagaaataatattcaatcttgttaacaatttaatgcatatgaatgcaacagatataccattttttaatcacattaggaaaaaatgtttaagataatacattgtttgcattaaggaaggtattgtcatatactgctagtgatagctatgttggtacaacttgcaagaaaagcaatttagcattatgtcttaaaaattattcatactcttttacccaatgattctacttcagggaattgatgcttacaaaataactcaaaatgaatacaaagagttattttattagcttgacagtcattattgagagcctaccgtatgccatggtttgtgctagatattagtgaagacataatccccgacctcaaggaatttataatttagcaagagatgtttatcaaagttctatttctaatagcacaaaattaaaggcgacctaaatttccaagaattggtaaatggctaaatatactttattatagccatatgagataatagtatgtcaaaatagtgtttgtaatgtggaaaaatacttacactatattattaattgtaaaaagtaggataccagatgtgatctcaactgtacacaaatagacatagaaaaaactaataaaaaacatgtcaaaaatgttaaaagtggttgttttgggtgattttcttgccctctctgtactttactgtgttttcaaagtattctataaggagtgtgttttacttttatgatcaaaaatatatttagaaaagtaagaaataaataaataaattctattttaaaaaacataatatctcatttatatgtggaatctaaagaagttgaactcatagaaggagagagtacaatgatggttaagtatgatacttgatagtgctacagactcctttttaactttctctgagacaatatgggagacaaagaaaaactcagaatgccctgggaataaataatgtttttgtattatatattctgtcagacatattcaaaagtgacatcatgtgtgttgataagatactgggatatagggagaagaaatatatatctttctaatgctaaacttgtccatttctttcttgttcctcacaggcagccctggaagcattagatgaactggatctgtttggtgtgaaaggtgggcctcaatcagttatccatgtcctggctgatgaagtacagcactgccaggtaaaatattatggaaaatggaaatagcaaattttattcttgcccagactcagatttaagcatgagctttagattaaggatagctgaatgagagacagtgcatcatctgattaattaccatgtaccaaaaatatatttaacaagcatactatactgagataagccaaatatagcatgggctataaaatagatcatagtcctgttctctagccaaaggttataaagggatcccaccatactatgtggaattatccaccactatcatatcaaagggatatggtctctctttctgagtatctccttttctaaatatataaagaaaaccagagatgatggatttgtagtattcttgttagtgtttctgaaacattctcttgttcctggttggctctaggcttagatatttggagattagactttaagtggcaaatatgtattttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctatgttcatcagggatattggcccatgggttttttgttgttcttgtgtcctcgtcagttttggtttcagggtactgctggccttgtagtgagtttggaagaattccctccccttcaatttactggagtagtttggttttagctctttaaaagtttggtagaactcagcaataaagccatccattcctggacttttcttcatcggagtacattttattactgattcagtcccattactcgttatttgtcttttcaggttttctatttcttcttggttcaatcttggtaggttgtatgtgtccagaaatgtatctgttttctctagagtttccaatttcttggcatatactttttgataatagtctctaataatcctttgtatttctgtggtatcggttataatgtctcttttttatttcttattttatttacttgggtcttttattcttagtctggctaatggtttgccaattttgtttatttaaaaaacttttcattttgttgatcttttgtattttttggccttaatttcacttatttcttgtttggtctttgttatttctttccttctattaattttgggttctgtttgttcttttctaattccttgaggttcatcattaggttgtttatttcaaatctttctactattttgatgtaggcatttattgccataaacttccttcttagtactgcttttgctgtatcccacaggttttgggatgttatgtttccattttcgtttattttaagaaattttaaaatttctttcttaatttcttcattgactcgttggtcattgaggagcatgttgtttaatttctgtgtatttgtacagtttcaaaagtttctcttgttattgatttctagttttcattgcagtcagaaaagataattgataatgatttcaattttttaaagtttgttgagacatgttttatcacctaacatatgatcaatcctggagaatgttccatgtgctaatgtattttctgtacctgttggatgaaatgccctgtaaatgtctgttaggtccatttggtctataatgtagtttaaatctggtatttctttgttgattttctgtataaatgatctatctaatgctaagagtagaatgttgaagtctcccactattattgtactggagtctaactctccttttagatctaataatatttggtttatatatctgaatgctgcaatgttaggtgcatatatatttacaattattataacctcttgctgaattgatgcttttattattatataatgaccttctttgtctctttttactttcaacttaaagcctattttatctgatataagtatagctactcctgcttgcttttggtttgtatttgcatggaacatctttttccattccttccagtttagtctatgtgtgtctttacaggtgaagtgactttcttgtaggtatcatgtgagtcttgttatccattcagccaatctacatctaaattgagaaatttaatctatttacattcaaggttattattgataaatgaggactttctcctgttattttgttaattgttttctggttgttttgtatatcctttgttcctttcttcctctcttattgtttatctttacagtttggtggttttctgtagtgataaggcttgattcctttctctttctctttctctttctctttctcctttctgtatgtgccctttctgtatgtgctcctttctgtatgtactagtgagttttatacttttgcatgttttcatgatgatagttatcatatgttcacttccagttgtagaactcccttaggcatttcttgtaaggctggtctaattctgggtatagtgttcttgcctgacaggtttttttttttttttttcagctcttagaatatatcatctcattctcttccagcctgtgagattactattgagaaatctgttgctagtctaatgaagattcccttatatgtaactttatgcttttctcttgctgtttttaaaattttctctttgtctttgacttttgacattttgactataatgcacctttgagagaacattttttggtttgaatctatttgggaactttgagtttcctggatctggatatccatatttttcccaagaattgggaatttttcagctattatttcatcagataggttttctgcacattttcccatctcttgtctttctaaaacttccataatgtgattatttgtttgctttatggtgttctgcaagtcctataggcttgtttcattcttttttattcgttttttttttgtatgcctggtttatttcaaaagatctgcctccaagttcagaaattcttctgcttgatctcatctgttgaagctcttgattgtgttttttatttcattaattgaattcttctgcgttaaagtttgttttttaaataatatctgttgaatttctcatcagatcatgaattgttttcctgattttattatctatctttattcttttatatcttgctgggtttccttaagatcataattttgagtttcttttataacatttcataaatttccttttctttgaggtctgttactagataattattacgtccctttggatgtgtcatgtttccttgccttttcatgtttcttgtgtccctgaattgatatatgcacatctggtggagcaggtacctcttccaatttatggagcagctttgatagggaaagactttcctggagatgggtcctaaggtgttggtttaggtaggatacactggctttggttctaggtggacacagttattatagtctctgtgcagtttcttgagctgtaatccacataatagatgtttgtgagtacctcaatggcctaggctgcaggagttgtgagtgtggtgggtagctttgctaggggtgggctcctgaacagactgatttccgggcctggggtgtagacatgcatgaggagaagggctgccagactgtttttctagccaaggtcataggcacatggcaggtcagctggttcagagactggtttgccaaccaggggcagggctgctgggctatttctgtgcctgggggcgtgggacttgggaactggcttgccaggggtggagccactgggctgtttctctgcccagggacatgggtccatcaggctgtttctccgtcaggctggtccagggttggctttctactatgcaggaccagagtcatggccattcctggggccaggcttcgagcagctgaggtcatggcactgcagccacctgtgtggggttggtgaaatgatggcaaagagtcaaggttggagaggtacaatggctactggcccccagagtaggggggccaactactgcactcctgcagtagctccagtttcaagatggcactgtactgcagcagctttggtcatgagaaataggaagtgcacaacatgtacttgtactctggagtaatatagttgtgtgaattctaggcagctccccaaactgggctcagcacttgggaggactgtaggattctcctatagtaaggactgcaggtgtctgggctggcaatgagggacggtgggagccttttgcttaccttttccctgcaaggggaagtccctcctgtctctgagccaatcccaataggggagatggggcagcagagccagggtgcctcgctctcctctctatgctgccatcctgggcttttctacttcacagggttcttgctgccagtcacttgctacaccacagtgctctccctcagacactccacttgaattttagttgtttattagttgttttggtccttttttgtggggaagacaagcaccaggcacctctagtcagccatcgtgctctatgttgattctttttttttttttttttttgtcagtacattccaaacatgtgtaaccaatgaacatggcctagggttttttttttgtttttttttaattggtattcacttcagtaacttcaatccacagatacaagcagtatataaccagaaagttacaagtaaacacagattatacatgcacatttctgttcacaaaggtcacatgtgcaggtacatgaattagaagcgtgcatctaggattatggccaaactgtttttaagatgcagaaatataaaattacatcttgaaaatatgaagaggtggtctacacacttcaaaaatcaaatgttgcttacaccagagatgtatgacgattacaggattcaagtgacaagcaataagatctcaaaaattagtactggtcaaagagaatgggaatatttttacgtttcactgaaaatattgactactagaatataaaatctagcaggaactcagggaaaaaaatacaaaacctaaagccaattacttaatatttcttattacctaaacaacagcatgacatttacagaaaactgcacctgcatttgaattgccaatctcattttaatgaagttctccaaaaatgaaatgcaaccaaaaaagggtcaaactccaaatgaaaagtttgcaaggctcagattaaaacatggaatgtttcagatgaaagtaataaaaatactattggttttgttctttattaaatggaatcaaatactgacatttctttgaagcttggaactgctaaatttcattttcccaaatggttctgcatttttttcttagtggtgcaagttgtcttaagtagcttacgaagtcaatctctacaaattacttctataaaacaactattcattaatcgtatgtatttttttgctataacacttaacacatgaacagacattatttctccaccaaaacaaaagagtacaatagttttcttctgtcagtattgtatttaaaaaagtttaacattaaacacaaagaaccattattttctttgaaacccttaaatcttcttgcacatcttaagttgccttcttctgtctgcattcttctgccaatttattcagaaatttatttaatttctcataatgaggaaggctgctgcaatgagtattctttgcaacttcttttgtataaaagagtgaacatagcttaccataaagccctgttttaggtattacatagtctataccaacaggaacattgggctgttatggtccaattctatactcatctgggattgtatagtcctccttgttctcatcactttggccatctgcattttcacttatgttgattcttagatgcattttactaagtgaaaaaaagccaaacctcaaagactacatactacatgattccatttacatgacactctggaaaaggcaaaactatagggaggaaaacagatcagtagttgccagaagttgggaggacagattgtctataaagatacagcactagagaattttgagggtgatggaatggttctctatggacttatgctggtggacacatgactatatgtttgtcaaaagctaaggaattgtatgccacaagaagtaaatttaaagaatcaaccagggtgtgtcaagaaagatggaattcagactgaaaaatgagtctaattacattacaaatgaatcaagtaaccacactaaaaggtatggaaaagaaaggagctgacctaagtcttggaaaacagtgttttgactagatactgcaagcctaacctaaagacaaaaataactgtatacacacactgtactctagttcaggggttagcaaattacagcctgtgggctggccatctgttgttataaatagagttttattggaacacaaccatggtgtatttacatattgtccatggctgctttcaaggtacaacagcagatctgagtaattgcaacagatgctgtatggtctgcacaatctaaaatattcactacctggtcctctatgaaaaagtttgccaacccctgctctagttgataaatttgtttctcaaaggggtactggttggcaattctgaaactactttatctgtacagtaaggttgaccaaataagtaaatatgtagtagatatagtgggtaatgagacctaggtttctcactgttacacatagggaatgggaaaagcctagaatgaaccttgtgatgttggattggagaaggtagtatcagtatgaagtgtgtatgtgtgtgtgtctgtgtgtctgtgtgtgtttaatatagggatgtgtgtcttcctatatgtgtttcctaactttgtccactgagagggcccagaggcaatgagtacacctagtgtccaaatgttggtttctaaatgtcattctcaatgaaaggacttagggctccttggagaagtggttgatttgactggggcagggaggatacaaggggagcctggagtttcatatggttctagaaaataaagaggtactcagaaaagtatggaacatgtcaaaggaacacaggaaccatctgaaaagtgcttctaatggccaaagcagaaaaaatttgaacaataaaataactatcatagtattggattataacccagagaataaatgaaatgtccataagtccatactgatataaataaataactgaaaaatgaataaataggaaagaagacagatctccctaataggagaatgtcaattaataaatgctaaaggaataaaggaaatacaaaattgccattagacaaacacaagaataacaattatttcaggagaaatctactgatggatgctaaaaccagtagacaaaagcttaagcataacgaaggtgttcgaatagtctcacagtatctcccccaaaatatttaatagttacaaatggaaaattacagtggagaaattcagcagacaccactttaaccaagtgatcagggttaacatcaccagtaataggacacattgacatcatgtactctctcatacaatgcactgagaagggcacatcacttctgtggtatccttcccaatatgcataaccgtactctgatcatgagaaaacatcaaacaaaaccaaatcgaggggcattctacaaaataactgatgaacactcttcagaagtgtcaaggtcattaaaaacaaggaaggactgaggaactgtcatagattggaggacactaaggagacatgatgactgaatgcaatatgggatcctgaattgggtcctagaacagaaaaaaggacaactgatgaaatccaaataagttatgggctttggttaatagtatcgtaccaaagttttttttttttttttttttgaaacaaagtctcactttgtcacccaggctggagtgcagtggcaggatctcggctcactgcaacctgtgtctcccaggttcaagcgattctcccacctcagcctcttgaataactgggactacggtcacgtgccaccacgcctggctaatttttgtatttttttgtaaagacaaggtttcaccacattggccaggctggtctcgaactcctgacctcaggtgcctcccgcctcagcctcccaaagtgctggggttacaggcatgagccactacacccagccaccaaggttaattttttagttttggcagatttctatggttatataagatgtgactataacggaatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaaattcagtatcattaaagggattgaacagtcaatatgaagcactttcactggtaatggaaacattgtttaaagcttagatttgatgtttgagagacattatggatttttttaaatcatcgagctcaaactcttctggtctacttcctcttccactttattttttagccttgaatttgacttcttcccctatcagtgtactaaaattatatgttctgaaacatcatcataagctcttaaatgaccaatccaatagccttttctgaatccttattctccttgacttctctatggtacctcactttttacctagccctaaattctcttgaaattcttttcctattttaattttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctctatacataatgaaaatagtttttccccattcattaaagaatatattcctaaaagtatttgaatttcacagataaagacatattgtaaatgcaacgtacagtcagttctgctataatgatacgtatgcaatctttttttgttgtcatttttaagacagggtctctcactctgttgcccagactgtagtgcagtggcgtgatcatggctcactgcagcttcgatctcctgggctcaagcagtcctcccacctcagccccctgagtcactgggactataggcatatgccaccacattcagctatttttgtttgtttgttttttgtagagacgggcctcgctgtgttgcccaggctggtctcaaactcctgggctcaagctatccctcctgcctcagcctctcaaagtgctgggattacaggcatgagccaccacacccaggccatatgcattctttaaaaatcaccatgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaatcaccatgctatgcatatttaagaaataaaaactacagggcttatgagaaaatggggtaaggagtgcagcacataaaatgtaacacatacaaaatgataggaacctaataaaaataatagtatcatggctttatacatggtaaatagttaagaaatacataaataccacaatagttaccgtactttcaccttaaaaaagacccaaagtttgcttgtgcaagtgtgtacccaagttctcaccagctcacccacctggctctcatgcccactacataatgtgcaagaggaagagaacaaaagagggattaaaaagagtgagagaaaacagagaaaaagagcataaaacagagaggaaaatttttttaaaaggctgagaggaaagaggtagaaaactgaagagagggcaaggcatgtggttgcatatccagggtggccatcagaggattgcagcttgtaagttcagtagtggtgaaaggagtgttatctgaaattggacagaaagtagtaaaaacagatgtgaataggtacagttcatcattctcctgagatatatgcatgtgtgttttgtgtattcttacatggcccagttcagctgagtacattctcagtatgaaattgtgcataaccaaacatgaaattcatgttatactcaaatttttccctaatatatcagaagcattggaacaaatttgtttacaaagaaagtgttatagcagaactatttttttttttcatcataaattacagttttgggttttgtttttttttttacattttatatattgctaagctttagcaaatggttaagcacagaacataaacttgaccataatagaacctaatttggcaggtagaaatgcagttttaagacaatacatcctcaaatctagaagctatacttaagatatacatagtggaacaagacaggcctttggaagcagactgccatggctacaccctggactcaactgtgtacttgctctgatcttccacaaatttacaacctctttgagataatttccctgtaaaaaggccttaattacacatagctcctaggatagtttttaaagttaaatgcattaaagtatgcaaaactcctagcataatatttggcctataacaagcatttagtaaataccctttcctttctattttactgggtgaataagctcctttgcaataggaccttctttggctgcaaccttctcctgggtccccaaagggactctctgtaagtctttttttcctgcctttcttttatctgcaggttcaagaatataaagaggctcttgaagcagtcctcatcaagggcaaaaatggagtcccacttctgccagagctgtacagtgttcctcctgacagggtgagtcagacagtgccataacatgtagctgatagagaagaggagcagtaccttgatcagactacctcatttgagtcaaataatttttaatcttattttgttgttctgaaagcttgtctttaggtacaggacaacataagtatgattttatttcttcaaaaataaaattttaaagcagtctcaatgatggtactgttgcacagtcagacaaggacaagaccaaaccttaatcttgagaatgatgtagagatcactaggaaaaactaggatgatgttctgtgtggactctcaagatttggtattctctatttttaggccagtaatcccggattgttttaatagatcagtcttggaaaatgaatatgtcttgttttcagactgtcattttcccaaaatgccagtcgggtgtaacattgttcctcttctccactgcaaaagagcattagacatggaagagaatagtcttccattccggtgagaatgagtagaataagctcccagcaacatcagcagcaccacctgagagcttgttagaaatagatttcaggccctacctcatacccactcaatcagaatctgcattttaacaagatcctcaggtgatctgtatgcacatcacagttggggagcactgccctagattatagtgatagtgcttcacttttcagtgcattgcatatgtagctacatagggtataaattacaatccagtccacctttttattatccagtatcttaaaccttctattattcctcatctggcctcttcatcttttcttttaggtcgatgaagaatatcagaatcctcacactgtggaccgagtccccatggggaaattgcctcacatgtggggtcagtctctatacattttaggaagcttgatggcagaggtaagaggaatcttcaaggctgtcccacttttttctgccttaagtcaccataataatcagatttttaagtagctcattaaatctgaaggatgtcttctgccttttgcactttgccttaattatagttttcctccaggtcttcagagtagggagcatggccaaccctcacaaaaagctcttgctgcctggcaaccatgtccctcctgctgcccggggctccctactttggcactgtatttggaactgctcaggccccagatctatccctttcaaaacttccctcagtgccctgcctggtgactaacagatgcatttgtgcttagctagttaattactgataatggattaagtgctaatgcttccaagcaacatgtttcattctttaactaaattaactgatatttttaggtgccatgataagtgactaggaacatcatgactttttttttctttgcttgggtttttatgtttgtttgtattttgttaagggtctctctaaatgttccttatatcagattctgttgagattgcccttaatgaggcatttgggagtttctgactttgtgtccaccttctttgtgacattttgagcctgcacagaggcattctgtttctcagaagtttttcatatcatctggcaagtctacttccccactctatgttattttgataagatataacccaggctcctagaggatcaagagtgggacttaactatcctatctgagtcagactctttgacctgtttatgtataaccactgatttttgcagctgttttgttcattttccttgtgtggctgtggccatggctgtttgattactcttagtcgacattactaaatgagtctagcaaaagtgggcagaatggtttgtttaagtaatccttacctggtgactctctcattcaattaaaataaagtaaaggcattgataaaaagaataccacagtgattggtattctttttttttctttttttaaaatttattttattttattttactttttgagacagagtttcactcttgttgcccaggctggagtgcaatggcacgatctcggctcaccacaacctccgcctcccgggttcaaatgattctcctgccttggcctcccaagtagctaggattacaggcacgcaccaccatgcctggctaattttgtatttttagtagagatggggtttctccatgttggtcaggctggtctcgaaagcccaacctcaggtgatccgccctcctcagcctcccaaagtgctgggattacaggcgtgagccactgcgcccggccagtgatttgtattcttaaggaaaaaataggtgagttcatcccatttcataaagggcagaaactcaagtcaaaagatttctgatgtgcagaaggcatagtagatacatgaacaaatgagaatacagcaggactaatggcttaaattactgataagctgtgtgatctaatcatctaatcatatgtatatccagagaagatagaggaataaccagaaaactttgtttatttataatttatacccagctgggtgcagtggctcatgcttataatcccaccactttgggaggccaaagcgggaggattgcttgagtccaggagaccagcctgggcaacataagtgagaccttgtctccatgaataaactaattagccaggcgtggtggcacacgcctgtggtcctagctacttgggaggctgaggtgggaggatcacttgagcccaggaggttgaagctgcagtgagccatgattgcaccactgcactccagcctgggtgacagagaaagaccctgtctcaaaaaaagaaaacaaattataccctacatatttataccctacctaaaaaagcatttgtggcagccaatagcaattaactctggataaaaggaattgtggtgtgaatttgggaattcaaacattttcatacagtgaaggcatttgtttcctttctacacctgtctcttgaatgttatggtgcaaggttatgggcatagggatgttgttttccctcaagtattagtttctcttttgagacttaataatctgtctttttatggtttttctttagggatttttagcccctggagaaattgatcccctgaatcgcaggttttctactgtaccgaagcccgatgttgtggttcaaggtatgtattcttattcccagtggaagaaactttatattaaaggtctggttatgggcagagatctttaggctagtaaattatgactttattctatatgttgcactttattaggcttcaaaatgtatacaatgaactttgttcggtttggtttcaaaatgctggttatcttaataataaacaaatgaatgatgttctatgtcagatgactccaaaatattatttgacacccttaaccactccttatatctggaaattattttcttttcattgtcataacattttagcctcctggttatctctgctttttctctgaccactccttctgtgctatttctactgtacttctttctttatatatccttctaatggttctgcgcttagtatttttttttttttttgagagggagtctctttctgtcacccaggctggagtgcaatggggcaatctcggctcactgcaacctccacctcctgggttcaagcaattctcttgcttcagcctcctgagtatctgggatcacagtcgcgcaccaccacgcctagctaatttttgtatttttagtagagacggggtttcaccatgttggtcaggctggtctcgaactcctgacctcgtgatctgcctgtctcggcctcccaaagtactgggattacaggcgcgagccactgcgcccggctgcacttagtcttatactcttgtctttctgtatttacactctgtattaggtagctaagcctgcctccttcatagtaaatttgcttccatggccccaactattacctctttggagaatactccaaacttttgtttttattcctaacaatttacttaaatttggggcatctactttctgcagaactctaggctgagttctataaacatgttaagaattctagtcccaatatctataaaacttctgtgccatttacatttcaaacacaaaactgacctcttttgtctccatcccatccttttcctctcctaagaaatgcaaatcgttctaccttccttatttctctcaatgatatcaccattattctagtctcttagggtagaagacttgaggtaagtttttactctctaacatcacaatccaatgtggtgttgtgaaactcctttgagatgtctccaatcacttgactttggggttggttctatatggaaaataatctcgtgtgttttctaaattttcttatacttggcatcccatgtggtcatacaggtagttcttgcttatcaatgtatatagcaaacattatataaaagtcattactcttcccttcccatgagagatcttgttctcctttgaggtttattccacctgtctatgttgatctcctggttgctctaattcattctttgaagactttgaggcctggctacagccttcctcttcctctccaaatcctgccatagaactagattttagcattgacgtcagtgcagtctaacacttcagtctcaaagttctagatatccataactctagtgacctttccttctacctatacttttagccattcactcaaaggaccaaactttaaggctctttcacttcagatacctgaaattccaatattctactctgtgatcatagtcataacattatttcaagtttctttttcttccctttacccttgtttctattttcccctagtttacccttctctacctcatggttgttcatctaaatctcccagtcaccaatgcaccataatttctattagaaccactcgaaaaatcacagccccaggtcagtgttacagtctgcattttctgatcctttacctggcctgctaaaaagctattggggaaaaaaaaagacacaaatgagcagagtggtggcactggaaatcgtggtctccaactcagctaggtttacagtgcctcctgttcatccttgttcttgttagtcagcattttcatacttctcaaccactattccacaccttctctgttttcaatccccacctctttttttcagcctaattcttggcctgctgcttcatgcctgacaatattctgatctttgtcagtgtctcagccctccccacccctacagtcttacctatccttgcctcattttctgcaatctcaggaaaagggtttcttctcctattcaaggacaagtcttccttctgatgtttgatcattatcttcttccccagcattctctagaaacttactctttcctggaatcctcaaactctcccattctgttggttctattttgtttagtctactgacatgttcatctccctctagttacactatatagcttctttctttctcatccaaacttccacttttttatcttccctttattctgcagtattttgtagtctggcttactactatgaaaatgatcttgcttaagttaccagtgacctttgtattgccaaatttggtaggtactttttaatctgtatcttactggagtatttaatctgtatcccatgtcttctatgatgccatactctcttgaatttccttcaacctagattaagcacatttctttctcattctggtcttcctcttcttctttgccccctaactattagtatttatgagaattctgtccttagcccactgctcttgcttatataaatatttctttctgttcctcagcctcctcctattccaaccttttccttcttcccttttccctctttccaccttcttacttcttccctcactctcagaagatgatctcacctcctataccatagatgaaatacaagccatgatgtaagaactcctccacttcacccccagcttttcttcatttgcccatgtcttttatgttggcattttccaaggttatattctaagtccgcttctccttttctctatgtattctccttgacccatctcatctctttctatgctaatgactcctgaatctgtatcagcttcctttaaggtagcctcacttgggtgtctcacttgccctgtaaatttattcaacatgtctaaaattattcagctataccctcctagtactacatcacccatacctgcttttcctcctatatgcctgtgtcattaaatgacacaccatcctcccagttacacaagtaaatacctagggaatcctctctctcatctcctacattcaacagttaacaagttctggctgctttatttcctaaataattctgagatccatccagttttctccagtaccaatatcttgatcctaatggaggtagtcaacatctcttccttgcattactgtagtaactttttttttttttttgagatggagtcactctgtcgcctaggctggagtgcagtggcgcaatctcagctcactgcaacctctgcctcctgggttcaagcaattctcctgcctcagcctccggagtagctgggattacaggcacgcacctccacacctggctaattttttttatttttagtagaaatgaggtttcaccatgttggccaggctggtctcgaactcctgacttcaggtgatccacccacctctgcctcccaaagtgctgtgattacaggtgtaagccacagcgcctggccctgtagtaactttttagctggtctctctgtcttactacagtctatcagtttattctctgtcaatctgaatgtactatttttaaggtacaggtattaatatggtattcctctgattatgcctctacaagggcttcccattggcagtctccttaatatgacttacaagaccctttagatctagccccgaccccatctccagcttcattttttatcactgcccctttatgctacatgttcctgttataaagggctttttataattcctagctctgccttgttttctgttcccttgagcctttgcccatgctatttcttctgtctggaacaatttcttccttacctttaccatatcctgttgcaggttaacttctattcaggcctctaggaggactctatagccgtctcattttttccatgtagggatcatgtccttaacatatggcagtgcctagcacataagaggcactaaataagaattttctaaatattttataaaacaaaaaaatgagttgcttgggttgaaggtactcctggggccccagagtattgttcacttgactgtctttcagtcccctctactcttacaaccaattcccatgaagaatcctaaggctcagtagaaagcagtttggaaagcatggcccaaagatgaaatacaaaatccttcaagtgatgcatatgcccttcacgatgctctaactcctgtctatctttccagatccatttcttttgccactatgcaaggtatattatgctacagcaatattgaagtgtatgtggttcttcccacctccctctatacatgcagccatgctgtttttcatctctgtgcttgataagttcattctggactctcttcctagaagggctatatccttcctaatcccttgtttctcctagctaacttattcattatttcaaactcagtttaggcatcaacactttgcagaagcctttcctgatactactcctcccaaccccacactacctaggtgtcactcctggatggtctcataaagttttgtgcacttatctctatttacctagcaggtcattttacaatccatgtgtatgccacttcggttacactgtgagctccttgagggaaagactaatttatccatttctgtatccctagtgactagcatagcacctcatccattgaggtacttaataaatgtttactaatgaatgaatgaattgccaaatgttttttcctggactgtcctcagccccctatcattcttcctctgcatatttttccctgaagaatctcttttattttcatgttttcagttagaagtaatcaagatggtgttatgtccaggggactctgtgatcaacatatcctgctatcctggcccagacaacagcagcccattagcatgaggttcccaagatagaaaaatacacaaaggataatggcaaaggaaggcaaagtagcactttgttaactaagcctttgcttcaaaaactcaatgtagaaaataatggtaagccaagcagtgcattctttttcctgtgaacaatccatcacatctaccagcactagaggagcaggagtagagggcacatttgccacagttgcttagtgtcaagacagctaaagcctcaattggattactggcccccagccaggtgtctgttccatatagcgaaagtgaaaaaagaatcaggaagctggcctagcctcctctcttgtagttgggcttcctacttcagtgacaggagtataagaggaagaaaagagagctgtccaggcttgtcaggctctgaatctagagaagtttcatcccccatctctccccagcacccgctacctgctgcctaaaaaacacacagtttcaactataataccttctatatgttgatgactcaaattgttatccccaattcaccatgccttctatcattctctagctataggcaactcttgtcattagggtgttctttattacccccacatacctggctctgaccttaggtttactgatacaaaagaactcggggaatcagtttttaccaaagctataccaaatctcatgatggatttttctcccatttaaacatggaatcttagatataaaaagagtgtggtattctctaggagcacataagtatttaggcaaaaagcaaaatctaatgctctagtcttgagatcttttcattttccttttccttttagataatattatttagcatgatacttattttatcaaagttcctcaataactgttcatttcctcccatttcctttttttctctttaaaagaaattatataacttgagagattgttaagttgctattgaaataaaattttctgttgacctcatcttctttgtctcctctagtctccattctagctgaaacagaagaaatcaagaccattttgaaggacaagggaatttacgtggagaccattgctgaggtataccccatcagagtacaaccagctcgtattctcagccacatttattccagcctaggtaaggagattggctagcctgctagaatcaaagcattattcattataggctggtttccatccttttttcttcttcatgattgtgtattgctttattaagctggatctgagaaggaatttagagtctctagaatccaattttcttaccttctctattctgagcaggcctgataattttaggtgtgttttatgaaccctttgggtacataaggcatgactattatcagccaatattgtatctttattccaagtgtgtgcttaaataacatgttctctcctttcttggagcctatacctctttttcaaatacttgcttattttatatggaatgatagccaaggaacttgtttttaggtcttttatactttgtcatttaatgaactagttgataatataaaagattccttaatataatacttatttttaattagtacttatttttttaattaattcacatattaaacttagtgatagattttttgcattaaacaaattactatattgttatctaaaagaaattctaaactactcttgtggaagactgaataatgactccccaaagatatacaagtcctaattcctggaacctataaaccttaacttatatggccaaatggactcatttgagatagggagcttatcctggattacccaggtggtccctaaatgtaatcacaagtgtccttataaaaggaatcagaggaagaccagactataaaagtaggagatgtgacaacagaagcaagagattatagtgataaggctatgagccaaggaatgcccacatcatctagaagctggaagaggcaaggaatagattcttccctggagcctccagaaggaatcaaccctgctgacactttggttttgattttagtcccataatgctcattttggactcatgatgccaagaactgtagaagtataaatctgtgttgttttaagccaccaagtttgtggtaatttgttatagaaccaatagaaaagtaatacaatcttaaaccacaagggagtagatttgtaaaagattggatcttaggtagtggattgccacttacaaacccagaagttagtttgtatatgtgtgtgcgcgcgtgtgtgtgtgtgcgtgtatgtgtgtatgtgtacttttttatcacccaagaatggtatgttagtaattacagttaaggcaagtattcccagcttaaaaccagtctccttcccttttctctggcacgtaactccagtcacttaatttctttgtctaaattgagagggaatcaaccaaggaggaaaggaccaagagtcagagctgacttttgtctgtctctaggaacatatatttaatgccaacaaggcttgaactccttgcattccggagctattaacatggcttctggctttaggagtatatggatttctttcttccatcttagctatgatgtaggaatgtccctttcctaaaaattcaaatataacatgattagaattttctaaagaaactttgctttaaaaagataatgaaaaactaaaatatatacacaaagaaattaacaaatttgttgaatatgtctcagatcctaataaatttctaaaatctagccacaaattagcttgaatattataaaatactcctggttccctctatttactcaaccctaactgaggtaaataccaagtcaaggctcctgaaacttctgaggctgatttgggtggatgctttgctaggtgggttacatacctcaccccttcccagaacctgcttcctgtttttattttttttggccattccctgtcaccccagacctataatgcacttctagtctccagatactagtccactagcactaaatcccttgagataaggaaggtatttccctatttagccaacatcttacccacttgagtactagttgatcttacagtcaccttctttgtaactcttagaagtctctgcagtaatgggtttatgcaagtcctgttggtgattttgacctgattctctctggctctcactcaaaagttaataggttaattttacccattgcctcattgcatctattattctaaatcggcatatcttactgggaaacaggtaacttctaagctctgggccatcatttatggaatctgcctgcctcacatcaggtctctccaacaaatagaagcaatctccttactatttactttttcaaaacctagactccatcttgggcctcttactaagttcttattttctagccaaaggaaataaaaacttaatgatgatcaaacattccaaggactcaagtgacaagtggacatttatcttcctgatacgttctttcatttgcttcattcattcattgataagcatttattgctcacttattatgtaccaggcactgggctagatgctatggaagacatagccatgcaactaaataatcacagtacaatcttataaatgctatgaccacggtgttacatataaaacacagaagaaaggggatagatttgcctggggaagtcaggaaaagcgtgatagatgaggcaacatctgatgacttatcagtcagatgagtgactattcaaaattctattattgcaacagtttcacaataaaaaaattgccctaagggtacgtcaaatgacaaccataattccatgaaggaaaaagggctatttctttaacaggtgtatttgtttatatatgttaactaaacggagttctctttctcccctcaaatgctcagtatttcattgtcagttccaaaacattttttttatttttttaaattatgagattaatcaactttgtgaaagtaagaacttaaaatattaagttcaaatctttatgtaatgctaattcttttctaatcttagtgcatatagatacattttaatagttatctttaacatgcctatattcacttgtgttctgtttgttttcacttattctctcgtgatgcatttccacatattgaaatagctatatagtatttcatcaaatcaaagtaattgtttcctgattattagctgaatattttcaagaatttttatccttctataaatgcctttgtatagaccactgttttcttaattgtatattctcagtaaagggattctggataagcttgtgaacagctttttagctcttgttacatgttgccagatgattatttacaaagacgaactaattcatagtgacataactaagatataaaatatacctttcttttttactaccccactaacattggagttttatttatttttgttagataagtaggttttagtatgtataaattattttaattttctatctttaattcccagggacctgtacgtttttctatttttgctttacctctttttttgaaactatgtgtctacaattgcttgcttatctaatagggtctgcacatttctgtatatatttatcaattatttatattttatggtaagcttttatcagtgagacttatatatatttcctagtctgttactttcttttagataattattttcttgcctgtgtacaaatctttaaatattagatacatccattttatcagatatatttttcagtccttcaagaattatgaatttatctcctaattctatctgaataggtatgctattctggttctctccaaatttcataagttgtaagttatctgattacaaattggtatgtatgcattgactgcagggaactggaaaacagacaagcacaaaggaaaaagataacaatcgcctgtaattccaccactcagaggaagccaccttttattttggcatatttgtttccaatcattttaaataaaataagtacaaacatgtttttagaaaaatgatatcattaagaatggattttgcattctgtttttcttgaaaaataacagtatatgataaactctgttacattttggtaagtagccacctacaatccagtttgatagctgtattaacgtaatttcttcaaaagttattttcataaatagcctttttctgttaattttgcaaatcgtctccttatattcttttgccatttttctactggatacttgttgatttcttactgatttccatgaggtatttttaaatatattagggatactgacactttctcttccacatgttattgaaatattttgctattttgttatttgccctttaattttgtgctgcttttcatgtatagaagttttatattttatgtagtaaaattttctctttttttggattctttccttgctgttacacttagaaagatagtcccatccctaggtcaaatacattttcactgcattttctttgttatttatggttacaattttacatttaagtcttaggctataatattaattttagtttatccaatgaggtaaaaatctgactttttgccaagtaaccaatcgttccagcactactgattgaatagttcatatataggttgttttgaagttccacctttataatttactgtacatgcatatactcactcacatgtgtggatacttttaatcttactttttggtgctgctgatcactgtttcttctttcctagtactatattttttaagttatcatagtttcaacctcaccaatgattgtgaaaatgtaagataaaagaatagtgctatgtaattttttgcccatcaattttacaaaaaaaaggtaagattgccaatatccagtgctgatgaatatgtggagatgtggacactctcagcactcctggtagtgtaaattagaggcaggtaggcattacctataaaaaaatgtaatgcacatgtctttgaccaacaaccttacttctaggaatctacccttttctttttctttttctccccccaagatggagtcttgctcttgttgcccaggctggctggagtgcagtggcgcgatctcggctcactgcaaccaccgcctcccaggttcagctgattctcctgcctcagccttccaagtagctgggattacaggtgcctgccaccatgcctggctaatttttgtatttttagtagagacggggtttcaccatgttggccaggctggtctcgaactcctgaccttgtgatctgcccaccttggcctccttcccaaagtgctggaattacaggcgtgaaccactgcacccagcccagaatctatcctatataacattcgtacaagtacacaagggcatatattcaaggatgttcactacattataatctgtggtggcaaaacaacaattagaagtactataatgtgtataaacaagaatggtagaattatgtatattgtatcatagctaaaaaggtagactttcagcttccagctgtgatgaaatagcttgtattgggctgtcatactaacaataactggaatggctgaattttaaaaatgaaggtgagtgaaggcttcagagagtaattacaacagccagaacttgagaaactaaaaccttggacagaagggacactcaaagaataaactcactattctctgtgcagtttacctttgaggcatttgctgattcttaagttttgcttgcatgaagtaaggggccaagaaactaagcaggaagtctcactgttctacggagacaaaaattgcatttcaggaccttcctatgtggaaggggctgtgataaacaccttgggctttcagttgaaacccctaaagaatggactacaccttaggagtaaggaaaaaccataaatagacgagttcttagaaagcctcaaatacaaatcctaaaacacaatcttcttaattcctgattgggctaagaagatctgcttatactgtatctgcctactaaaataaactgaatcttctctggagggaaataatgtcatccagagcctctacaattctttatacaccgtattcagcattgaaaaaagaagacatgacttagaaaaccatgacttgttattaattggtaaattaataaaattaataaaagacaaaagaaaaaaataaaacagacacccagacttctattcaacatagcttttttttttttttttttgagagaagctctcactgtgttgcccaggctggtcacaaactcttgcgctcaagggatcctcccaccttagtctctgggacaacaggcacacaccatcacagtcggccatcattggaagttctagccagagcagttagacaagaaaaagatataaaagacatccaaattggcaaagaaaaattaaaatggtctccattcacacatgacatggttttatttaaaaaacaaaaacaaaaacaaaaaaaacctgtgagaactaataaacaaattcagcaaacttataggatacagaatcagcacacaaaagtcagttacatttttatacactaaaaatgaacaatttgacaaggaaattaagaaaacagttccatttataatagcatcaaaaagaataaaatacttaagaataggcttaaccaaagaggtgaaagacttgtacactgaaaatggaaaaacattgctaaaagaaatagagaggagacaaataaatggaaagacatgctgtctttgtgggttagaagacataatattgttaagataccagtacaacccaaagctatcaacagattctatgcaagccctatcaagagcccaaatgatgatttctgtaaaatagaaaaattgttctaaaatttatatggaatctcaagggaccctgaatagccaacatgaggatgtggagacatgaaaactcttgtgtactgtggatgggaatgtaaaatgtgtcagcccctatggaaaacagtatggcagtccctcaaacaaattaaacatagaattactatataatccagcaattacacttctgagtatatatccaaaagaagtaaaaataggaacttgaacattttctacatcaatgtgcagcattgcccacaatagccaaaaagtggaaacaacccaaatgtccatcaatgaatggataaacaatatgcaatgtatacacaaaatgtatacccaaaatggaatattattaagccttaaaaaggaaggagattctgacatatgctacacatagatgaactttgaagactatgctaaatgaaataagctagttacaaaaggaaagatattgtattattccatttatatgagataccgaattcatagagatacaaagtagaacagtggttgccagaggctgggaagcagaggacatgaaaagttacttactgttcaataaatagagtttcagtctgggaagatgaaagagttttggagatagttggtggtgatgtttgcacaatgatgtaaatgtacttaatgccactgaacttaaggttattaaaatggtaaatggtaaattttatgttgtgtatattttgcagtattaaatagaaacaaaaagtaaggagtagtgggaaaacctggttgtgacatcaatctcaggtaaaatgtgtgctttactgcatggaccctggaatatgaccaaggctttaacaattctctgatgctagccccctaagagtaaagcaacactaaaactggcatatttgataagtataacacttacgtaaagcaaatgaaaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctacatgataataacaaacctgattgtatgtgtttatggggaggagaaactattttctggaaagaaagcttaaactccccatttgtcatcttacatttgaaatagtgcagctgaggtaggtataaacaaaagagtaatggatcatagattctatttctgactttgtcatttgctagccatatgatttcactaatccacgtatcatctcttagccttatttttcatctattaaaagaagaaaagccctcactggggggttacaggattaaataaaattatatacttaaaaatacttcgtaaactgcagcataccgtaaaaatgtcagaaattattatatgtgccagttaaccccagatactttggaatgtattagacattaaatgtgggggtatcattgccctgtgacatcttggatactcttctgaatatatgagtagtttaaaatattacttgataattgtgagagtaaattaatctaatctattatttttatttgtctcagtttatagaccagcaacagttctacctggctctggacaacaagatgatagtggaaatgcttagaacagacctctcctacctctgtagccgctggcggatgacaggccagcccaccatcaccttccccatctcacacagcatgcttggtaagggctgcatgaggcaaggaacgaatgtattttggaaataagtcatagatttagcccttcaacatcttgttgtttctagagagctacttcttataatttattctttcagcagtatttattggctcctattttatgccaagcacttttctaagcactggggacacatggagtgaataaggcagatgaggtttccgttctcatggagcttatgctttagaaggtgaagacagactatatgtaatacataaatcaacatacaagagtaatttcagagctataattgaatagttttcagatagtttgagagctataattcaaaaaatgtagtggaggataatttaaaacttggttggtggttactttagataattagtttctaggtcaattttcagaaattttattcatacaattatttttaaagacagtaatactgtatctgcatatttcttactctagtggtacatcaagattttatagataatttcccaggctgcttcttccaaagcctaacggaagctgtaaaatctagtaggggaaaaagccaaaaggcttttggcttacgtttcctcttttttttttttttttgactggatttcctgacattgcttacttgaaactgggtgaaaggctttattattctctcagttcctggaggactagagccaatactgaagcgactgcttcctttctgtgtttctcctgttgcttccaaagacctgtttgtactgccaaagtatatagaattccttttcattaaagaaaaatcccttattattaatcattcaaaatccagacagactgttagggattttggtcacatctcaaaagtgcttcaatatcacaggatttgaggaagtagggtagtctttcttctctttgtctttcttcattacttaagacagttaacacaagtacccatttaaaaactactatatttgcagaattgtcttcagaaagtataaagtctaattggagacgaaaagctaatatgcaagaatgatagaaacaacttaagacaatatataaagaattactaaaccattaggtcagtattttacagtgaaggagatccagttgacaaagaaaatttctcaactgaggtaggacttaaccaggctttttggaatggatagtattcagatgacaggagagcagaaggaaaggtactataagtgaggaggaaaataccatgagtgagccctagaggcaagaatgaacttgacctgtgagaggagaatgaagttctcctgaatagagtggagtttgtgtgttggagtataattataagcaaaatgggaaaagtaaggtagggttcaataatgaagaccttgaaaataagcaaagatatttaatatagatttttctcagaagtctgaaactatcaaaaggttttgagcaaggagtaatatgataaaaatgatgtttggggactattggtgacagtacacattgtagtgaggagagactgatgtcaaagaaactaatccacatatgaggtgaagagaaagtacactggattggaggtaataaaagtagaatgaaaaagaaagatatgagtcattttaagcaacacccaactcagatattggataactagatataaggtatgaattaagatagctataacaaaataccaaaaagttggtaatttataaacaatagaattttattttgtactattctgggagctaggaagtccaagatcaaggtgctgacaggtttggtgtctgggaaggacctgaagtctctccttctaagatggtgccttgttgcttcatcctctgcagcagacacacatgtgttcttacattgtagaagggacagaaaagaagcaaacccactctcttaagcccttttataagggccccgatcccatccatgatggctgcacactcatgacttaatcacactagatggcctacttcttaatgctatcacattggtgattaagtttcaacaaacgaatttgggggcacattcagatcatagcactaggtaaatgttgctgcattgatagaatcagagacattttatatgaagaagccagttataaagggacatgaatttgtagtgacaaagagatttcagaattgaaatacctgagagttgggatgagatacatagccacagcttgggaagcagaataaaactaaagatctaggcttaaatcaagcatttttggtacttgatatgtggtcacataacaaaaacaacaataacaatagcaataataactgtaatatttactgaatactttctctgtgccaggcactgagctaagtgttttcaattaattattttgaaatctctacaacactcttattcaggcaggtactcattatccaaagtcacaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattagttaaattctcatattacagacaaagattcctgtaatacataaaagagcaaaaataatacataaatggcatccaggtggatgctatttacaatagatatccctaaaataaaatcataaaaaaagatggaagaaaagaatatgtaaagatatatcatgtaaatgctgacaagaaagcagtggtcgcagtattaatatcaaaaatagcaaataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtatatataactatgtatccaaaaaggcagaacacacaaagaatgtttatggttaaaaagtagaaatcatacaaacgatattgccagatacgtgacataaaactaattaacacagaatagttaaaaagaatctaactataaaggaattatattttttcccaaataattattagattaaagagaaagtcaaatttgaaattatatgcttcttagaaatgaaaaatgataccactacttataatttatgagatttggtcaaaatcatatttagaaaatttcatatccttaaatacttctacttttaaaaagtgacttttagttttgagacaagatggcatagactcacttctccctattcctcctgctaagtgcagctaaaaatccttgacatatataaaacaaacataagaaaactctgaaagttggaaaccaggcagatcagctagagactttaagacctgaagaacagcagagcagtaaatatcctgggccttatatgtcctggactggaagctagagaagctgacatctcagaaatacaaaaagaaaaaaaaaaaaggaaaaacaggtttttttaaagacccaaggaaaatctgctttgtctagctgaaggaacaggaaaggagcaacctagagagacagaaaacttttagaccctattttactaggccccacttatgcccctgtcagcagagactgagtggggactctagacttccacgcttgcacagctctgaagaggcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagtaaaaaaaaaaaaaaaaaaaaaaacctgaaaaaatatgaacagagcctcaaagacctgtaggactaataacaaaagatttaacattttttaacattcacgttaaaaagatctaacattcatgttataaaagtttcagaaagaggagaaaaagtatgagagaaaatcagaaaaagcattccaactaataatgactgaaaaattggtaaaagacataaacctacaaattttttaaaaaatgagaaaatcttaaacatggtaaaatccatgtcaaaacacataataataaagttcttgaacattaaagaagaaatatcttgaaagtggccagaaagaaacaataccatttctataagcaacaaacagaatgacagcaaatttatcatcagaaaccatggacaccagagggaagtgacacaacattttttaagtactgaaaaaaaaaagaattttaaaccaagaattttgccctatccagtgtacttcaagaataaaaggaaaaaagacattctcagatgtaggaaagctaagtgaatttgtcagcaggagatctgccctaaaagaatggtttgaagaaagttcttgaaacagaaaggaaataataatagatggaatcttgaaacatcaaaaagaaaaaataaaaataggagtgaaaatatgagtaaatacaatagactttctccacttcaattttccctttctttctctctctctctctctctctctctcccccacccccgctctttttctttttctttttctttttctttttctttttcagagtctctctctgtcacccagcctggagtgcaatggcacaatctcagctcactgcaatctccagcttccgggttcaagtgattctcctacctcagcctccccagtagctgggattacaggcatgcaccaccatgcccggctaagtttttgtattttttttagtagagacggggtttcgccatgttggccaggctggtcccgaactccttccacttcaattttctaaattatgcttgataagcattgcttaatatagttctcaaagtatgtagaagaaatattcaaggcaagtatattataaatggggaaaagtaaggaccttaatgggagataagattctatacatcactttaattggtataatgttgacactagtaaagagtgatatatgcatcatgtttgtatatataagacaatgcctggagtaaccactaagaaacctatagaaggagataacagtcaaacccagtataggtaaatcaaaatggcattctaaaaaatgtaaaagtaacccataagaaggcaggaagaagaaaatagacaaatgaagaacagaggtacaaatagaaaacaataaaatggcaaacttaatcctaacatatcaataattactttaaatagcctaaatacatcagttcaaatatcacaatatacgtagactgaaaagaaaaggaaggaaaaagatataccatgtaaacattaattttaaaaagcagaagtagctacattaatatctggtaaagtagaactcagagtaaagaaaaaaacaggtagtaaaagtgttaggaaagacaaaggagatatagcaacagaaatagaggagactttaaacactgtaaaagaataccaactacaattttgtacatctagataaaattgacagattttctagaaaagtaagaatacaagtataagctgaataggaacacttataaaagtgtatgagaaaaactataaaactattgaagacaataaaatattttaattagtagagaggtacaccatgttcctagacataaatagttaatattgagaaattacccactttcattatatcaattcaggcaattcccaataataataaaaacataaatttttatgaacaagctgaaccttgatttcatatgtaagagaaaatgtaaatgaataaccagatttttaaaaagaaagtgaaagatccattgtaattaaaacaatgatgaagatagaatttcaaatagagacaaaatttaatataaatacatttgggaaaataattcatttaggcttgctactttactttttttgcaaaaatacattctaaatagattaaagagctaaacataaacaataaacctgtgagagtcttagaaaaaaatatgggaggttgggcagggtggctcaaacctataatcccagcactttgggaggctgaggcgggaggatacttgaggtcaggagtttgagagcagcctggccaacatggtgaaaccccatctctactaaaaatacagccaggtgtggtggcacgcgcctgtagtcccagttacttgggaggctgaggcaggagaatcacttgaacccgggaggcggaggttgcagtgagccgagattgcaccactgcactccagcctgcatgacagaggcagactccatttgaaaaaaaaaaatatatatatatatatttatatgggaatatatatatatatatatatgggaatatttttgttatcttaggttgaagagagctgtcctttgcaagacacaaaaataaaatattgtcagattttgaaacatgaaaatgaaatcttttatatcaaaagcactgtggatgcggttgaaagaaaaataataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacgaaatcaggagattgagaccatcctggctaacacagtgaaaccccgtctctactaaaaaaaacaaaaaaaatacaaaaaattagccaggcgtggtggcgggcgcctgtagtcccagctactcgggaggctgaggccggagaatggcgtgaacccgggaggcggagcttgcagtgagccgagatcaagccattgcaccccagcctaggtaacagagcgagactctgtctcaaaaaaaaaaaaaaaaaaaaaaaagtgtaggaaaaagtctttctatactgttggtggaaatataattggcacaactcttatagtgggtaatttggcagtctctgtaaatttacttagtaagtgtttcatttgtcctaatagttctacttgtaagaatttaacctaaggatataatagaataagtgcatcaagatgtaggtacaatggtcttcattacagtgttgattataatataaaacagtctaaatttagtaagaattatttttagctattacaaaggtaaagttagaaagcagatcatgaaagagtatatgtagtatgattacttccacataaaatcaggtaattgttagctttctagatattttttatgcctatacacagacatatgtgccaaggttctttatatgagataatgtgtataaaatgtttagcacagtgcttggcacataacattcaacaagtagtggctactggtattatcagcattcagtagtcattcagtgttctgccatcagacactgtgctaagtacttctgacaaataagataatgctgacaaataagataatgcctttgaggaaatctatcagtcatcatcccttaccatttacccattcttaagtgttgttggctctcagatgaattgttaaaatcaggatggtcaatgaggagtgtctcatttgtattgtaaccaccagaatgttgatttgaaataattacaagatttctccctacttcagagttaaaaccacaaagattgttttaaaattctgttcatttcaagatgaagatggaacaagcttgaattcaagtatcctggcagcactccgaaaaatgcaagatgggtattttggtggggcaaggtaagtgacctctatacactctttagtgaaatgaaatgaaattaaggggctggatatagtagtggcatacctgtgatgcctttctgtgtatgatagtccccccttatctacaatttgactccgatatttcagttacccgtggtcaacctgtagtctgcaaataggtgagtacagtacaataagatattttgagacagagagagagactacgttcacataacttttattatagtatattgttataattgttctatttcattattattttgagctcttactatgcttaatttataaattaaactatatcataggtatgtatgtataagaaaaaacacagtatatatataaggttcagtactatctgcagtttcaggaatccacaagggggtcttggaacatatcctgcaggagtaagcgggggctaactgtatcttcgataacataatcccatcctacttagaggagtttgatagattgaatcaaggaatttaatgttgtagaggaaggttggaagtttttcctaccctgttctttgcctagatctcaaaggatcagaaaacctgttttgttttgtttttttaatgcctactggattatttgattccagctgcttttcttttctttttccacttaagtttttattttgaaaaatttccagcttacagaaatttgcaagaatactactgaacacccatataccctttctcaagattcacctgttattaacattttgtcccactgtgcattctctatttcttcccttccctcccttcctgcctttccccccttcctttctctcttcctccctacatcctcccatacacatacatatgcatatacacacacacacgtacatactacatatactatgtgttttatatatatatacatatatatacacacatgtacacacatgcttttttgctaaaataattagccatagacatcataactcttcaaccctaaatacttaagttttctttgttttgtctaggaacaagtgcattcttacatataactataatataatcatcacacttagtttgggaggccaaggggggcagatcacttgaagccaggagttcaagaccagcctggccaacatggcaaaaacctctctctacaaaaaatacaaaaattagccaggcgtgttggtgcatacctgtaatcctagctacttgggaggctgagacatgagaatctcttgaacctgggaggcggaagttgcagtgagccaggattgtgccactgcactccagcctgggagactgtggaaagcagtttggagatttctcaaacaacttaaaatagaactaccattctaccctgcaatcccattactggatatatatccaaaagaatataaatcattataccatagagacacatgcatatgttcatcacagcactagacacaatagcaaagataaagatgggcatcaacctagatgcccacctatggtggacttgttaaaggaaatgtggtatataatgcaccatggaatactacagtgccataaaaaagaacaaaatcatgtcctttgcagcaacatgaattcatatagaggccattatcctaagcaaattaacacaggaacagaaaaccaaataccacataccacatgttctctcttataagtgggaactaaacattgagtagacatggacacaaaaaaggaaacaatagacaccaggaccttcttgaggatggagggcgagaggtaggtgaggattgcaaactacctattggatactgtgcttactatgggtgatgaaatagtttgtacaccaaacccctgtgacatgcagtttacccatgtaacaaatctgcacatgtacccctgagcctaaaattaaagttggaaataaataaataaataaagtagaaggagaaataagaacagttacccaattatcccaataatgttttatcatagctgttttcccaccaatccaggatccaatcaaagatcacatgttagcagttagttgttatatctctttggtatcttttaatctagaagagttctccagccttttgtcaatctttcatgagagttttcattacatttttgaagaatgcaggtcagttattttgcagaacatctcacaatttggatttggctggttgtttctcattattagattcaggctacatgtttttggcaggaatactacctgtgtgatgttgggtccttgttttaagttaggatctttaagatggagagcaccccttcaatggttaggagaggcacaagatggaaataaagattttattacttacaggtcctgcaggtgaggtacacagaatacctggaggccacacacactgaggtcagggagcatgtggagagagaaaaagagagacccatgggccaatgcctttattgaggtccagggcattatccaaacagatattccttggggagttttaattggtgggtttaaagcaagtaggcatgacttcctggaggtcacactgtgactgagaggtggtcactgtggcatattggcatagttcatgtaggatgtgaggatcagtgaggctagtcaaatagatcatatttagctgtcccttagggaggtggttaccaggaggaagttgtataaggcagatatgtggactgaccacagtgaggaactgagggaggtgtagaactggaaactgtcaaagattcctgaactctgcttctggtatgagaaagttaagcttatattcaaaagagatgccagggaaacatacaattataagaatttactacagtctctttcagtgcatcatatcagaggcacatgagatttgtttgtgacattattgggtgatgataaccttgatcacttggttaaagtgttcaacctggtatctgccaggtttctgcatatcctttctccaacagtctttgatcaaatcgtattagcttccgttgatccttgcgtgaattcacttattactattggagttattaaatggtgtttctatcattctgtgtacatttattggttgaaattcttatgttaaaaaaaagagctttcccttccccccttttattttgtagtttagtatcagcacagattcatagattattattttattcaatatgccatgatccatttctgttattatttcaatattttaattatccaaggtgtggccattgatagccccttcaagttggcctctttagaaatttggtaatgctgactttgcttttgggttttgtaattgtcttcataagtaggagacgatatggcttacagtctactataatttacagaattgtcaagtaccatcctttatgttcaaatgacctttgggtatttttttaatgaagtgatgggtttgtgatgatttatcttcattctctccaggcttctccagtagccaatgcaaatttttaccagatgtttggcatagttagcaacgtaatatatggcagtagaagagagcaaaactggtctgctggtggattgttaatccataattgtaacctttattaatacagtcccctaaccatttaagatgtacaccatgcctaggagtgctgtaaaattttatttttataaaatttatattaatgtatgcacattagtaatcccccaacaaaacatgttaggtgtccttttatcactaagattgtgttgtttaaaaaggatcacccctgattttctgttttctatcctcctctaatttttagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatggtaaggaggcttcataaagcactggcctggctggacaaaactacaaaatattgtttagcaccatccttaataatttatgctgccagcagtctcacagtgttctatcctcactctagatctctacttttgtttggctttacttttcctccctctacttacctttggtttctggtctaatattcctgcggtaattgtggagtatggagttggacagtcccttactaagattggggaagattcctctcccaggcatttgaagtggctggtgattttgacatgggaagaagcagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaaaaaataaatttgctgccctcagtgaggtcagccagcacaatctcatacaataggacaacacattagcagtcagaaggactattttcttttttgggcccgacatttactcactaagcaccacttcattcattctgtgtttgtttttgtaagatctaaaacagttgaatttctttgttggaaaagtacattaaatacaaggctatttactgttatcagtaataacaaaagtcatgatgtcttggcataaaatactttgaaaattaaatgagaagatcatatattgagattgtttgctcttctatgggtagttgtgatttttatctgtagtactcattccattggattactaaaatatatatttctaatgatacgtgttactgaatttgacattatggcattctgagtcactttcctagttccgggtttactcatcagtgttctcaaaatgaatgtatttattgcttgccagcccttctgtgggtaaagagcttctctccatattcttcataatcctccactcaagtctctagattgtattcaaggttacaatctttgtcattaggatgtcactgaatatgagctccattcttacagctctactagttcgcattagtcacatcagagcacagaaagacatctggagagatcagtaaatatcatcaaaaaccagaagactcatgactgatacagcagactttggtatcgatctgaatagtgtgtttttctaactataaaccttgtgaatattcatgtaaagtctgaaatattaagcttccacaggatatatgtatgtttttctttccattacccatactcagagataatgttatagaaggtatatgggagaaggggagcccaagaagatagggaccatatccatcctcttcaccactgaaatgtcagcacctagtacactgcctggtacatagcagccaacaaatatttgctgagtaaacaaacgaggtgactaagaagatttttgccctttcctggcccttcctcaccaaagtcccctcacattagtgtgacctgaagctccctgttctgttcctcctccatccctgccaccattactatcacatgcacacacacaaatacacagattgctaaatgcttgctccaatgtaaaacaagctcatactgctttcaagaaccctgaccttgtctcagcaagttgaagaggaggtggatcctagtaaatggccatggtcactggatcttaaagtgatgaggttatatcatgatcacaagcttttcctccatgagctaaaaacaacctacttctggtgctgtgttgtgagcacaggagccaatcattctctttgctggggtagattgtaaagtaactaaaatattttcattcttttctcttccccctccccccactaaccttgcagctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagagtgagtaatgccgtgactcaccagagtcaggcacaggatgacgtgaagcccaggataggggcgggcattgattacaatgtaagcaggaactttagttttcttcactgctttatcccccgcatctcagacagcacctagaacatattagacactcaaatatttgtaaaatgagtgaattgtgtatagttatgctgcaggtagtgctatgtagtctggtttaactggtaacatggtaagaagaggcagaacaagagacatggagcatattcaactataacattaaagtttgaaatggtagaaagggtttttcctttgggaaaattacttctatggaattttcttgttgttccagcaatgtagagctgttttgtcaaatataatactcattctttacaactttgccattcttctccccatggccactaccctccttcagttgtattcacagtggagggtgtcttctgccacacattgccaggagtagtcatagttcctaagagtgttcaatgtctttatagtagctggatatgaaaggagagaagggctccttggccacacctagaagacctgaatgttaacattttacagatgaggagaatgactgagatgcatgctcttgctgtctaaaactttattgaccattactaaccaaatacattaaacatgaacattgggaatcatttaacatttataatagggaaaagctcagcataccctctgagtatgcttcctcgagaaagggcttatatgaagagatgaaatttattgttatacttctcaattgtgaaccagaaaacttgggcttaattcccagctctgctacttacttgcttgaacagttatttgagctctgtatctctctttctgtatctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcaaaatatacttattaattgcacattatttaaattatcttatattcatatttattttctttgatattaccaagaaaggagaaatttgtcattcttgttctatgaagaactgactcacatgtgacttaattgttgaagtcaactgtgcatttctattagtctcctaattacctaatatttcccataaatgtcatatttttgcagatgttcacatgtatcttcctacgaagttatttcaggcttcccggccttcattcaacttacttgattcacctcatccccgacaggagaaccaggtaaatttgtgcaggaggtatttctattagctttttgaaaaactgccatctttatgggaaataataggactagtcattatggttcttgttactaactagtggtacgcaaaatgctattctggtgaagatacatgttcttttcagttcacttttacattgggcaagtttgtctggtcagactttgggaaaactagattgctgtattatacatctggaaggtttcattacttttgctttgcctttcattagtatttaaagaattccttggaaaaggtttagaggtgaaaatatgactcattctaggacattatttaagttgagcacttgtgaacttaatttcttgtcatcatttctcaaactaaaggttccctctgttcgtgtagaaatacatcttcctagagaccagtctggggaggtggactttaaagcactggttttacagttgaaggagacctcaagcttacaggaacaagctgatatcctctatatgctgtatactatgaagtaagtggtggatattatcaatctagtttaatgttcataatcagaggaattatagcataataaatagagcacagcttttggagtttcgctgatctggaattgaatatagtttaacaacctatccatcatgtgacttcaaaccctcagttgtcctcatttatagaatttggattatatatacctcatagagttattgtaaagattaagatataatatccatgaagtctctaatacaatgcctggcacatggtgggtgatcaataactgataaatattactgtcattaggttatttttaagcctccattatttggtcaaatgtacagataagtttttaactcaagaaaagtaagaatatagaggtttataggagaaagaaactaacatttttgtttgctatgtgtcaggcatcctgctaggtactttgtattagtacaaactcaatatgtccaaattgaactcctctctcctaaaccccacaagcttacacaaaaataatctgttctccctccttttccatgttgtagtcaccatgaagaggcaggatggactttcttcccctaaatttggtttggatgttgagatagatggtgacatacacataccaagaaggtgtggaatatttattactcacataataaggctttctaggaagagcaaagaaggttcccagcttgctcccaaaaaggcttgagagcccagggaaaggagactaaattgggggttttataatcattacaggatgagcattctcactggcttctagttttctttttttgttgtgtccttgtttggttttggtatcagggtaatgctggcctcataaaatgagttcggaagaactctccccttttccttttttttttttattttttttattttttggaatagtttgaaaagaattagtattagttctctaaatatttggtacaattcagcagtgaaaccatctggtcctgggcttccctttgatgggagactttttattactgattcaatctcctttgttattgatctattcagattttctgtttcttcatacttcaatcttggtagattgtatgtgttcacaaatttatccgtttcttctagggtttcctacttgttggcatataattgttcataacagtttctaacaattcttttaatttctgtggtatcagttatatctcatcttctttttttgattttgaagtgaggtctcgctctgttgcccaggctggagtgcagtggcatcatcatggctcactgcagccttcactgcccagtctcaagtgatcctcccacctcagcctcctgagtagctggtaccacaggtgcgtgccaccatgtccggctaaatgtttttttaattatttatagaaatgaggtcttactatgttacccaggctatatatctccttttcatctctcattttatttatttgggtattctttctttttttctttgtctagccaaatctttgttgatttttgtttatcttttcaaaaaaaccaacttctcattttgttaatcatttgtattgcttttttagtctctgttttatttatttccactctgatgtttattgtttcttccttttactaattttgggtttagtttgttcttgtttttctagttactttaggtgtaacattatgttgtttattttagacctttatactttttgatatatgcattcattgctataaacatctctcttagaatagcattttctgtatcccatatcttttggtatgttgcatttccttttcatttgccaaaagaaatttttgtaatttccttcttaatttgttcagtgaccccttggttgtttaggagcatgtttaatttccttgtatttgtaaagtttctgtggtttctcctgttattgatttctagttttatatcattgtgatcagaaaagatacttgatatgattttgatcttcttcaattcattaatacttgtttgtagcctagtatataatctaccctgcagaatgttccatgtaaagttgagaataatgtgtattctgtagcttttggatggaatgttctgtaaatatcaattaggtccatttggtctagtgtgcagtttaaatccaatgtttgtttgttgattttctgtctatgtgatctgtccattactgaaaatgggctgttgaaggcccgtactattattgtattgtagtctatctcttcctttaggtatgttaatatttgctttatatacttaggtgctccaatgttgggtgcatatacatttacaatagttgaatcctcttgcttaactgatcccccttatcattatatggtgaccttctatatcactttttagtgttttacttaaagtctatttttttaagacagtcttgctctgtcagccaggctggagtgtagtgccatgaacatggctcactgtagtctcaaactcctgggctcaagtgaccctccaacttcagtttcctgagtagctgggaccacaggtgcatgccaccatggccagctgatttttaatttttttttgcagagctggggtctggccatgttgcccaggctggtctcaaactattgggctcaagccatccttctgcctcagcctcccagagtgctgggagttccaggtgtgagccacagcacctggccctgaaagtctgttttatccaagtagagttacgtctgttgtcttttgctttccatttgcatggaatatcttttttccatccgctcacttttagtccatgtatgtcctcacaggtggagtgaatctcttttaagcagcatatagttggctcttggctttttttattcattaagctactctgctttttaatgggataatttaatcaactcacattaaaggtaattattggtaggtaagggcttactactgccatttaattaattgttttccagttgttttgtagaatcaatccttccttccttccttccttccttccttccttccttccttccccccctccttctttccttccttccttccttcccccctccttctttccttccttccttccttttttatttctctcttactatctgtctttatggctaagtgattttccttcataatatgttttgattttttgctttttatttttagcatatctattatatgtttttgcattgtggttaccatgaggcttacaaaaaatcttaacaatttaactatgattacagtaaaagagaagaaaaatctctttaactcaacctcccaacattttgagtttttgatgtcacaatttaaaatttttatattgcatatcccctaacaaattattgtagttactatttttaatggttttgtcttttaaccttcatactaaagatgtaagtaatttacacaccatcgttagattaatagagtattcatatgactgtgtactcagtgacatatatcttcagatgttttcatattattcattaatgtctttttctttcatcttgaagaactccctttagcatttcttgtaaaacaggtctgatggttatatatttcctcagcttttgtttgtctggaaaagtctatgtcttcttcatttctgaagtattcttggctggcagttttttcccttcagcacgttgaatacctcatctcactatctcctggcctataagggttctgctgagaagtctgccgttaggcttattaagattcccttatatgttatttgcttcttttttctcactgctttcagaattctctctttgtctttgatctttgacatttttattataataggttgtgacatagtcttatttggagtagaatttattttcaaatatatatcttcctattgaacatgtctaaagtcaaattcactgtctttactacaaacctactgctgttgtctttcctgactctattctgggtatcatcattccttcaagtaacccagacttgaaattgtgtcattgtcttcaattcctccccatcccctgcctctcgctacagcatcaacactaccacagggaatcattggccaaatctaaatcctctatgatttgactttcaacttttatttaccattgctcttcccttacaatgtgaatgctgtcaccaaaacagtctatttatcatacccaaagcacagcctctacatgcctaccttcataccttgattcttattttttcttctgcctagaatattctcctttaccacactccatttctacttcttgcatttctctctgtcaaggcctaggtcatctgtcacccacatgaaacttcctccaatctgtaatagtaaaaataatcttccactgattctgagatctcatagcacttttttcatatctttaaaatttgacagtgtcagacttggagaaaagttgtgaggatagtacaataaaaattctggatagccctccttcagatccatcagatgtttccactgagcttttaatctctctctctctctctttcacgttgatgtcatcatctatactcaatcacacacgcatattatttttttctgaaccatttgagagtaagtggcagacacgatccccatctaaccctaaataattcagtgtttatttctgaaaaattatgaactctcctacataagcacagtataattgccaaagtcaaggaattgtttaacattaaaccaatactattaactatctacagatactattaagatttgtcatatagcccaatagtgtctttatagaaaagaacatctaaaatcatgaattttattgagttctcaggtgtcttgagtctccatttatctggaacagttcctgagtcttcatttttcatgttgttaacatttgtgaggaatacaaaccagttattttgcagaatatccctcaatttcagtttatgtgttgttttgtcatgattaaattcagattatacattactaaggtaatgccaagttcttttccatgtgtcatatcatagtgttgattagtcccattgctgatactgtaaactttgatcgcttggttggatcatttggttaaggtagattcttccatgtacctacactgtaaagttattatgtcatcttttgtaattaaaaaagtatcctgtagagatgtactttgagactacgtaaatatacggttactcttcaaacttttgctcactgatatttttcatccattaatgactcttcctatagcacattttatttcatgttttttaatttaatatattgaatagatatattcctatggttcaaaaatttttaagtacaaaagaatatacagtgagagggtaaaatgtctttctcccatctctgttcccccagataccctgttccccttctcatgggcagtcagtgttgtgtgtgtgtgtgtgtgtgtgtgtgtgtgtatcctcccatggacatttatggatatgtaggtaaacacagacatatatggggataattttacccctatttatccaaaaggtagcatagtatacacacagctctaccttgctttctttcactaaaactatatatcttgatgataactacatatatattccaattatctattgcttcataacaaatcactctgaaactcagtagcttaaaataacaaaaatttaaaaatttttaaattatctttcacagttctgggacttgcctgtgttcagccaggcagttctcacctgaggtctctcatttagttttggtcaacaatttctggggctggaatcttcacaatgcttgcccactcatatgtctaggggttgatactggctgttggctagaacctcagctgaggttacctacagctggtacacccacagatgacctcctcatgtgtctctccacatcttcacagcatgatgactaggttctactagtaagtgtcccagctgggagctctattactttgtatagcctagcctcagaaattaggtaagtcacttttgccttaatcacaagcatgcctgggttcaagggaagggaacacagaactcatctcttcatgggaggagtgcgagagtcacattgtaagaagagtaggttggataggaaattgttgcagctattgttgaaaatatattaccacaatctagatctacttcatattttctgaataattgtgtcattccattatttgaatatatcataatttacttagccagcctcttattgatgaacatttgaattgttgccagaattcacaatcacaaaaatgctatggcaagtaccctcatagcatacagcatttcacgtgtgtgaaatttatcatgcaagtaaaccagaactcgaattgatagatcaaaaaataggtattttttaactgtacaattaaatggctttgaatgtattcacattgttgtgcattcttcaccactactcattttagaacatttgcattaccccaaaaagaagccccacttcctttatccatcaacccccaatccctccattcccccagccctaggcagccactaatctacattctgtctgtatagatttgtttgcttgggacattttatataaattgagtcttgcaatatgtggtcctttatgacaggcttctttcatttaacatgatattttcaagattcatccgtgttgtaacatgtatcagtacttcattcttttattgccagatattatatcctgtataaatataacacatcttatttatccattcatcagatgatggacatttgggttctttctactttttggctattatgaataatgctggtataaacattcatgtacaagttaatgtggacatatgtttttatttctattgactgtataactagtagtggaaatgctggattatatggtaattctgcatttaaccatgttaggaattgccaggctgtttttaaatattttcaatactgatatatatttccaaatagctctccaaaggaattgtccaatttttattccgatcagcagcatattgatggtgcctgttttctcaaagcctcaccaaaatagtgttatcaactttagggacttttgacaatctgataggttaaaaatgttatcttggtatagtgctaagttaaagtttttctaggagtgaggttgagcaccttttcctatctttaaaagccatctatttgttttgccagcagtatttgttttgccagcagtatttgttttgccagattttcttttgtttttaattttttaaatctacatgttggagttctttatatataagggaaattatcctatgaattgcaaacattttttcctagttggtaatttgtcatatgactttccttacagtgatttttgaaataattcatttgttaaatctttgtctttaatttcaactatattgaagcccatgaatagggtaaaagaatgcattttgtcaaaagcacagctaaaactaagacttattcttgtgtaggtactggctttcagagctgactgttaatcatagttttataaggattcttagtaaattacattgatttcctagtgagagagacctatcaaaaacaggcatgttcattataacactgaaagaaaagatgattgccagaagctttacttaaaactgatgtagtcctgtcgttaaaattctagaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggtactataaattcttgaatttataccaaatctaaataagcgtgctttttaaaaattggtttctataattgttttttaaaacaaccatagcctctaaccatttgagatgtcttttccacataaaatttgatattcagttcttttagtttgtgaatgacaagtaagaattgtagatttataaaatgttataaaccataacatctttataatgatattaagaattctatatcttaagaatgaatttacactaggttcctacctcctagaaagggaaacatccatacaccattagtgggaatggaacttagtatagctacttatgtaaaacactatggaggttcatcaaaaaactaaaagtagaactaccatgggatccagcagtccaactgctgggtatatatcaaaaagaaaggaaatcagtatatgggagagatatctacaactcccatgtttattgtagcactattcccaatagcaaaggtatggaataaacctaaatgtccatcagaagatgagcagataaagaaaatgtggtatatatacacaattggatattattctgcatcaaaaatagtaaaaccctgtcatttacagtaacatgaatggaactggagggcactatgttaggtgaaataacccaggcacagaaagacaaataccacatgttctcactcatatgtgcgagcttaaaaagttgatctcatagaggtagagagtagaatgatggatactagaagctgggaagggtagtcgggagtgggggatagagaaagtttagttaatgggcatgaaaatacaactagattgaaggaataagatctagtatttggtgtcacaatagggtgactatagtttacaataatttgttgtaaatctcaaagtaactagaagagcagatttggaatcttgccaacacaaagaaatgataaatattgaggtgatggatgtctcaattacccaggtttgatcattacatgttgtatgcttgtatgaaaatatcacatgtactccataaatatgtataactcttatttatccataaaaattgaaaacttaaaaatttaaacaaattttttaaaaagaaagaaaaaaaccccataaaccaaccaaacaaaaaagttcctactttctaggagatagatgaaaagacctcattgtttcttcctagaaatccttcttttctgatcttcatggtattttctgaggaagagagttcagtgtgtcattatgttaaagaggagcaaaggtttttcagctgaaaagagaaatgtttgtggaaacctgaggtgttacagaaacgataatattatgctatctcttgttaggcctgcacagaccttctctcccaccagaaacatttgacagtaggacttcctccagaacctcgagaaaagactatctctgcgtgagtatggctgggtttggtcaggcttctctgagaaggagtggtgtggacttagaattcccttgccctaatctgtcagtggatgataatgtcctacatatgttcacctctatcagagacacctagtggaagaatgttggtaatggtagggcaagagtaaatgaaggagaaaactcacagagtagtactcaaactctttttacttgttggattttccatacctgccattcaaaaaacaaaacaaacagggtaccctgaattagcaaccacaaaatgtcagccatactctggaaagagcaagtgaaagaaagtggctagagcacagggctgaccatgaaactccatgctgctcatggggaataaaggggatggaggtcatagtcaaagaggaaaaatggttacttacagagcaatgtgaggtagcacccctccaggaaccctgtaatcagagtgccactgtctgaggtctgccacagcctccaattggaaacagtaccctaagataggcttggcctggagggagatgtaagtcaagtgatggggctgggatggaaaattcagtctttatacatgagtcttccttttgccattggccatgccagtaaaattcatctgcagtaaatgtgtttaatttcatatcacaccagtgccaaaatttaaatcttgcaaacagtctgtatctccaagaaatatttttagagagattctaacttcattcataaatgatctgaagaatctgtttttctactaggagtaatttttaaaaagggtattcccccctgcttgccagttctacttctgtagccaatgtagttaaaaaaaaacttttgtcaatatttctccctcattttttcctggttaaactctatccagagcatgttttttgtttacaaaattttttttactacattggctacagaagggatacttttgctgatgtctgcatactccttccttcctggtttatgtccatgatttctgttacccttgagttccagttcaagctcccatatgaaggcttagagaaacaaaagttccagcaagcttcaccaccgcgggcttaaagtgctctgggtactaaatagactcaaaaagcagtctaggccacaaggactgcaattcctgggcaaatccttgtgctatgctggactcgaagccaatggacttggggtgcatgcggcctagtgagacatcagctagagtgggcaaaggagtgcttgtgccacccctcttccaactccagatagtgcaactctgggagagaatccttccttccactgaggagaggagaggaaatagtaaagaggactttatcttgcaagttggataccagctcagccacagtaggatagggcaccaggcagaggcatcagactcccattccagtccgtagctcctggatgacattttgacacataccttgcaccagaagggaacctgctactttgaagagaagtacccagttttggcaggatttatcacgtgctgactaaacagcccttgggacctgaacaatcagcacagtgaccagacattctggttccaagtgtgaccaaacacatgcccagccgtggtgggtatagggagagactccttctgcttaagaaaaggagagggaagagtaaaggggactttttcttgcagcttaggtaccaggttggccacagtggggtagagcaccaagcaggtttttgaggtcccggattacaggcctggcatttggcctaggaactgctaacaaatgtacagtgcagtggtggttcaagaagttttgcaaaggagatgagagccttgaagatgaggagcatagtggcctgctattgaaagttgacaacgaccaattgagagcagttgttgaagctgatcctcttaaaactgcatgagaaattgccgaagaactcagcatcgaccattctacagtcagtcattcagcatttaaagcaaattggaaaggtgcaatgggagaaaatatttaccaactacctatctgataagggattaataaccagaatgtataaggagctcaaacaattctatagggaaaaaaatctaatagtctgttttaaaaatgggcaaatggtctgaatagacatttctcaaaagaagacatacaaatggcaaacaggcatatgaaaaggtgctcaacatcattgatcatcagagaaatgcaaatcaaaactacagtgaagtatcatctcaccccagttaaaatggcttttatccaaaagacaggcaataacaaatgctggcaaggatgtggagaaaagggaaccctcatatattgttggtaggaatgtaattagtacaactactatgaagaacaatttggaggttcctgaaaaaagctaaaaatagagctgccatatgatccagcaatcccactgctaggtatatacccaaagaaaggaaatcggtatattgatgagatatctgcactcctgtgtttatttcatcagtattcacaataaccaagatttggaagcaacctaagtgtccatcagtagatgaatagatcaagaaaatatggtacatatacacaagggagtactattcagacacaaaaaaaatgagatcctgtcatttgtaacaacatggatggaactggaggtcattatgttaagtgaaataagtcagacacagaaagacaaagttcacatgttctcactgatttgtgggaactaaaaatcaaaacaattgaactcatggagatagaaagtagaatgatggttaccaaaagactgggaagggtagcagggtttatgggcgttgggggtggagatggttaatgggtacaaaaagtagttggagagaatgaataagatcttgtatttgatagcacaatagggagactatggtcaaaataatttaattgtgcgttttaaaataactgaaagggtgtaattggattgtttgtaacacaaaagataaatgcttgatgagatggataccccatttaccctgatttgattattatatgttgaatgcctgtatcaaaaatctcatgtaccccagaaatatatacaccactatagacccacaaaaattaaaaattaaaaaaaaatttaaagaaaagaatttgaggagaggacataattcaatccataaaatcttgcttctggaaaaacaatcttttttgtatcagttttgtgacactgtaggtaatccaaagaagatggcatggttcatgccccagagtgctttgtgtcagcaggagaatcagaagtgtgtgaggatgtgtgtatacgtgtgtgtgtgtgtgtgtgtgtgtgcatgtgtgtgaattgaaactatagaaaatcaaacaactctgtcaactgtgattgtaaagtaataaaatggcttcaaaaaggcacagctagtattccattgtaggggtgggatgctgaagagatgttggttaaagaaggaatacattctaatgttcagtagcagagtagggtgactattgttaacaacaatgtattgtatatttcaaaataactagaagagaggacttgaaatgttcccagccaaaagaaatagtaaatgctcaaggtgatggataccgtaaataccctgacttgatcattacacatcctatgtatgtaacaaaacatcacatgtaccctgtaaatatgtagaaacattgtgtattacaaaaaaagcacagcttaaaattaatttagtactttgtagccataatagttacttgtcaaatgttcaaagctaactatgaaagactagtctagaagaacatcatggtgtgagttttaaataaattttgaaggaggaagagaatccagatttagagagaagagagcagagctcctctaagttgatatgggccagagtggtttcaggaggcaatgaatgagctttgaagtttgaaagaatcagaatgctattggtaatgatgaaatgttgaggcagtgacttggacttggataaagcttcttcattttttcaacatatttaagattaagtggttgtagaatattgtctttctttgctgtctttttccttagacctctgccctatgaggcgctcactcagctgatagatgaagccagtgaaggggatatgagcatttcaatccttacacaggtgagaagaattgtaaaggctaatctggtgactgatattttaaagtttgttttcaattgatctagcaatttccaaagacaacaaaataggcattgtgagacctaggccattatttttgtctatatctactctgtgtgcaggaaataatggtatatctagccatgtatatgcgaacccagcctggcctctttgctgaaatgtttcgacttcgaattggtctgatcatacaagttatggcaacagaactggcccactcccttcgatgctcaggtacttaattcagtaactattttaggtggaattcacttttgatgtaagtttatagagtttggaataaggaaagaaagaaagctaaaacatttttatccatagctcagaagctggatatggcaaccttgttcccctgttggtcactatttatgcaagtcaaggagctgatatgatgacacatttgtgtatcagttcgcagcttcagaatgccatctcctgtgggctcttcactccaaatccctcttgacttatcactcgttgctaacttcatttctctaactctggagagtatttgagtgtgacagacagagttgggttaagatttaggcagtggagcgtctgtacaccaagaatgagtcactacatcagtggatcatggtgtcagtattctgtctagtcaccatcatgactgaataaaggaagatgacattttcattaacatctatctgacaagactctctttgaaattaactataggtgtatttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaattgttttatacctaccatatgccagatactgtgctttttgctttaagtttacatatattgtgtcatttaatcctttcaagaatcctctggagaagaaggtattattgtgtcacttttaccaataaagaaactgaaactcaagaaggttaactaacttccccgaagcaacatagctagtaaatagtggaatttgagtctgagtccacctgattgcaaatgatttctagttcagtacattgttatagataaacattatatagtataatgttgtttttttttttgcgagagagtgtgattgctcaataataaacctcaataagggataagcccctgaatattcacttttccttaatttagcctgttatatttcttgttttcctgtggattcatgaaaaccatggctctttattccttataggataaagtcaagatccctgggtctgatgtttaataccctcaacagtctggcctttatcttctactcccacagtacttcccactaattttgtcagttccagtccttggagattgatgtctccattgatttcaaaggcaattattgtctatacctctcatttggcacatagaatatgcaatgttttattgtttatcttgttttcatgttccatcactcccaaagagatagtcagactcaagattaggtatcatgtcgtcatacctgcttgcacaaatgttacttaaaatgatgacctgcatgtagtctacttttaataaatgtgtgatgctgattaacatgttcaagttatcctcatatattcataatttcatggattcaaatctatctcttttaagtctctattatttccaggctgagaagttttaattattttagtttatctgcatatatacattcattgtctttctctgaatggcctccagttccattgttcttctttcattcttcccaccttcaaataaagattttactaagtaccctaatggtctggaagcagggtgaagaagaaatcaattacctcgctaatccacaaactggatagtcagtccttaaataattaagaatctatggaagtaagaatacctaagcagtagggtgctatcaatttattttgtaattctgttcttccaatcaagtgactcagaaattctaagcaagaaaagaaatagagaaaatatagagagggcatggcaggcaaattagaagtccttctgttctaacatttctgctgactagctgaggaagccacagagggcctgatgaatctcagtccttcggccatgaagaatctcctgcatcacattctcagcggcaaggagtttggagtggaacgaagcggtgagattgaataactgcattttcatttcatactgtttggtttaagtgtctcattggttttaaaatgtttttccttcatcacagaaacctttttccccaaataaataaactccaatatataaaacagaaaccaagctgtcttctggaacaagatttggaaaccactatatttttccttaaatggtatatcaactaagtggattgattactatcatgtttcatttttaactgtttaatgcattccctcacattatcttaagcctccactttaggacaactagcaacccatatcatctgaaactttcttgtattctaattggcaataattcagtagctcttacagtattgtattatgtgtatagctgcttacagtacttctaatgtaacccttcaactttaaactcacaaattaatagtccacctacatttgtggttttggttggatttggcattgcgtacctaaagcagcagagcaaatgaaaagtggtcatctctcatgctcaactttcaaggttagggtaagtagatatatatggtcagatggatggatgtcagaccttagagtggtaaaagaaagttgaaaagcagtgcgtttcaagaagggtatcttgctaaaatgcacattttgattcagtagatctggggtgggacctgagattctactaacaaacttgtaggtggtactgatgctgttggtccatggaccacatttcaaatagcaaggttatagtttttaaattaagttaaaaataaggatatatatgaaagttttttttaaatgtgatggggaagaaattgaaccttattatcctctctctttctctgtaatctctcatactacatagttcgtcccactgattcaaatgtcagtcctgctatttctatccacgagattggtgctgttggagcaaccaaaacagaacgaactgggatcatgcagttaaaaagtgagataaagcaggtaagatactacctgggagattagctgggatattgccatgtttcagaacattcttttggaatcagactttgttgggtcatttattttgtttcacattctgagtttaatttgagccatttatgtttcaggtggaatttcgtagactgtcaatctcagctgagagtcaggtgaaacaactagggatcatttaacatggtttaacttacctttagttctgtataacatgcatgagctcatggcctttttacaaataagataacaagtcatggagtagattgtttgaatcgcctttataacagtcattttgcagatagctttcctttttctggaccaaagtactttgttaattttagaaggaaagtaacttgcatctgataataagaaattgaagtttctcttattaggactgatgtaattttggaattaattttctttataaaacaagacttagacttcaagcaaagagtctttgcttggccagagtttaggtgggcttctcaaccttttcctaggcccatttgtgcacttccttgtaaaatccagctttagcaagagaaccctgctaagtcagtttagccagaaactcctatcctcgatatcttatcatccttgacatctgatcaggctcctcatcttctaccacccccaggtgatgtccaatcaccctggcctgtcttcagcaaaaatcctgttaagatggtttagccagaatcctccctacctctgatgtttccctcttagtaattttccaccacttggctataaattcccacttgattatgttgtattcagaggggagcccaatctctctcccttactgcaagacctcattgcaatggttctgtacctattaacaatggtcctgaataaagtcttccttaccgtgctttaacaagtatcattgaataattttttctttaacaagatgtagaaaaggtgctgtggacacagagggagaaacatctaaatcagtctgggagatagtgggagtcactaaataccatgttgtagcctcttaatttttcctgcaggtgagaatagagagcggttgctttatacaaggaaatagttaacaaaagcttccatagcttctttttaaaactctaggaagtcatgtggtttcaagatctccaagttgagaaattactgatttggcctctcctagaagcacattttatgaaaagcttaaaactactcctgttttcagaatagaattatgatagcttgcagtattgaaacccccagaagaggagtggtgaaatggaaatttggagttttgtttttagttttcgtttcttttttttagctttttagcactggggtctcactatgttgtccaggctggagtgcagtggctattaacaggcacaaaatcctggattcacgcaatcctcctacctcagtcaccagagtggctgggactaaggcatgccaccaccttgctatttggtttttttaaaaggaattagaaaccatttaggaagacaatgagccagtgcttgaagcttaatttgaggtaacttgagtacactcatcaaataccctatggcatttatatttatgcaagaataagtatgaaaatggagtaagaaagggccttgtattcactttacagttttctcgaataatttgaataatctgaatattttcctatttgaaacgtgaaagaactacattcagtactgaatagttagttacattggcattatctgtaaataatctttgatttggttgagagttattggataaacattttataattgttgatagtcactcagtattacttataagttcattatatatttacaacttgaagtacatgttcccagctacattaatatgatgttgagacttgatctacccagctacatcatttaagttttttctaaacattcactacctataggttttcaagggagccaaaatcactaggactataatttagaggattgagagtcctaaatttgcattactttcttatttctaaatattaacttccatcctcacctgcctgtctggtattttgtattgttctaagccattttttccctatcactcaagaatgccctcttttctgattatgaaaaaaaaaattataagggtatttttatttcttttcccttcaccatggcttctagggtaaagctatttcatcagctttttaatgattatgtgctgactacatactgaaatagtctgtatttttactccactagtgacttaaaagtacaaataattgtttcctggcctcatatcttttaaaattttattttctcaatttgttctcatagtccaatggtggtcatcccctgggtatagatttgatgtcaccgtcttttatggtaactgctgtgatcttctcgtatatgccattcacatgtgctttgaatatgctcttatataaatcatgacatatactggttgattaaaaaaaaaattaatcaagaattaaaataagtataaagcaatttcatatatgggggtgaatcttttcatttattttccaataacatagggaagggagttcaactccaacctctttgcgatttcagaaaacaaaattcaatttgctaagtattggttaagtataaattcttggtcccaccctaagtacacagagtcagaaagactgcggatgaggcccagtaatctgttttatttagatgattctgatgcatttttaagtttgaaagccactgggttagcttttcttctgattatgaattcatttagtaaatattaattgagtgccagttttgtgccaggcactgtgaacaaaatggatgtggtctttgccctcgtgaagcttacaatttaggaggactgacctctaattaaatttatttggtttaaatcaaagactcataatggcctatgatttcagatttctcaagctgaagagatttaggctagacaattaccaaacaaaaaatggaaaattattcgaaacaatattagtatttaggttaacctaaatcaaataccctgtaatgaactaataagacttggccaactctatcatatccacactaacataggacaggggtatagaagaaaatttaaaaactcaaaatgattgatatttggctttggaaaacagtctgaattgtactttatcagatctataccctttctggtttgacctcacaatcaacagcctaggatcttggtggtataaacaagacaatgaagataattaaatggcagttcatctactcaatagatcagtgcgatagtcacttgccagtagaaatgtttgggggctcttttcttttttacattgcattggttggtgatttaggcatttggcccaaattaaaacgtgagaagttattttctcagaaaatatttctattatcttctatcttatatttatttctgaatttaaactgttaaccactttgcccaatgtattttatcctttacttagtataagtttttcaaagttcattatgttttagcatgtatcaaaagtttatttttttcattgctgaataatatcctactaaattaatgtaccacattttatttatccattcatcagttgatggacacctggattgtttccactttttggctgctatgaataattctacaatgaaccttcatgcacaagtttttgtatggacatatgttttcacttctcttggatatatatctaggagtggaagtcctgggtcatatggtaactatgtgtcgcattctgaagaactgccagacatgtccaaaagggctgcaccattttacattcccaccagcagagtatgagagttccaatttctttacatcttcaccaacccttacaattgtcttttttattatagccatcctgatgggtgtgaactggtatctcgtagtggttttgatttgcattgccctaatagctaatgatactgagtgtcttttcatgtgcccaatggccatttgtttatcttctttagagaaatgtcaattcacatttgtacctattttaattttttttgtctttttattgttgagttgcaaggattctttatatattctggatacaagtcccttttaagatataaaatttgcaaatatttctcccatcctgtgggttgtcttttcactcaataccattaagtattcttcaaacaacaaaaatttttgatttccacaaagtccaatttgtctattttttcttttgttaatcatgatgtttttggtgtcatatctaagaaggctttgcctaacccaaggtcacaaagatttattcctatttgtgttctaagggttttatagagttagctgttttatttaggtctatgattatgtatggagggatccccaagatcaccctcagatttaatgattcactaggaagactcatagatctcagcatatagtcatactcactgctacggtttattacacctaaagggtacaagatgcattgggcacagtgtaactacagtcaacaataatttattgtacattttaaaataataaaaagtataattggattgtttgtaacacaaaggaaggataattgcttgagataatggataccccatttaccctgatgtggttattatgcattgtatgcctgtaacaaaatgtctcatatacctcataaatatataaacctactatgtacctacaaaagttaaaaaaaatttaaaagagtcattggtcaaagtctagggaaaacagacacaagcttccagagtactctgtcagtagagtcaccctgcaatgagttgtgacaagatgtcattgccaaccaaggaacctaataaagactcagcacccattgttcttgttgagggctggtcacgtaaacagcctctgtctggcgtgtatcaaaactctggactcccagaaagaaagcaaacgttcaacataaaccatagcgtttgtacagtttaggcatggtaagccactgttattagttctgggaatggtgagaactctcccagaatccaagtttctaagtttctaaatgccagccaagggccaaccttgtaagcaagcctttccaagaatagcagttctggcctactgtcttaactcttttctgcacaatgggcttaatttttgtgtgtggtataaggtagagttcaacttcattcttttgcatgtggatgtcactgttccagcaccatttgttgaaaaggctatttttccctcatttaattatcttggcgtccttgttgaaaattaattgaccaaaatataatggtttatttttgaactccctgttctattccatcgatctatatgtccatcctataccaatatgacacagttttgatagttttgtagttttgatagctttagagtaaattttgaaatcaggaagtgtgagctctccaacttcagtcttctttttaaatatgaatgttaggatcagcttgtcagtttctgcaaagatcccagctggtatgttgatagagattgtgttcagtctgtacatcagtttttgaaatattgccatcttaatgatgttaagtcttctgacccatgaatatggaactatatttcaatttatttaggtctttaatttttttcaacatgttttatagttttcagagtatttgttttggacttcttttgttaaatttattcctacatattttgttattcttaacgttattttttaatggaattgttttcttaattttattttaatattgttcattgctgctgtttacaaatacaactaatttttttattatagtaagacatttaacatgagatctatcctttaaaaaatttttaagtgtacaatatagtatcattaactataggcttgatgttgtacagtagatctctagaacgttttcatcttacataactgaaactttatacccattgaatagcaagttcccattttcccctctacccagcccctgacaactaccgttctactctctgcttctatgagtttggctgtttcagatacattacataactggaatcatacagaatttgttcttctgtgactggcttatttctcatagcatagtatcctgcaggttcatcgacactgtcatattttgcaaaatttccttcgtttttaaagtctgaataatattccattttatgtattaccagattttcttttgccattcagttgttaatatatatttaggttgttttcatatcttgactattgtgaataatgctgcatttgaacatgggcatgcaaatatctcttcaagattctgacttcaattcttttggataaatatccagaagtgggattgctgaatcatatggtagttctatttttaatttttgaggaacctccataatgtgttccatagcggctgcagcattttacattcccagcaacagtgtacaagggtcctaatgtcttcacattctcaccaatacctgttatctttgggtgtttttttaaccacggtcatcctaacaggtgtgaggtgatagctcattgtggtttgatccgcatttccatgatgattagtgatgttgagcatctttacatgtgtgtggtggctatttgtatatcatctttggtgaaatgtctactcaagtaaaatttaattgatttttgttattgatcttatatcatgaaacttcactgaactcatttattagttgtagttgcttgttagtgaattccttagaatttctatatacaagatcatgtcatctgcaaatagtttttacctcttcttttccaatctggatgccttttatttcttttcttacttaatctccctggttcaggccccccataaaatgttgaatacaagtgataagagtggacattcttgtcttgttctgatcttcggggggaagccttcagtcttcaaccactcattatgatgttagctgtgggttgttgtaggaaaaaaatctaaacttttattagattgaggaggttcccttctgttcctagtttgttgagtgtttttatcatgaaggtgtgtcgaattttgttatgtgtttttttctgtatctattaagatgatgcgttttttatcttttattctgttgatgtagtgtattacattaattgatgttcagatgttaaaacagccttgaatttctggaatcagtcccacttcatgttgtataatccttttagtatatcactgaatttggttttctagtatttcctggaggattttcgcatctatattcataaaggatattggactgtagttttctggtgacatctttgtctgattttggtatctgggtaatattggcctcatagaatgacttgggaagtgttcccttctcttttctggaagagattgtgaagagctagtaataattcctctttaaatgttttgtagaattaaccagttaatccatctgtgcatgggctttactactatgtgggaacgtttgtttatttgtttgtttgttcgtttgagacagagtctaacgatatcacccaaggtggtctcaaactccggggctcatgcaatccttccgcctcagcctcccgagtagctgggaatacaggcacaagccatatgcccatgcaccacgagccaagaacccatactttgaaggaagttttgtacttactaatttgatatatttgtttgtaatagttctattaagatgttatctttctttatgagttggtttgggtagtttgtgtctttctaggaatttgtctgtttcattgagattatgtaatttgtccgcatatggctgcggatggtatgcccttataatcctttttctttctgaaggtcagaattgaggtctttatttcccctttttttcttggtctttctatctaatgatttgtctattttgttgatattttcataggaaaaaattggggattcatatgctttccctattgtgtttctagtctctatttcatttctttccactctaatccttattatttccttccttctgcttgctttcaatttagcttgctcttctttctttattgtcttcaaatggaaagtttgtttattgatttgagacatttatcctttctttaatataggcatttataacataaattgttcgttaagtgctgttttagctgcatcccataagttttgctatgttgtgctttcgttttcattcatttcattattttctaattttgctagtgatttttttccttaatgcatttattatttagaagtgtgttaatttccacatttgtaaatttccttaatttatttcgattactgacttctgttgtggttagagaacatacttcgtatgatttcaattttaaatttattatggctcatcttatggcccatgagggcaacaaactaaaccatggacgagctagaagtttaacagagataatcaggtcaagagacagctaagaatgtcccaaatcatcagtatttttatgacttttctcatgtatcaccagattgctttcaaaaaggattgtaccagcgtacagcactgctagctacatataagtctactagcttcactataacctctttgtcttggctgcttcacttaatatttggtttataattctgcagagtaggtttattgttcactataaagttcaaagacttgggccgggtgtggtggctcacgcctgtaatcccagcactttgggaggcccaggcgggtggatcatgaggtcaggagatcaagaccatcctggctaacatggtgaaaccccgtctctactaaaaatacaaaaagttagccgagcatggtggcaggcgcctgtagtcctagctactcgggaggctgaggcaggagaatggcatgaacccgggaggcagagcttgcagtgagccgagattgcgccacgccactgcactccagcctgggcgacagagcgagactccatctcaaaaaaaaaaaaagttcaaagacttcatcatagaaacagagataacttttgatttatgttctttcctctcctcttccaagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaaggtgagcataatacattgttgatgtctcatttttgccccttgaaattctcagtctccttggcagagatatgacatgactaatataatcactgcaattatgtaaaagtcataactcagatagacaaaaccaagaagaaaacataaaaatgaaacagttgatttgttattgtggcattattaataatttagtctctttctattattgttgccatagtcttgtttctaaattagacttttaaaatcatcacctctctgcttctggccatagttggacattgtgatacatttgctgctaatcaaacgaatttgttactaaagagctaactttctttgtagctgtggagggttgtaaatgttatttgtagcaacgtgctatcagtagagtaaaacaaatgtatcagtagagtaaaaccaagtatcagtagagtaaaacaaatgcagtacttggggagtttgtgttaggagttattacctatattttttcttggatgaaaactactaaataaatgcaaagtcataatgatggtaatagttcggagactctttgatgtgaccaatatttatttttcttttgaaggcctatttggccaaagaaatttaagggcatgccacactattatggtggtgacagttttagagggccaagaacactattatgctcagcataggtctcattcatagtctcttaggtgccactttctgcatcactggctttaataaggacctgaagatcacttcatccaggacttaaaacccttcagttatgttttttcccctttgggcatggatattcttccaaggacagaatcaggtgatcttttggaaaggtaaaagttggttcctcagactatgggctctggcaatcttcctttaaagagtactgataacttgctttttttgcagctaacttctatagcacaatggtgacaaatattattttatctcttcagttatgcatggattatggcaatgttctatgtgctcatacagcaaagaacaaaacagataataatcttcattctccttgaacttatattctactagggaggaacaaattataaataataaacagtaaataagcaaagtatctagaatgttaaaagatgataagtactgtgtaaaaacaagaacagggtatgagtatttatgaagggatgggatgcttagctagcaaatgtagtaacagtacatgtccgataaatgcatgtcttgatttcattttcaaattaagactttatgttcaaagaaaagcacttaaaatttaaatgaaaatatattgttttaaatcattcataaaccaatatctctcatatacaacatgcagtgtacagtaattaaaattggcatttctgaaagctttgttataaagatatttagagttatacccagtaacagatagctttgttgaatactgtaatatggaacaatagccagttctataaatgactttaaaattctaaaactattggtgtgctaggaatgacaaatttgatttgtgtgaatactctttaaattctgtaaaggtttttttttctttttttttaattatactttaagttctagggtacatgagcacaatgtgcaagctcgttacataggtatacatgtgccatgctggcccactgcacccatcaacccgtcatttacattaggtatttctcccaatgctatccctcccctcgccccccaccccatgacagacctggtgtgtgatgttccccaccctgtgaccaagtgttctcattgttcagttcccacctatgactgagaacatgtggtgtttggttttctgtccttgtgatagtttgctcagaatgatggtctccagcttcgtctatgtccctgcaaaggacatgaactcatgcttttttatggctgcatagtattccatggtatatatgtgccacattttcttaatccagtctatcattgatgggcatttgcattggtcccaagtctttgctattgtgaatagtgccgcaataaacatacatgtgcatgtatctttatagtagcatgatttataatactttgggtatatacctagtaatgggattgctgggtcgaatggtatttctagttctagatccttgaggaatcaccacactgtcttccacaatggttgaactagtttacactcccaccaacagtgtaaaagcgttcctatttatccacatcctctccagcatttgttgtttcctgactttttaatgatcaccattctaactggtgtgagatggtatctcattgtggttttgatttgcatttctctgatgaccagttatgatgagcattttttcacatgtctgttgcctgcataaatgtcttcttttgagaagtgtctgttcatatcctttgcccactttttgatggggttgtttcattttttcttgtaaatttgtttaaattatttgtagattctggatattagccctttgtcagatgggtagattgcaaaaattttctcccattctgtaggttgcctgtgcactctgatggtagtttcctctgctatgcataagctctttagtttaattagatcccatttgtctatttaggcttttgttgcaattgcttttggtgttttagtgatgaagtccttgcacatgcctattgcctaggttttcttctagggcttttatggttttaggtctaacatttaagtctttaatccatcttgaattaatttttgtatgaggtgtaaagaagggatccagtttcagctttctacatatggctagccagttttcccagcaccatttattaaatagggaatcctttccccatttcttgtttttgtcaggtttgtcaaagatgagatggttgtaggtgtgtagtgttatttctgaggcctctcttctgtcccattggtctatatctctgttttggtaccagtaccatgctgttttggttactgtagccttgtagtatagtttgatgtcaggtagcgtgatgcctccagctttcttctttttcttaggattgacttggcaatgcgggctcttttttggttccatatgaactttaaagtagtttttttccaattctgtgaagaaagtcattggtagcttgatggggatggcattgaatctataaattatcttgagcagtatggccattttcatgatattggttcttcctatccatgagcatggaatgttcttccatttgtttgtgtcctctcttatttccttgagcagtggtttgtagttctccttgaagaggtccttcacatcccttgtacgttggattcttaggtattttattctctttgaagcaattgtgaatgggagttcactcatgatttggatctctgtttattattagtatataggaatgcttgtgaattttgcacattgattttgtatcctgagactttgctgaagttgcttattagcttaaggagattttgggctgagacgatggggttttctaaatatacaatcatgtcatgtgcaaacagggacaatttgacttcctcttttcctaattgaataccctttatttcttcctcttgtctgattgccctgtccagaacttccaacactatgttgaataggaatagtgagagagggcatccctgtcttgtgccagttttcaaaggcaatgcttccaatttttgcccattcagtatgatgttggctgtgggtttgtcttaaatagctcttattattttgagatatgttccatcaatacctaatttattgagagtttttagcatgaagggcttttgaattttgttgaaggccttttctgcatctattgagttaatcatgtggtttttgtcgatggttctgtttatgtgatggattacttttattgatttgcatatgttgaagcagccttgcatcccagggatgaagccgactcgatcatggttgataagctttttgatgtgctactggattcggtttgccagtattttactgaggattttcccattgatgttcatcagggatattggtctaacattctctttttttgttgtgtctctgccaggctttggtatcaggctgatgctggcctcataaactgaattagagaggattccgtctttctattgattggaatagtttcagaaggaatggtaccagctcctctctgtacctctggtagaattcggctgtgaatccctctggtcctggacttttttttggttggtaggctattaattattgcctcaatttcagaacctgttattggtctattcagagattcagtttcttcctggtttagtcttgagagggtgtgtgtgtccaggaatttatccatttcttctagattttctagtttatttgcatagaggtgtttatagtattctctgatggtattttgtatttctgtgggattggtggtgatatcccctttatcattttttattgtgtctatttgattcttctctcttttcttctttgttagtgtagctagcagtctatcaatttttttgatcttttcaaaaaaccagctcctggattcattgatcttttgaagggttttttgtgtctctgtctccttcaattctgctctgatcttagttatttcttaccttctgctagcttttgcatttgtttgctcttgtttctctagttcttttaattgtgatattagggtgtcaattttagatctttcctgctttctcttgtgggcatttagtgctataaatttccctctacacactgctttcaatgtccgagagattctggtatgttgtgtctttgttctcattggtttcaaagaacaccttcatttctgccgtcatttcgttatgtacccagtattcattcaggagcaggttgttcagtttccatgtagttgtgcagtattgagttagtttattaatcctgagttctaatttgattgcactgtggtctgagagacagtttgttgtgatttctgttttacatttgctgagaagtgctttacttccaactatatggtcaattttagaataagtgccatgtggtgctgacaagaatgtatattccgttggtttggggtggagagttctgtagatgtctattaggtgtgcttggtgcagagctgagttcaagtcctggatatccttgttaaccttctgtctcattgatctgtctaatattgacatggggtgttaaagtctgccattattattgtgtgggagtctgagtctctttctaggtctctaaggacttgctttatgaatctgagtgctcctgtattgggtgcatatatattaggatagttagctcttcttgttgaattgatccctttaccattatggaatggccttctttgtcttttttgatctttgttgctttaaagtctgttttatcagagactaggattgcaaaaccctgcttttttttgctttccatttgcttgggagatcttcttctatccctttattttgagcctatgtgtgtctctgcacaagagatgggtctcctgaatacagcacactgatgggtcttgactctttatccattttgccagtctgtgtcttttaattgcagcatttagcccattcacattaaggttaatattgttatgtgtaaatttgatcctgtcattacgatgttagctagtgattttgctcgttagttgatgcagtttcttcttagcattgatagtctttacaatttggcatgtttttgcagtggctggtaccggttgttcctttccatgtttattgcttccttcaggagctcttgtaaggcaggcctggtggtgacagaatctctcagcatttgcttgtctctaaaggattttatttctccttcacttatgaagcttagtttggctggatatgaaattctgcgttgaaatttcttttctttaagaatgttgaatatcggcccccactctcttctggcttgtagagtttctgccgagagatcagctcttagtttgatgggcttccctttgtgggtaacccatcctttctctctggctgcccttaatatttttttccttcatttcaacctgggtgaatctgacaattatgtgtcttggtgttgctctttttgagaagtatctttgtgttgttctctttatttcctgaatttgaatgttggcctgccttgctagtttggggaagttctcctggatagtatcctgcagagtgttttccaccttggttccattctccccgtcactttcaggtacaccaatcagacgtacgtttggtcttttcacatagtcccatatttcttggaggctttgttcgtttctttttacccttttttgtctacacttctcttctcgctttatttcattaattcagtcttcagtcactgatatcctttcttccgcttgattgagttggttactgaagcttgtgcgtgcgtcacgtagttcttgtgccgtggtttgcagctccatcaggtcacttaaggtcttctctccactgtttattctagttagccattcatctaatcttttttcaaggtttttaccttccttgtgatgggttcaaacatcctcctttagctcagagaagtttgttgttaccaaccttctgaagcctacttctgtcagcttgtcaaagtcattctccatccagctttgttccgttgttggtgaggagctgtgatcctttggaggagaagaggcgctctgggttttagaattttcagcttttctgctctggtttctccccatctttatggttttatctacctttggtctttgatgttggtgacctacagatggggttttggtgtggatgtcctttctgttgatgttgatgctattcctttctgtttgttagttttccttcttgcagtcaggtctctcagctgcaggtctgttggagtttgctggaggtcccctccagaccctctttgcctggttatcaccagcagaggctgcagaacagcaaatacttctgcctgatccttcctctggaagcttcgtctcagggggcccctgcctgtatgtggtgtcattcagcccctagtaggaggtgtctcccagttaagctacacgagggtcagggacccactagaggaggcagtctgtcctttctcagagctcaaacactgtgctgggagaaccactgctctcttgagagctgtcagacagggacgttcaagtctgcataagtttctgctgccttttgttcagctatgccctcccgctagaggtggaatgtacagaggcaacaggccttgctgagctgaggtgggctctacccagttcaagcttcccaggcagctttgtttacctactcacgcctcagcaatggcggacacccctccaccagccaggctgctgccttgcagttcgatctcagactgctgtgctagcagtgggcaaggctctgtgggcatgggacctggtgagccaggcatgggatataatctcctggtgtgctatttgctaagaccactggaaaagtgcagtatttgggcgggagtgtctctattttccaagtacagtctgtcacggcttcccttggctaggaaagggaaatcccccaaccccttgcgcttcccgggtgaggtgatgccccaccctgttttggcttgccctccgtgggctgcacccactgtccaaccagtcctaatgagatgaaccaggtacctcagttggaaatgcaaaaatcacctgtcttctgcattgatcacactgggagctgcagactggagctgttcctatttggccatcttgaaatggagacccaaggttttttataaacatcttttttattaatcaatcataacatggcaaaattgcacacttgccatttctgaaaagtgatccaaactctacatccacagatgaaaaattcttatagaattttgtgaaaagcatacattttgagttaaaaaaattttatagctgttggagtgccatgaaattaatacttgcattttggactgctgtagtttatactttttatatgtttcaaatcaggtgtgcaccatttgtacttagaacaccacaaaatgaagtatctaaaatcccttgattttaatatgtgttttggtttattaacaaatgatagtaatttcttacacatttttggaaattacttgtataagaatatatgcatctgcttatggatacagtgtgtaaataaaacttgtgctcaccaaactatcgcaaggacagaaaaccaaacaccgcgtgttctcactcataggtgggaattgaacaatgggaacacttggacacaggatggggaacatcacacactggggcctgtcatggggtggggggaggggggagggagagcattaggagatatacctaatgtaaatgacgagttaacgggtacagcacacccacatggcacatgtatacatatgtaacaaacctgcacgttgtgcacatgtaccctagaacttaaagtataataataaaaaaaaaacaagtgttaaaaaaaaaaggaaaacttttgctcactaaaatataagtaaataaataaatgcatgtcttgagttttttcctatggcctaaaattttttctaaggcctgtttgtgatggccgtgcgacctagtatgatatctttccagatagtctctgaatatttgggactagtctatcccaaaagatagagctttcctactcattccatttccctaagtagaggatgaaccttaggtctcctatagtccaatcctgcatcttggcacttaggcatcacaactccatggcaagggcacttggactgcagagccccttgctagtctgtgattactcagcatataccacatgaggcacacttagaaatacagcgtctcctcatagcctccccgttgtttgtctatccttggtgatatggtttttggtgatatggttttttttctgttttgcagtgtcacggactttctgttgaagggtttgtccttccttcctctaccactagagaggtaagagtctctttcttgcacatttatgtgactgataactttgctggctaaagtatcccagtgatcacttacttttcaaagtgacagatccatgcttttataaatcaactgaacatgaaatgcatttgaagaaaagacaatttttttaatggaaagagaatattatagaataagtatggattactttatatgaagacaaattcttttaatggttgattaagttaggccggcttatgtgagcgttgtgagggttagacaaggcagagggatcaaaatctatgaatgcatgacttctcatgtctcccgtccttcacattcctacctttctctagtaggatgtttgtagaccattagaacataaaccagtggttgttagctacaactatatgttggggtaacccgggttccaatttccaatttagtggattagaatctccagggatgggacgtgagcatctgtattttttttaatctatagaatgattctaatatataaccgtggttggaaaatattaccatgaaccacagacatagattatcagatgcttttatattttcctttttgtccaaactacacagaaattataaaaactagcttttacacagagtcaacaaaggagctagtgttagcatgattgaagtagtaagattcaatagtagaaagttctcaaaaatgctggggttgtttcagatagcatcttgggggacaggtacagaaagctaatgttatgcttcagggcttcactattgcctacaggccttttctctaatcaagaatgccatgtcccccatttgtcttttctctacctttacgcaagagtgaaatgttcatataattaataatacatacctgaatagtacctttaagagtcttcaaacattatttttacatttttaaatttggccttaaacaccattatgtaaaataggtaaagaaggaattatcattcctaatttatggataaggaaacaaatttagagattaattgtctaaggttgtataactagtaagtaacaaagataagacttgaacccaagtctttatactccaaatctacattgcctccctagaggatatactcaatacaagtttaccaaagtatacttctcaatccccttcaccccaaaataactttacatttcttaatgccctttttaatctaatagtatatggatgttttacataattctaatttttatgtattatacatacaattttaagttttacctcagtttttcctttatttacagtgatcagattttaataaacagtcatgtaaaaactcatgaagttgctatgccatgatatgccgttcccatgtttaggttacctctagttttacacttgtgactaaagctactataagtactcttctatatggagctttcttcctcttttgaattactatcttaggatgaactctcagaaataggattatgggttagagggcatggacactcttatagctcttgttatgcgttgccagattgccctccaaaaagattgaagcagtttactcactcagttattttgaagggggctgaatcaatgctcatggctacagtgtttttactgcctttcagagcaggtgattgatgtttcttggatgatggactcttaggaagtgattttctttttctctatcacagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacaggtaggcaaacctgttgttttctcaatagagaaatgtttttactccaacctgatgacattcagaggtctttgaggagccacggtcactttcttgtgccctcttcctcatacttcttttttgggccccctttgtagcggctctgagctctgtttgcaaaagaagtaggccgcaggaagacctctgtctttcaccatgtgtttttggtttgtgttagagggtaaagttgcctggaactcaggaggctttatgcttttccctgaaaggccctgaagcataccattagcatcatatttcaaatttctgatcacagtgctttttgtagctttaaggacttaataagaaactattggatggcatatcctttctgaactattgaggaaaagagatttggttttagttttactttgcttttgctattcacctataggaaaataagaaagtgaaacttttactcctacatttttcttattttcttaataaatcttcttccaggaaattatccacattcaaaaatacaaactattgaaagtgtcccaaatgttgcccgtattaacagtaggagcacataagtgaaggacaggcactgttggcagtaaaaaaattttcaaaacatataatagctgttttcattctgttagccactgggaggagatgcaaaagaaaaatatccagggctttctaagaagattctaattttaaaaattatggattgctgtcagtccatgtatctaaaaatgtgttcccttttaggcatagacctctagcctcagaaaacttagtctatttgaattaagtcgccttagaaagaaatcatgatcaaatgcaggataaaagaatacaagctgaaattagtagtactagaaggagtcagaccaaagctctactacggtgatttgtgttaacatttgtctattaataggtatgactcaatagatgaatgattatatttaacttttagaaattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaactt

SEQ ID NO: 4729 - DNA, 135224 bp, human
tccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccacatttcagactcgaaaggcttcagccaccgcttaccccttattcaagatagtatttgcaaagggcacaaagtttcagttataagatgagtaagttctggggatctgatgtacagcagcatggtgactgtagttaatcatactgtactgtatacttgaaatttactaagagagtagatcttaagtattctcaccacaccaaaaaaaaaggtagctgtgaggtaatagatgtgttaataaacgtcattttggtaattttccaatgaatacataaatcatcatgttgtactccctaaatatacacaatttttaatgtgttgaatatagctcagtaaagcttgggaaggtgggaagatagcatttgcctgcaataggtcagaagaagaggaggttataaaactcaagagtggagaagtagaagaaagaccaaagtccctaaaaaacccatttggaagattctgtttcctgatgttaacacctatggttaccttcctgccctctttttcttgaccttgcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcaggtactcaaaataaaaatacaaagagatctggagctatgtgtgattgggggttgggggcagagtggggactgaaggaagtgaaacccaccaaaagctaagagaactgtattttgcctttccctctttcatcatctttctgaaattatattccagaaagctttcctgtattgtactgaagtggtattcttgcagtggaaacttgaaacttgctgatttgagggagagggaacagtctgttctgttacagtggaaaatcctatcctgggatctttcctaaaatgcatgactctctaagttaatctatcttgtagtcaccactgtatttattctcattgagaaaatgtttgggagcaggtatctactattttatttcatttttaaaaattgtggtgtttgtatgagggtaaatgacatgaatcagcaaaccttctggactagacacagtaaagactttatctgttgatttttatagctgtggccactgtttcagagcctgttgcttcctccctcccccaactcctgggcaaaatgaggtcagagtcagcagatgcctttaagccaacttttaaggcacttcccctcagtaaaccagcatcctttatagaactgttgagacgcaaaggtagctgcatcctcttcaacgaccaagaaaataatattaagaaaacaatattctgggctatggtgggagttgaagtactctgttgtcagttataagatgcatgtgcattcatttccattagtgggaaaaattctctctataccagccattttctccagtggtctctccaagacttaggcaatctgagctccagtcttcatctataaatcagaatattgatatttggttattttacgagtatcaatataatgtggggttgcactgtgttgtccttagcaacagcaggcatttgttgttctttcaagccattattgagagatacataggtccaccaaaaaaaaaaaaattattcaagtttttgctccacaccaggtagtacagatcattatttttatgactttttttgttgttgttgagacggagtctcactctgtccccaggctggagtgcagtggcacgatctcagctcactgcaacctccacctcctgtgttcaagcgattctcctgcctcagcctcccgagtagctgggactacatgcgcgtgccaccacgcctggctaattttttgtatttttagtagagacggggtttcaccatgttagccaggatggtctcaatctcctgaccttgtgatctgcccgcctcggcctcccaaagcgctaggattacaggcgtgagccaccgcgcccagccttttatgacttttataaaaataccattgtagaaatttggaaaatatagaagagtgtttaaaaaaattcacctgtaatcctgcccactcccctcccccaaatcctacatcctactcaacgttttctagtttgagctcagtgttttgtttgttgctatttttactagaaattaatatcagtagaattggaatttcatatctggtacaatttgaccaattttttcaattctattagaagaaatctgttatctccctgtaatgttaacactttttcttatttggcccagttataaagaatttaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaataaaaaataaaaataaaaataaaaaaaaaaataaaaaaataaaaaataaagaatttaacagaggaagggggaatagtagggaaacattgaattgcccattctaaaattttaatattccattaaataatttttcacatagccaaaaaatacctttcataccaccttaatagtaattaggaatgtttcaaaacattatagcaatgggaaacatctttcaaaaagaaaagattttgtgggaatttttaaatttatatgaactttccttattaattgcaacaggtttttattattaggtctcaatttttttctcaaacctgattcagtgttaatcaaggaccagaaaatcatatctttttttgtcattagggttgtaggtcacatgtggtctctatctaactactcagctctgtgattgtggtgcaaatgcagccagagacaatgcagtcatccctcagtatatgtgcaggatggattccagtacaggctgcttataaccaaatctctgcatactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacaccagtctgttgattcatataatttctcttgaatctatcccctcttttctcttcccttctgcctcaaccttagtctaagcccttatttcctaacacttctgtgaaaaccacatttaaattatgttatttccatcctcgacaatctttctgtggccctcatttctccacaagtaaagtcgaaacattttggattgatagacaaggccctctatgggttggtcccagcttatttttttcaatattatatcacgctggtgccctccattatacccccagttccagccaggctgatgtctttattactcctctaatcccttaataaaaatacctaacatttgtataaatactttccattgtacaacacacttccccataattaccagtattttattctcacaataccctgtgaatcaagtattatcctcaatttccaagtgaagggactgaggcccagagatgaagctggaatttgatggtaccatgaatgcaacctgggtcttatgacttcggaatcagtattgtttgaatttttgcctccgtgggagccatagacattgccacctgcaaaaatttttatgggcttcttcttctacctgcctattccctttcaatctaaactaatatcctttgaaagcctagcaccaatcccactttttctgtggtccctgtccttcctcacagaccactcacttgtacagtgatcacttctttctcaggactcctttcttggaacttctagatcacttaccatctgtgccattcaacatcttcatttttttaaatttaaaagactgtgtaatcatcatgtgccaggccctataatagatgttaaaaagaaaatggtacaaaatgtttatatgtaaccctcaacttttttttatggaaaatttcaaacttacaggaaagttgcaagaatagtaaaataaacatatttgcatatactctatctaaattcgctagttgttaacactttgtcatatttgcgtacccacccctccacacacacacacacacacacacacacacacacacacgattttttgataagccttttgagagttacttgcagacatgagtttgttttttaattcaacttccttcgtccattgacttgaaggtctttttctgaacctggcctctgcccctttttctcagggagttcattgtctgatgggggagacagatatataagcaagtagttacagtacattaagataggtactataggtactgatttatatatttgagataactactaagctctgtgggaacacacagaggtgggaatgtctaaacttctttgggacgaggcaaggaagacttcagagaggagttgggttttaaaggataattaggaaatgctgggtagactatgctgtagttagtttttaaaacatatctgtcccatttcccttttctttatgttctacaaaacctgatagaggttcaataaatatctgattgcacatatacctgggggtagagagaaagaggtacacagatatggttgtgtagttatatattcttataaagtcagttcacagatatatattgatttatgtcgtcaaaaagaataggcaagagggagagtcacttggtatggggtagaagccctgatgtatgaatgtacatgtataattaatgccatctagcacacctggatcagaaaacagttagtttggggaacacagagtacagatacctcccatcattcctacctcccgatacttcctactaattttatcttgccttggaaattagaacttgaggatagaaatggctgacaatggccactaattgagatcctccactgagtccttgattccccagatttgctgtttaaagaaaatttagatgggagtagtggggctagagggtaaagggagttgatgggtttgcaagagaaaagatgactaaggcagtaaaatagtgaagaagccaatgacatgagcccaggattcttacagaatagtataaatgctgagttctatattggtcgactagaggcccttaatatgtttttttaaaatgagttcctttaggccattgatataaagacaagactattcaagcccctccctctgcttcccattctaattcattgacttttagaaaagacagaatatggtagaaacctttgagtatgtggtgacatgtatcagaattgaataaagtttccccacagaagaggttgtgttaaatactttccataacaggtatattaaagagatggactctttcattagcatcaaagtcatatagatgtcttcttgtaggggttacagtaagtttccttgctttataataaatgtttcaggctttaaaatgtgacaagatcatgcactgcctattctttctctctttttaaaatttcttcttttgatctgtaaggggaggggaccatttatagacagaaatgacttaagaaaggggactctcccacagaaaccatttttattcttatttttccctcaataaaaggcttcataaagagttggaacttaataggtacttatccttatcatgactattgcttgtagtcccatttgaatatgttttgaagaaataacagaatcatgtggcttccaagtagattagttttcagaggtgtcctgaagttacctctgagccagcataccctggagtaacctggttggatttcttttggactgtgaaacagaaagctttttggagaaatagagaaactgttcagtgctatgttcttccaaaacacatttctacccatgccacgattgatgggccctttagtgtcatgtagtatatagttggtgatcagaattttgagatgttatgattggaaaacaaactactttaaattatcaagccccagtaagagaaatagtgatgacttgaaacttaagaatttgtgactttctttcaaggaaaacgggttgagtcaaatgaacagatcccctttatacttattctttattaaaattcactttattctttagaggacatgtccagataaatatttctgtggactcttgaagataagtcttggctagcttagaaaaaatgaaagcaatgttgtagtgaagtctttctaggccataggatgtattttagaatatcctcagagccttaggatttttgagctgacttgcccctttctccaggtggaatgtcctctaataggatggttggcttatttttacataaaccagttgaagcttggatgatttttttgacttgaaggaatcataaagtgtagcttttgattccacttttagctgtaatctgctcttctgtgtaccaataaagtaaatgtcatgtaaataggaacacaggatagggttacttgttctcaaaaggtcatgtaccatctgcagttgctgagtaagtgttcctgtatctagggatgtttataactgtcttgtttccatttatttctgcagagtgtagtgaagctgatgagaggactactgcactgcatgatcagacaggtatggtattgataacaccttcctctctaataaaagcacattgtaatagtatctctaccctttagggaatgtttatagcttatattttctttcagtttcacaaatagtacacactaattttagaaaattttgaaaattggagagggataatgtcacccataatctcacaatgtaattaccactggaatgtttctttccagtcttttttgaccctctacaaatgattttcaatgtgtttcatcattactgtacatgcaattgtgtatgtagggtgaaaagatgatacaggtttaaaaaccctcatttgaccaggcactggtggctcatgcctgtaatcccggcattctgggaggccaaggcggatggattgcttgagtccataagttcgagaccagcctgggcaacatggcgaagcgttgtctctacaaaaaatataaaaattagccgcgcatggttgtgtgttcctgtagtcccagctacttggggttagcgggggtgaagtgggaggatcacttgagcctgggaggtcaaggctgcagtgagccaagatggtgccactgcactccagcctgaaacccagtctcaaaaacaagtaaacaaaatgcacacacacacacacacatgcacatacacaaaaccctcatttgaaacccttggggccatcaactttagaatttaaagtttttcagattttaaaaaggcagtacagtgcatactcctgccaacctttaattatatggtgtatggtatatatacaccatatattaccttatgccttctgcgggtctagaacagcactctataatcagaaacattaatatctctgtagggaaacatgcaatttcatactaagtagaataaataaagacttaatttgaatctggtgttgccaacaaatgaattttaatgcaaaatttaggggaaaagccttttcaaagtgtttcagattttaagattggagataagaaaccttgaatttgcatctccttgcagtaatttgcattttcctgacctccagtgaagttgagcatccttttatgtgtagattgaaaatttgcatttcctcatggatgaattgtctgctaagtcctttgcctatcatctaggttctctttcctgcctgttgaaaagttattgtacattatagacattagtcctttgtcatatgcattgcgaattttttagcagtctatcatttatttttgaggcttgtttgtgatatttttgcatacaagagtgtttttactttaaaaaattgttttatcctaggagatcttaaagcattttgcccacactcaatcttacctgtcttttctgaagatcaagattgtgttttattagaagaagaaattgaggcccggattgctaaagtgactgcctacaggcacagaagtctatagtagaaggaaatatatagtagatagaaagtagtacatagaaatatatgatagatagaaagtctttgctactttattttgtattttagatatttgcactttcgtttttttctttttagataggggtctcactttgtcgctcaggctggagtgcagtgatatgatcatagctcactcactgcagccttggcctctgggctcaagtgatccccccacctcagcctcccgcatcactgggactacaggtgtgcaccaccatgccttgctaattaaaaatttttttttgtagggatggaatctcactatgttgcccaggctggtctcaaactcctgggctcaagcgatcctcccaccttggcctcctaaaatgccaggattataggcatgagccaccttgcctggccaatatttgaactttttaccttaccaaataggtttaaggtcactaatttcaggaaccaaatttaaggtataacggttactgtcatacatcagaggcattaattatcaaatttaaatttcaggaactaagtctttcagttgtcctttgcacaatatttccttctgacttctagttttagctttctgttttgaacccaggaaatctgagacagatctcagttaatttagaaagtttattttgccaaggttgaggacccacccatgacacagcctcaggaggtcttgaagacatgtgcccagggtgattggggcacaacttagttttatacattttagggagacatgagacatcaatcaatatatgtaagaagtatagtatattagttccatccagaaagggtgagacaactgaaagcaaggcctccctccactatgggcttccaggtcacaggtaggtaagagacagatggttgcattctcttgagtttctgataagtctttccaaaggaggcaatcagaatatgcatctatctctgtgatcagagggatgactttgaatagaatgggaggcggattttccctgaccagttcccagcttgtaggggcccaagttattttcctttcacatccccccacctttgttttttcaaatcttttggagaaagcattttacaagaaaatgaatctctgatctcaggtttcgcctgatctctcatgagtaggacagtttatttctagatgggtaggtcccaaaagctcatttttagcaggttgtgaagtctcatatcctgtgaagagaaaatggggggaggtaagggagaaaaaacaataacaaacaaaagaacaatcctggaaaaatcagtataggccctattactctgaagtccatacattattaggcaggtatgaaagtggcttatgaatgtaaataggttactgttgttttttgagatgaagcctctttctgtcacccaggctggagtgcagtggtgtgatctcggctcactgcaacctccgcctcccgggttcaagtgatcctcctgccttagcctcctgagtagctgggattacagatgtgcgccaccacactcggctaatttttgtatgtttttagtagatatggggtttcaccatgttggccaggctggtctcaaactcctgacctcaagtgatccaccagcctcggcctcccaaagtgctgggattacaggcataacccaccgtgctggccaattactgttatttttttctgaagtttgagttgtctggcttcagttcccagggttttaagaaagcacagctgagttttcagggactccaaattaggaaaaatgggggaaaaaaaggaaggaaaaagttgaaaacattattttgaagacttgtagccaaaaaaaattagaattccatccaaactgtagaaactaataaaaattgaaacaaaaattaggcaagactagaatctaacaatgggtgtcctatcgttttgaaatataattttttctctctccggtttccccttttactaaagacaaatcatggtaggactggtttgcttattatacttggcctaattatttgtatacagtgcagcaagaataattattttttacataggcttttaaatgggctttgatggaattttgttccataggaggaatctcagataagatttttttcttgagatggagtcttgctctgtcacccaggctagagtgcagtggcacgatctcagctcactgcaacctccacctcctgggttcaagtgattctcctgcctcagcctcccgaggagctggggttacaggcgcccaccactgtgcccggctaatttttgtatttttagtagggacggtgtttcaccatgttggccaggctggtctcgaactcctgacctcatgatccacctgcctcagcctcccaaaatgctgtgattataggcgtgagccaccacacccagccattagttaagacttcttgaaagccgagcccagccatgaatttatgccatcaaatatctatgagttgtttgaatttctcctcctcttggggttccaagataaacctgaggcttctgtgcctgtcggaaagtgacattctttacttaccaagggtcagaaaccctatatgtggtctgtgtacatgaaatatgaggccagtttttccaagggctttattggcttcacaagtcaagtttgattctttaaaggaaagcacaccattccagtcaaagccttggtaaaattaccagtttctccaactgtgtcccgttacaaatgaaaacagattcttattgcacttacgcaaataactgtattgccataagttaagaatactcacaaatagtttccaaattctagagaaaatcaggtagagagaaataaatatgctccaaatcttttttatggcagtatactaaattgttaaaagctgtcagtagctcaaaagaaaagttttaagtatctgaaaaacaaaacaaaggatcagcaaacattttaagcaaaaagtccaaaaaattagttcagtccatgcagttatttcttgttctgcttgatattcatgaacattttagttctccatgagtcctggaaatttttcctctattctgatgtcacaatcttcaaaagttatcagaaacctgcatttaagagcacctattggaattttatagctgattataaaaccgtcttctaaaaaggaccaaaacaagacaacaattgtccatggatgaaaaaaaagttttaaggcagccataatcaaaagacacaattgacaaagaaatttgttacctctgtggcacacaataattttaacataacaattaggaatattactgataatgtacactaagttatatcagaatttcaggagtttctcataattttggaacacataccaataacatatttatacaaatacagcccaaagaaaaccaaacaacatttcatatttgacagtgcttcctgtataatttttataccaaataagccaaattatgacatttttggacttcagggaacctaatgtcttaaaggattaattaggttagaaaaagacataatttataatttgattttggaaaatttgtcaaatataaaagtttgaaatgcttgatattacaaaagaatattacaggtcattgtttaaccaaagtgataattcaaggacttcaaaaaaagtgaaaaccttaattctttgagagaagagacttaattttctaaacaagaagccctaataaaaacagcatgaagccaattacatttgtttttcaaaattttgtaaacaatctataaagtttaaccttgattataaaatataacttccataaggcttttataacctttattaaggagttggaggagttggttaatgctttaagaaaaacctgttaatctgacacaggggtccatatactggttttgcatcagtgtgcctttcatactaatgattaatttatagagaaactgaacttattttatctttaaaaattggcctttacaatctgtgcactgtcttcttccacgatagtccctggctcatgaggaatcaaatagctttaattgttttttgccctgtatttcaggaatgcagcttattttgattggcatcttccatggggcctgaagatgaggctttaattgctgttagtgtttaagatttagcaggacttgatgtcctttttagacccaggagttaaagccctctaactcaatgtcacaaggactttaaaagcccatataggaagatacatggatgtaataaccttagtttaaaaaaatttttttttgttaatctcagtttttttcctaagcaaaaccaaaacttaataataatatttggactttctggtttgtcctgaacatccctctttttttttttttttttttttttttgagatggagtcttgctctgtggccaggctagagtgcagtggcgcgatctcggctcactgcaacctccacctcctgggttcaagcaattctcctgcctcagcctcctgagtagctgggactacaggcaagcacgccaccacacccagctaatttttttttgtatttttagtagagacagggtttcaccatgttggccaggatggtctcaatctcttgaccccctccacctgcctcggcctcccagagtgctggtattacaggcatgagccactgcgcctggcctctttattcttataactttctttacatctccttttgtttcctggttgtttttaccttgttttatacataacctttaaataagctttgaattagacaaaacttgttcaccttttattttttagcaagaatgttttcctacaatatatatttattggaaaatacccaaataattaaatatctattatttaatataactttatatcctaaattatgaccagtttttctgcaagtacttatcctattacatttacgtaattattttaattgttttaccctgattatttatgaaaactgtgatagtcgtgatttaaagttatgaaactgccattgaaaattatgactgagacagtgaaaaaagatttgacctaactgactccatcttgctcttagccccaagccgtccttgttcactcctgggcataggccaaactaactttgggaggaatttagcttatagattagctttgaaacaaagagaataacagtcctttcccaaaacaaacctccttattgtctgtgcatactgcctaaagccacaagattcgaagttacggtaatattactaaattcaagatgcagctattttcattaagcccatatcaatgtcttatttattaaaaattacacaagcaaagaatcgttctgttttgggctgggcttatagtttgtaacccctatgccaaattttgacacctgatagtatttggcagggataagtatgaaattgcttgattcataaatgtaaaacaaaagaatgtatactggcaaatcttaagacatttctaatgttactttaccaaataattttaaaactagcttatttattacagattttacttaagttacataaacttcaaaaagcatttgacaattcttttttagtatctgatttaaatgcttttatttttctttaagccaattaattagatctcttatatatgtttagtagtgaaacagtgtgtacacaacacataattacatataaggacacattaggcatgccaatggatttataaagaccccctcttttttttttcttagattttcatattcttgataacctgtttcacaaccctacacagttgtcagctaaacagctttaaatttgcacattgaaggaaacagttcaggtgaaatcaaatagcaaaatttacatcataatgtacagagagaaaggtctggtggtgcagaactacagggagatgcttttacagtgcacttaaaaaaaatttttttttttttgagacagagtctcgctctgtcacccaggctggagtgcagtggcgcagtctcggctcattgtaacctccacctcccaggttcacgccattctcctgcctcagcctcccgagtagctgggactacaggcacccgccaccatgcccggctaagtttttgtatttttagtagagacagggtttcaccgtgttagccaggatggtctcgatctcctgacctcgtgatccacccgcctccgtctcccaaagtgctggtattacaggcgtgagccaccgcacccggccaaaatttttttaaacaaagacatttctgagtgtcttccttaaaaacccaagtgtagcctctgttgcgataactattttagtcaaaaaatcaggtgaaaacagaattcagtcaactgagaagaaaaaaaaaaaaacttttgctcaaaaaaaagacaaggtcttaggagaccttgtttttttttctcaaagaaaatcaacctcaaaacatgaaggccttttaaatacaaacatgcccacatgcacacatatacacacacatcttggatgttaaccttttaattaagccgacttttaaccattgagctcttttaaaaaaaatcttttaaaatcttattactgtatttcagctaggacaaaatgctgctaaactaacaatcatcacacaaattctatgatttctgagcactctaagtgtaagcagaatttaacaccagctggttgttaatgctaacttcagtcatttaaaaagaattttcaagacagaatcccaaaccagtttcttacataatgatgggtctcaggctgtagactgctctctacggtcctagaaacaggaaaaacaaaaacaaaactcatcttccccgttagaagcgtgttcaaactccataaaggagttacctgccttccatcgacatggaggcaggaaaacttgctttccttgtgttggaagcaagtaaaactccaaaaaaagaggagttgtaacagcaaaataagctttagatctcaaccaaattttgagagatcagggattctgttgagggggtgctctcaggcctcagcaaattgtcctgttggtttgagccatcaagttagctcatgctggtaccaagcaccaacaggagatttgtcaaaggtcaggggcatctccactcagaatccaccccaccttgaggttaccaaaatgtgaaccctgaaaatctgagacaggtctcagttaatttagcaagtttattttgccaaagttgaagatgcgcccatgacacagcttcaggaggtcctgaggacctgtgcccaaaatagttggggcacagcttggttttatacatttttgagagacatgagacatcaatcaatatatgtaagaagtacattagttcagaaaagctgagacaactcaaagcaacgccccacaactgggggcttccaggtcacaggttggtgagagacagatggttgcattctcttgagtttttggtaagtctttccaaaggaggcaatcagaatatgcatctgtctctgtgagcagagggatgactttgaatagaatgggaggcagattttccctgagcaattcttagcttgaaggggcccaagatattttcctttcagactgtcatacctttactccctcactctatgtgtctctcagcagctcttttcattactccttcaaaatatatcctcttattctaatttacttcgaaatttctacctcagtttcaggaacaaatgtatcttttcacattcagttacctcttactaagctgttctcactcaagcactctgaatctcagtttatctacaatgtgcagtgtggcaaagcaaccatatgaagagtaaacaagaggcaatgaataggaaagagctgtttttgactatttggtattattttctgattaaatcacctaaattgaaaaacaacaataacagactttccagttatattagtgcagggaaaaacaggtaacgagtattttaaatattcacaattgcctgaagatagtgtatcttcacattgcaataatgtatgttagagtattacagaagtgtggcatatgggttgatttttcagtatatccttcttttaatgtttttgttcttttcaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggtcagtacaaggagagaagtgctgggagcccctgagcatggagtctggggtactaattaatattcttttaaattgagaaccgggaaggctggggtagatcttcatgaaacaggtattttttattatttattaattctcagatatcatgagatggcaaagaagggctaggtttcattgcttgttctcattacagtacattgacaagcctgccagttagtataaatacaaactcaatcacctactttatgctactctttatgaatatattataaacaaggcatctgtctataggcatctaaattatattaagaaaattaacttaggaatcagaatccaaattttttaattattgaatactatatccttttcagatggttctcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactagttaggaagttagtgaaatactttaaggcaagattgattcagaatttatgtaaggcagttaccttgagaatgaaagggcatatgtgagatttaagtggtagtatgcaagatcttcacagagtatttagcaatgctctacacatttttgaatacacaaatctccaccttggttaaaagagaggcttagacagaacttgactgcaacttacagaatgggggcaggaggggctccatggaacctcccccagcaaaacaaccataaatgttgaaaattattttttaaaaaccagccactacattattggaaattgtctgaaggacatacagcaggtagagaaacatttactccaggaaatctaccaagtattggtaaaagcagtgagggagtgtggcatttgagtctaaatctactcccccctccaccccacctcagcatggcagaagcaatattcaaggcgggtacaaccaagagcacaatctccccagctagttcccagtttagggacactgtatctctctgagggaggtaaggagatacatcctctccagctccatgttgcaaaagctagttcaggcaagaatagctgacaggcctggagttcccctcctccccaggaaaaggcagggtgagaatgctaggccctgattaaccttggcccacttcactattagggtggaggttccccactgggaggggcaaactaagaagatcaaaggctaccatcccttcccagcactcaatttgtaaagcaggggtgtcactccaaaagaagtgggccactgttctcaccactagctctggagcactggcacggaaattttgctggggagagaggcaggctgtaaggacacaaagctctgtagcttttcccaaaggaattgactttatttaacagagtgtggaaaagttaaagcctaaaggcaatctcaaaaaacaatggagatttgggttctaagcaattaagaggaggctagtagctcaataagagcaagaagctaaaccatatactagctcaatggcacatggaacatttttcaggatagattatatggtataccataaaactagcctcaataaatttgaaagatttcaaaatcacacaaagtatgttctatgaccaaaatggaatgaaattaggaacagaaagaaacctaggaatctcacaaatatatggaaattaagcaatacacacctaaatgaccaatgagtcaaattgagaaaatactttgagctaaatgaaaaagaaaatacaacataccaaaacttataggaagcagagaaaacagtgcttagagggaagtttatacctgtaaacaccaatgtaaaaaaaaaaaaaagaaagaaaaatcagtaacctaacctcccaccttaaggcactggaaaaagacaagcaaactaaacccaaagcaaagagaaaggatgaagtaataaacattacagcagaaattaatgaaacagaaaatggaaaaaacaatagagaaaatcaacaaaaccaaaagttcattctttaaaaagatcaacaaaattgataaatctttagctacattgaccaagagaaaaagagaggatactcaaattactaaaactaggaataaaagaggggacatcactacaaccttacaaaaatataaagaactaaaggggaatactatggacaactggttaccaaaaattagataattttgatgaaatgggaaaatttcttgaaagataaactactgaatctgactcaagaagcaaaggaaatctgagtagacttactacaatcgaagagaattagtaatataaaatctttccacagagaagtaagcccgggtgcagatagctttactgataaatctaccaaataaagaagagtgaacaccaattatttacaaacacttccaaaaatagaagaggtgacacttgcaacctcattctgtgaagccattactctgatgctaaaaccagacaaagatatcacaacaaagtacaattatagatcaatatctcttattaatatagacataaaaataaacaaaatactaggtaactgaatccagcaatatattaacaagtttatataccttgaccaaaccatatatattccaggaatgcaaggttgttttattatctgaaaattaatgcaatacatcatgtcagtggaataaaggacaaagatatattattgtctcagtagacacagaaaaacatttgacaaattcaacaccttatcatgataaatacttaccaaataaggaatagaggagaattttttcaacctgataaatggcatctttgaaaatccacagctaacatgacatttgatggtgaaagaatgaatgcttttccccatagatcagaataagacaaggacatcaactcttgccaccagtatctaaaattgtactggcagtttagcaagggcaaatagccaataaaaagaaataaaaggcatcaaataaatgaaggagtataattatctccatttgcagatgatacgttcttacatagagaaatcctaaggaattcattaaaactctagaataaacaaagttcagcaaggtaacaacgtacaagataaaaatgcaaaaatgagttatgtttctaaacagtagcagtgaataaccaaaatgaaatttaaaaataatttctattacaataggatcaaaaatgaaataatgaggaataaatttaacagaagaaatataaaatttgtactttgaaagatatgaaacattgttgaaagaaagtaaatatctaaataaatggaaagacatctatattcaaggatcagaagatttattgttaatgtggcaacatttcccaaattaatctacagatttaacatcaactgactttgcagaaattgacaggctgtttctaaaatttatatggaaatttaaaggacccagaagagctaaaacaatcttaaaaaagaagaaagttgaaggactcaaatttcctaatttcaaaacttactacaaagctatattaattaaaacagtacaggtactggcataactatagacatgtagctctttggaatagaattgagaggttagaaataagccatcactttatgctcagttgatttttgacaaaggtgccaagataattcaatggggaaagaatagtctcttcaacaaatggtgctgggacaactgtatgtccacatgcaaaagaatgaaattggacttcttcctcacaccatatataaaaattaactcaaggctgggcgcggtggcccatgcctgtaatcccagcactttgggaggctgaggtggcaggatcacttaaagtcaggagtttgagaccagcctggccaacatggcaaaaccccgtctctactaagaatacaaaaattagccaggcgtggtggtgtgttcctgtaatcccaactactcaggaggctgaggcaggagaatcgcttgaacccgggaggcggaggttgcagtgagccaagatcacgccattgcactccagcctgggcaacagaatgagactccatctcaaacaaacaaacaaaaaaagaaattaaatttaaaaaattaactcaaaataaattgtaggcctaaatgtaagaaggaaaactaaaacactatattagtctgccacaacagaataccacagaataggtggcttaaacaacagaaatttattttctcacagttctggaggctggaagtccaagagcaaggctggtagggttggtttctggtgaggcctcatcttgcctttcagatggctaccctttctgtgtttttacatggccttttctctatgtgtgtgcactcctggtgtgtcttcctcttcttataaggacggcagccctattgggttagggccaccctcatgacctcatttatcttcttaattatctccttgaagtccctatctccaaatatagtcatattaggggttagggcttcaatatacaaatttttggggggaggacacaattcaatacataacaaacacttagagaaaaatacaggagtaaatgtttctggccttgggttaagaaaaagcctcttagatatggcacgaaaagcataagctactgaagaaaaaatagataaactggaatgtatcaaaattaagaacttttgtgcttcaaaggaccccatcaagaaactaaaaaagcaaccaatagtatagaagaaaatattcacaagtcatatatctgataaggtacctgtatctaaaagaactcgcagaacttaatataaaagataaataacctaattaaaaatggtcaaagaatcagaattgacattcctccaaaaagatgttcagataaccaataagtacatgaaaggatagtgaacatcattaattttgaaagaaatataggtccaaaccacaatgagataccacttcacacccatcaggatgactgtaatcaaaaagacagataataagtgttgctgaggatgtggagaaattggaaccctcatacactgctggtggaaatgtaaaatggtgcggctgccttggaaaagagtctggtagttccttaaaaggcttaaaaaagagataccatatgatctagcagtttcactcctaagtatatatatacccaagagaaatgaaaacatatgttcactcaaaagcttatacattaatgtttatagcagcattacttatgatagccataaatgaaaataacccaaatgtttatcaactgataattggataaataaaatatgatacatctgcacaatggaatttttaaattttttttcatgttactgctacctctcaagatggaatattttgggcaataaaaaatgaattacaggtacatgccacaacactgacaaaccttgaaaatattatgctaagtgaaagaacccagacataaaaggccacatattgtatgattccatttatatgaatgtcaactaaggcaaatcatagagacaagaagtagattagtgattacttaggctggggggcaactgtagaagggaagtggggagtgactgctaaggggcacaaggtttcttttggagtgatgacagtgttctaaaattgattgtggtgatggtcgcataactgtgcatacactaaaaaccgttgaatatatacttcttatgcatgctttttacatatctcaataaggttgtttctaaaaatgagagaaagaggcttaatgttatacagatgagtgcagaatataagtgcaatagaccactgatttagctccatttctggagccctgtatgccttagtattctttatatagtcacctttggtctaatccagccctatctcattttatgtgtactcacctctgcattctttgttcgacaagcagtgtctgggctctacaggaggcacaggatccagaggtcctccatttatgacctttcctcaagaggctgatccctttcctgtggttaacagaggtgtttaaaatcacttaataaattttcaaacatctactgttcaatgctatttaataccgttcagaatactacgtgagatacttttagtggctatgtgagataattttagaagatgcagatataaataagatgtagttctttccttaaaattcaagtacacatttgtctataatacagagtaaaaaaataagttcataaaagtaagaaaaacaaaattctgtgaatcacaaaataggagaatcaatgatagcatcacagaggacatagcatttgagctgagccttgaaagaacagtaggatttcaagatctggagagaagaaggccatttaaatggagaatataacaagcaaaaggacataaatggtagaaatgtctggcatttgtatgatatagctgtgatgcaagtctaacagatgaataataccagtttcatacttttgccttctctgtctctgctcaatcgcattgtcacacaaagatgacaagataaagctatgaagctgatgtcccatgtcactatcatctcttctctttaccggcgtctttccaagaagttagtgtcattacgattgcaagaaaaaacacactttgccactttgcttctgcagcttccctgtgctatggatgctattttgacagagccatggatcaggaggagtttgcaatctgataataccaatcatatagttctttttaattataaagttacacagttccatgatttaaaatatatgttaatagatcaaagatttagatgtggccaggcgcagtggctcaaacctgtaatcccagcactttgggaggcttaggcgggcggatcacaaggtcaggagttcaagaccagcctggccaacatggtgaaaccccttctttactaaacatacaaaaaaattagccgggcatggtggtgggtgcctgtaatcccagctactcaggaggctgagacaggagaatcacatgaacctaggaggcagaggttgcagtaagccaggatcatgccacagcactccagcctgggcaacagagcgagactctgtctcaaaaaaaaaaaaaaagtttctgataataaaaaaatactataaacaagtccaaattccaacaaactagcaaaaatacttgcaacacatatgatgtgcaacggactaatttccttaatatttgttaaaatatcaataatagagaaagaagttttttttaaagtttaatgctgagcaaatacacacacacaaacacacacacacagtatgtttgtgtgaaccacagaaaaggggaagcaatgacagcatcacagaggagatagcatttgagctggaacttgaaagaacagtgagatttcaagatatgggaaggaagggaaggccatatgaatggagattatgagcaaaaggacataagtggtagaaatatgtggcatttgtatggtatggctgtgatacaaatctaagagatgaataaggccagtttcatacttctgccttctctcagcctctgatttctattgaattgccagtctttctggcaatatatacttacaatgcatactttttatgtatctcaataaagtttttaaaaatgacagagaatgaggcttaatattatacagatggtgcatgtatatatatgtatataccaagaccatacatatgccattttatatatatatactaagaccatacatatgcaaagactggtatatgtatgtaccaggaagaccagcaattcagtaaaaatctgaaggacatgaccaaacagttcataggaaaagaaatatgaaacacagatagcttataaatatatcaaaagatttacaaccttactcataataaaaaactggaaattaaactacaaggggcttctatttcttatccactaaagtgagacaaagattaaaaattttttttaaagcctgtgtttgcaaagatgtagggaaacaggcagtcagtgttggtatataaactgtagaatttctttgaagaataacttggagatgattatcaaaatttaatatacatgatgaagtatttagagggaagtgtacggatatctgcagcttactctgaaatgtatcaaaaaggaagatggatagatatatgatgaacaaagtatactaaaatgttaatggtggagttcagatggtgagtatacaggggtcctctgtaaaattgttccatatttttctgtttgtttgaaagtgttcataataaaacattggaaaataatatgcatacatctttgggtcagcaattccaagaatctgccctgatatactggcacatgtgcataaagatatatttccacaaatactcattgcaacattgtagtgaggaaagatttgatacaaccgaaatgtccttccgtagggaactggttacatgagtaaccgttcagtgaaatgttctgtagctattaaaaaaatgagacagatgtatttgaaattatctccaagttacttatatatgaaaaagcaaaatgcagtataatatacagtactaccctttgtgtaatgtttgtacatgcataatatatctctgaaaggatacagaagaaactggtaaaacaggtttctccagagagatttggcagtggtgaaggtgatgtggttctgggtaggaggaagactcactggttatccttcggcacagtttgatttttttcatgaaagagtattactaagtgctgacttacgaagggcgtgttaggtcttagaattctttctgaactggaatgggtgttcaggatattcacagtggagttcatttgaaagctgacattaagaaacatttgacaatcattttacatcatgcttctaagaatgtgagaggactttttccattctcaagtccttttaaggaagtttttttcatctagatctaattgctctagatatgcccactgttcagcaaactagaatttcttggctttttctggctaacacaactacatagctggcacatgtactcatttccattaaaccaacacatctgtttttgtgacaaatgcgaacaaaaaatgttttgtttaaatagaatagcctccaccaagtaaatatgagaagcttaaaagtttagtctctatagctaacctgatgttcactttttcctcctgtttgttatagaccagaaaggaaaaattagcttcctgatttttaaattctgaaatgatttcttagtttagaatcaaatagtccaaaccaagtctttcatatgtaaacagtaatatttattgttataaaagaggtatattaaaagttaactgcttagtaaattttaggtgtataaaaacttttagtgctcaggattaagtaattttgtataaaattttatgaaatatatcctgcagttttctgatttattatgattttgctttttaatataactttaaattacaaaaaattacaaaagtagcacctgtttcttgtagaatactgtaaaattgcaaaaatgtccagaaaagataaaataaaactaccttgaatctcaccaccaaagataactgctattaactaacatcctcctggttatatatttgtgtagttctgtatgtttgaggggggagatataaagagaggagtttttaagcaaaaatggatcatattatacatattaggaggcagtatagcatcttacctcctaatgaaactgcattcagcattctctgaaatgaaactgaaatcaacagtcaattgagtcccggttccactatttgttagttacatgaccttaggaaaatttttaactcctttaagcctcatggagaaaatagaggtgcttacctcttagggtggttgttgaaaaattaaatggataattcatgtaaaacattctgtgtgtaagttataatatctttgtatggcttacatttagaataattatcatttttacttaaaaatgcaatttaagtcctttttaaaatcataattttatctatttcttgcttagtatttagaccccttccagctcagttttgaaatatttgtcttttattccccaagtgcttaggtttgtacatttaagcatattataaattagttacctatagaatcagattttactttttggtaaaatctgtaaataacagttaaaattcttccatgttgaaatatgcttatatctcgcttagttggagactagcctaggacttgtttgtggtcttgtttttatagtttaagatcaaagtgccttccattgttcctaggcaggagtaggattgcttgggattagtgagatcagttagtcactatggctgcctataaagcttatagtgataattgaccagttctgtatctttattccctctttcctcaggactccatatcatccacagcctagatgaagtcaatttcatacagaaccttgtgttttacattgaagctgcatataaaactgctgtaagtactgattttagaatggattttagacatatgatgtttttgttttctaaatactgggcaactcagttgttttcttaatgctactgctcatagtgaaccaacctaaaaggcttctggcagaaattgtctttagcctctttctttattaagacctgtcatcctgtgtcttctcttcaagggggttacagagacaagagggtcaggatgctatactttcattcctttcaaactctgtgatatctcatggtatgtatttggcaatctgggctaaattgtggtcttattttaatgatttaagttcttaagagcaagatagctaggttgtattgtgggtcagttagctacttagaaataaaatttagtcatgtttgtaatattatctgtaggtgttgattcagtgcttacaatgcaaataagttatttttccttacaactaccatatgaggtaggtttctgttaaatcataatatatttaacatcttctctgtataaaatgttaagttagacactatacaggaatgcgatttttttcttcttcagtctaacatagacaacttttctttgttgttcattgaagctttattcataatctccaaaactggaaataacccaaatatctatcaacaagtaaatggataaacaaactgtggtatatccataaaatagaatactactcatcaataaaaaggaatgaactgttgattcatgcatcagtgggtgaatctcaaaggcattatgcttagtgaaagaagttagacaaaaaatgtacagactgtatgattctactcacataaaattctagaaatctatagtgacagaaagcagatccatgattgcctcaggagaggagcagagggagagataaattacagaagagtatgaggagacttttggaaattttacaaatattcattattatgatgatagtttcacgcatgaaaacatatcaaaattaatcaagttgtacactttaaatatgtgcagttctttgtatatcatttatacctccataaaaatacaaaagttgttattatttgttgaatctgtgtttccatttctgtttctgtttttgtctgttgcccaggctgaagtgcagtggcatgatcgaggctcactgcagcctcaaactcccaggctcaggtgatcctcccacctcagcctcctgagtagttgtgactaaaggtatacgccaccacatccagctaatttttgtattttttatagagacgaggtttcgctatgttgcccaggcaggtctcaaactccttgactcaagcaattcaccctcctaggcctctcaaagtgctaggattacaggcatgagccaccacacctggcctgttttccacttcttactaaccaccctcctcctttgtgaccaacacattattttttatttctgttaattggacagttatcttttaagtatatttaaataaaaattagaaattcatttaccatttctggtgtacttcttttcttcatgtagattcagatttccaactggcattatttccttctgcctgaaaaactttcttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcccggacggggcggctggctgggcaggggggctgaccccccccacctccctcccggacggggcggctggccgggcggggggctgaccccccaacctccctcccggacggggcggctgacccccccacctccctcccggacggggcggctggccgggcagaggggctcctcacttcccagtaggggcggccgggcagaggcgcccctcacctcccggacggggcggctggccgggcggggggccgaccccccccacctccctcccggacggggcggctggccgggcggggggccgacccccccacctccctcccggacggggcggctggccgggcagaggggctcctcacttcccagtaggggcggccgggcagaggcgcccctcacctcccggacggggtggctggccgggcaggggggccgacccccccctcaacctccctcccggacagggcagctggccgggcggggggctgacccccccacctccctcccggacggggcggctggccgggcagaggggctcctcacttcccagtaggggcggctgggcagaggcgcccctcacctcccagatggggcggctggccgggcggagggctgacccccccacctccctcccggacggggcggctggccaggtggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccaggcggggggctgacccccccacctccctcccggatggcacggctggccgggcgggggggctgacccccccacctccctcccggatggggcggctggccgggcggggggctgacccccccccacctccctcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtcttggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagcgcgccaaccaccagccgcggccaccatggccagacgggctccctcgaaaaactttctttaacatttcttcattcttctagtgatgaactatttcagcttttgtatgcctgaagaaatctttatttcatcttcatatttgaaaaatattttcactaggtttagaattttatgatggcagatgtttttgtctttcagtactataaaaatgttgttccactttcttcttgcctgtattgtttctgatgacaaatttgttgtcaaccttatgtttgttccgctacatgaatgtgcctttttctgctgtctgcttttaaaagtttcttttatggctgggcatggtggctcatgcctgtaatcccagcactttgggaggccgaggtgggtggatcacctgaggttgggagtttgagaccagcctgaccaacatggagaaaccttgtctctactaaaaatacaaaattagctgggcgtggtggcgtgtgcctgtaatcccaggtacttgggaggctgaggcaggagaatcgcttgaaccccggaggtagaggttgcggtgagccaagatgatcacaccattgcactccagcctgggcaacaagagtgagactctgtctcaaaaaaaaaaaaaaagtttcttttattactgactttaaacacttcgattatgatatcccttggtgtcattttcttcacgtttcttctatttagggtccatttagctccatagatctgtgcatatatcgctttcatcaaaagttttcagcaattatttcttcatattgtttttatgttcccccccttccttcgagtattcaataacatgtgtattaggctgtgtgatgttgtcccacagctcacagatgtactgtttagttttttaattcttttttccctctgtgtttcattttggatagcttctattactatgccttcgacttcactaatctttttatttacaatgtctaatttgtcactaatcccacccaatgtatttttcaggtcagatacagttttatcgctaaaagttgaatttgagtctatttttctatattccatgtatctactaagctttctgaatgtatggaatatagttataatacatgctttaatgtccttgtctgagtattctaacatctgtgtcagttccaggttggtttcagttgattgatttgtctcattatgggctatattttcctgcttcttggcatgcctagtaattttttactggatgaaagacatcatgaatcttatcatgttgcatcctagatattgttgtattcctgtaaatattcccgagctttgttcagggacctagttaatttagttgaaaacagtttaatccattattacttttaaaatgtgttttgtgggaccagagtcatgtctagtctggggctagttattctccactacataggtaagacacttctgaatactctaccccatgccccctgaattatgaagttttctagtctggctagttgaaacaggcactatttcttgtcctgtgtgagcactaggtattttttccctttaattctttgggtggttctttccctagcctcaagtagttttctcacttacatgcattcttcattattctgctgaatatttgagggggaccctctgcagatttctgtggttttctgtgtagctttctcttctccgttagtctgtcctgcaaattatggttaccttggtgtatctgtacttagcgccatttcctcaactcagggagtctgccaggctctgtttagttttctccttcctgtatagtggcctgcaaactcttacaacagtaagctgggacagtcataggactcatcctatttgctgccctttctcagaaatcactgtccttcattgtgtagtgttcattgtattgaaaaccattatgttataaatagttttttagttgttgcaggtgggaaggtaaatctggaacctgtgacttcatattcaccagaagcacaaacctaacatagataattttatgcaagcagacattatttgttgactgatggctttgcttctgacaccacaggcctgctgtggttcagtgcggaagttagggttctttggcctctccattatatccaatgattataacagtagaattattgatatttctgtattctcatactctaacctttgctgcacaaactagaatggagctggattgggggacagataaggccagtcatgggttaaacatggcttaccttcctgaaacttcactttaactcagagatttggcatgaaaagtaattaaaggtagatacagagatacagatgtgtgtgggagggtgtgtgtttgtgtgtatgcacatacacatttgcacatgtctgtttccaagttccatttaatgagagggcctagaagcaatgacacctcagtgacaatgagtgtacccagtgcccaggtcttggattctgactctcattttctgatcaagtaaaccaggacttcttatgaaagtggttgattccagggctatggcggggaaaatatgagataagattggagcatcttacagtgccaaaaagtgaagaaacgttcaaaaagggagtgttttattttgttatgttttgttttgagacagggcctctctttgtcacccacactaggattcagtggcgcaatcatggcttacttcagcttcaacctcctggactcaagctatcttgccacttcatcctccctagtagttggaactatagaagcaccatcatgcctgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaacaaaaaaatagtaacagtggaattgagaaacccagcagacatcacgttaaccaagtgatgagggttaatatcaccagtaataagacgtatcagcattgtatatccctgctatgatgcactgagaaggacacagcataatgtctgtaatacatattcttgcctaaaatgcataatctcagtctagtctaatgagaaaacattaagcaaacccaaattgaggaaaatctactaaatacctgatcactaatcttcaaagagtgtcaaggtcacaaaagacaagacttgaggaactgtcactgattagaagagacttaaagaaacatgacaaatgcagcatgaaattctggattggatcctggaatgtaaaaaggccattggtggaaaaagtggtaaaatccaaataaagtccatagtttggttaatagtattgtgccaattttaatttcttagctttaactattacactgtggttatgttagacgttaacatcaggggaagctaagtgaaaggcatatgggaactccttgtagtgtttttgcaacttttgtataagtctaaagttattccaaaataaaaagtttttaaaagtaattttaaaggctatatgattcaggggatttatagagctctggctaagagggtaggctttggagtgagattccttggattctaatcctggctctgtcacttattaactgtgtgactttgagtgagtcacttaacttctctttgcatcatcagtttcatcatctataaaatgtaaggattaagaaagataatgtaaaatgcgtaaattagtgcatggtacgttgtcagtaccaatagagagtaaaattagaatgaatgtttacaataaaatattgggctgctatttaggctccatcttgcagatctactgggtatttgctttaatgaaaaattttgagaaacacctctccagatagacagagttatagttcttagccctcctgattaactgttgaggagtcttccaatggcttggaggccccagtagaatttaaagctattggcaaagtagctgcaggggccaccccacacattagcatctccttaataagcattgtgggtatatatatatatatatggcaaattagttactcctagtgtcttttattcaagggtaaacacttcctgcatctaggaagtatttagtagttatgacttgctaattgtatattggttattttatgccaggacttcgggatatgggaacgtggagacaagaccaaccaagggatctcagagttgaatgccagttcagttggaatggcaaaggtaattttcctttcctgtttgtactaagtatgggatgaggaagtctggtatccctttgtcacagataaaacttaatgtgactgtggaccataatcaaattaattattattttaaaccacaggcaacattcagattctcctgtagaaccatggatatgtagatgaaaactttcataagctgcagatttgatatccaactgcttttgtggcatgtctctacttatattatatgccataaggacttgaaaggacttaaactaaacttatcatctctaccattacaaaaacaagcaaaagaaggcttttattcctttcgtttaccagttgaccaagctttatatcaaggaatcatctttcaatcctctatcctctttattttcctccatcccccaaatcatcatcatcatcatcatcattagcagcagcagcattactattcaacttggctctactttttcatcctacccactattgtcttctctggaaacagcaagaagacatacaataagatagcaggaataagatcaaacatatccattatgagaaatatgcatgatttagtctgtcctactaatatgcaaagatatagattgattttaaaaaataaaaggaaatccaatatatgctgtctataagagctctaatataacaaaatgatacagaaaggttaaaaacagaaggatgagcaaaatacagtctgacaagcataaaatgagctagggtgactgtgaatgtcaagtgaagtagaattcaaagtaaaaaatattgcatggaacagagaggacaaagggagtcacaatagaattttattccatttttttattttatttatttttattttatttatttatttatttatttattattattattattattttttgagacggagtctcaccctgctgcccaggctggagtgcagtggcacgatcttggctcactgcaacctccacctcctgggttcaagagattctcctgcttcagcctcccgagtagctgggactacaggcatctgccaccatgcccagctaatttttttttttttttttagtagagacagggttttgccatgttgacgaggctggtctcgaactcctgacctcaggtgatccatctgccttggcctcccaaagtgctgggattacaggcatgagccactgcacccagcctaacaatctcatagtgcactgaacaacataaccaaacatccttctatgtcatttcacacagacaaatttagttcattcttttcagctgctatacagtatttaataattgctccattgacagaattgtctttattttttaacattctagataatgctttagtgaagatccttgtacatacatccaggtaaatttacacaaatatttttataggaaaaattcctcaaagtggaacccttaggttaagggatgtatacttttaaattgcccttcagatatgaacagacacttctcaaaagaagacatttatgcatccaaaagacacatgaaaaaatgctcatcatcactggccatcagagaaatgcaaatcaaaaccatagtgagataccatctcacaccagttagaatggcgatcattaaaaagtcaggaaacaacaggtgctggagaggatgtggacaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccacatgtccaacaatgatagactggcttaagaaaatgtggcacatatacaccatggaatactatgcagccataaaaaatgatgagttcatgtcctttgtggggacatggatgaagctggaaaccatcattctcagcaaactatcccaaggacaaaaatccaaacaccacatgctctcactcataggtgggaattgaacaatgagaacacatggacacaggaagggggaacatcacacaccggggcctgttgtggggtggggggaggggggagggatagcattaggagatatacctaatgttaaatgacgagttaatgtgtgcagcacaccaatatggcacatgtatacatatgtaacaaacctgcacgttgtgtacatgtaccctaaaacttaaagtataataaaaaaaaatttcaaatgaaaaaaaaaataaattgcccttcaaaaatatttccactagtttacatttcccatcctcatatgatagatatacgtcattatgtaccatagatgtcatttttcttttcttttttttttaatcatatgctgtttctttcagtgaatgaaagtgtttgacagagaaatacctttggaaacaaatattgagaacatgttattacaacttgtttctttttgcactggtacttattattacaaatttacatatagagcttttttgccacttttctcaaactctcactacctggatattatcaatatttttgtatatttgatttaaagttttttaccatttaaacttttttactttttattttgtaatcatttgtgacttagaggaaagttataataattgtacaaagaattcctatatagtacccttcactcaagttccctacttgttaatatttgctttatctttttctctgattaaacaaaacaaacacacaaacacacaattgtttttttctgaaccagtagagagtacattgcagacatgatgccccattactcctaaatatttcagtgtgaatttcctcaaggactcttttataaccatgatacaagcatcaaaatcaggaaatgaacactggcattatactgccacctaattgatatagcccattcaaatttatttagttgtcccaataatgtgatttatagcaaaaaaaaaaaatccttttgatccaggatccagtctaagataacatattacatttaattgtaatgtctctttaggcttcttccgtctgaaacagtgcctcagtccttacttgtctttcatgaccttagcatttttgaagagcataggccagttattttacagaatgttcctcgatttgattttgtgtgatatttcctcacgatataggttcaggttatgtgtttttggcaagaataccacagaggtgatgctgtgtccttagtttatcatcaggaagcacatgatgtgaatttgtcccattactgttgatgttatcttttatgacttcattaaggtggtatctgccaggtttctccactgtaaattttctattttccctttgtaattgctatgacttgaatgtttgtggtcccccctcaccaaaattcgtattgaaacttaattaccaatgtagcagtattgagaggtggagcctttaagccgtgactggatcataagggttcttccatcatgaatgcattaatcaattcatggattaatggattagtgagttatcatgggaatgggactggtggctttataagaaaaggaagagacacttgagctagcacactcaggccccctcatcatctgataccccattccaccttgggactctgcagagtttctacccgccagaagccctcaccagatggggccccttgacattggactttatcagcatgatgaacgggagccaggtgctattcctcaagacaatggaggaaagaccccaaggcatttcagagatcttagatgctgccttttccatcacaggtccaaaggcctaggagggcagaatagtttcaggggacaggcctggggtgttctttatgggctgtgcccaggactgccttggaactgtactcccggcacccctgcttcagtgttcactcagctcatgccactactccaaaaggtccaagtgataaaccttgaaggtatccatgtggtgttaattctgcaggcccacagaatgcaagagctgcagaagcatgacagtttccacctggatctcaaaggatatataaaacagcttctgttctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccatcggtctatatctctgttttggtaccagtaccatgctgttttggttactgtagccttgtagtatagtttgaagtcaggtagcgtgatgcctccagctttgttcttttggcttaggattgacttggcgacgcgggctcttttttggttccgtatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttctatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtcagagagggcatccctgtcttgttccagttttcaaagggaatgcttcctgtttttgcccattcagtatgatactggctgtgggtttgtcatagatagctcttattattttgagatacgtcccatcgatacctaatttattgagagtttttagcatgaagcgttgttgaattttgtcaaaggccctttctgcatctattgagataatcatgcggtttttgtctttggttctgtttatatgctggattgcgtttattgatttgcgtatattgaaccagccttgcatcccagggatgaagcccacttgatcatggtggataagctttttgatgtgctgctggatttggtttaccagtattttattgaggatttttgcatcgatgttcatcagggatattggtctaaaattctcttttttggttgtgtctctgccaggctttggtatcaggatgattctggcctcataaaatgagttagggaggattccctctttttctattggttggaatagtttcagaaggaatggtaccagctcctctttgtacctctggtagaattctgctgtggatccatctggtcctggactttttttggttggtaagctatccttcacgtctaaaacaccaaaagcaatggcaacaaaagccaaaattgacaaatgggatctaattaaactaaagagcttctgtacagcaaaagaaactaccatcagagtgaacaggcaacctatagaatgggagaaaatttttgcaacctactcatctgacaaagggctaatatccagaatctacaatgaactcaaagaaatttacaagaaaaaaacaaccccatcaaaaagtgggcaaaggatatgaacagacacttctcaaaagaagacatttatgccaccaaaaaacatgaaaaaatgctcatcatcactggccatcagagaaatgcaaatcaaaaccacaacgagataccatctcacgccagttagaacggtgatcattaaaaagttaggaaacaacaggagctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacgtgcacccgtatgtttatagccgcactattcacaatagcaaagacttggaaccaacccacatgtccaacaatgatagtctggattaagaaaatgtggcacatatacaccatggaatactatgcagccataaaaaatgatgagttcatgtcctttgtagggacatggatgaaactggaaaccatcattctcagcaaactatcacagagacaaaaaaccaaacaccgcatattctcactcataggtgggaattgaacaatgagaacacatggacacaggaaggggaacatcatacaccggggcctgttgtggggtggggggaggggggagggatagcattaggagatatacctaatgctaaatgacaagttactgggtgcagcacaccaacatggcacatgtatacatatgtaactaacctgcatgttgtgcacatgtaccctaaaacttaaagtataatagtaataaaattaaaaacaacaacaacaacaacaacaaaaaaaaagaaaaacagcttctgggcccaggcagagacttgtcacaggggtggaaccacaacagagagcccccgctagagcaacactgaagcagaaacatggggttgcagcttccacagagagttcccactagggcaggaccaccactgggatgccagaactgtggagtcactggcagcatgcaaggtctgcctgagaaagcttcagataccagactgcaacccatagaagcagccacctgtgctgtacccatcaaagccacaggggcagggctgcctgaggccttagagacccaatcccaacctgcgcgcagagtcaaaagggattattcttcagctttcacatttaatgtctgctatgctgggtttaagacttgctttaagcctgttactgctttctttttgcctgtttctctcttttagaatgggaatatctctgtctgtcttatgcctgtaccaccattgtatcttgaaagttgataacttgttttgatttcagactcacggatgagattttggacttttgagtcttatccttggtgctggaatgaattaagactttgaggctatggggttagaatgaatgtatttatatgtgagaaggacatgagtttggtgagggtaaggagtagaatagtaaggcagtaattaatgagtattttgtgcctggccaacttctacttaccctataggtctcagtttaggtgtcatttcttcagggaagactttcaaaactggcttctacccccaagactaggtcaagtctgccctttaattgaggaattacagataactaataaatactagaaataatattcaatcttgttaacaatttaatgcatatgaatgcaacagatataccattttttaatcacattaggaaaaaatgtttaagataatacattgtttgcattaaggaaggtattgtcatatactgctagtgatagctatgttggtacaacttgcaagaaaagcaatttagcattatgtcttaaaaattattcatactcttttacccaatgattctacttcagggaattgatgcttacaaaataactcaaaatgaatacaaagagttattttattagcttgacagtcattattgagagcctaccgtatgccatggtttgtgctagatattagtgaagacataatccccgacctcaaggaatttataatttagcaagagatgtttatcaaagttctatttctaatagcacaaaattaaaggcgacctaaatttccaagaattggtaaatggctaaatatactttattatagccatatgagataatagtatgtcaaaatagtgtttgtaatgtggaaaaatacttacactatattattaattgtaaaaagtaggataccagatgtgatctcaactgtacacaaatagacatagaaaaaactaataaaaaacatgtcaaaaatgttaaaagtggttgttttgggtgattttcttgccctctctgtactttactgtgttttcaaagtattctataaggagtgtgttttacttttatgatcaaaaatatatttagaaaagtaagaaataaataaataaattctattttaaaaaacataatatctcatttatatgtggaatctaaagaagttgaactcatagaaggagagagtacaatgatggttaagtatgatacttgatagtgctacagactcctttttaactttctctgagacaatatgggagacaaagaaaaactcagaatgccctgggaataaataatgtttttgtattatatattctgtcagacatattcaaaagtgacatcatgtgtgttgataagatactgggatatagggagaagaaatatatatctttctaatgctaaacttgtccatttctttcttgttcctcacaggcagccctggaagcattagatgaactggatctgtttggtgtgaaaggtgggcctcaatcagttatccatgtcctggctgatgaagtacagcactgccaggtaaaatattatggaaaatggaaatagcaaattttattcttgcccagactcagatttaagcatgagctttagattaaggatagctgaatgagagacagtgcatcatctgattaattaccatgtaccaaaaatatatttaacaagcatactatactgagataagccaaatatagcatgggctataaaatagatcatagtcctgttctctagccaaaggttataaagggatcccaccatactatgtggaattatccaccactatcatatcaaagggatatggtctctctttctgagtatctccttttctaaatatataaagaaaaccagagatgatggatttgtagtattcttgttagtgtttctgaaacattctcttgttcctggttggctctaggcttagatatttggagattagactttaagtggcaaatatgtattttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctatgttcatcagggatattggcccatgggttttttgttgttcttgtgtcctcgtcagttttggtttcagggtactgctggccttgtagtgagtttggaagaattccctccccttcaatttactggagtagtttggttttagctctttaaaagtttggtagaactcagcaataaagccatccattcctggacttttcttcatcggagtacattttattactgattcagtcccattactcgttatttgtcttttcaggttttctatttcttcttggttcaatcttggtaggttgtatgtgtccagaaatgtatctgttttctctagagtttccaatttcttggcatatactttttgataatagtctctaataatcctttgtatttctgtggtatcggttataatgtctcttttttatttcttattttatttacttgggtcttttattcttagtctggctaatggtttgccaattttgtttatttaaaaaacttttcattttgttgatcttttgtattttttggccttaatttcacttatttcttgtttggtctttgttatttctttccttctattaattttgggttctgtttgttcttttctaattccttgaggttcatcattaggttgtttatttcaaatctttctactattttgatgtaggcatttattgccataaacttccttcttagtactgcttttgctgtatcccacaggttttgggatgttatgtttccattttcgtttattttaagaaattttaaaatttctttcttaatttcttcattgactcgttggtcattgaggagcatgttgtttaatttctgtgtatttgtacagtttcaaaagtttctcttgttattgatttctagttttcattgcagtcagaaaagataattgataatgatttcaattttttaaagtttgttgagacatgttttatcacctaacatatgatcaatcctggagaatgttccatgtgctaatgtattttctgtacctgttggatgaaatgccctgtaaatgtctgttaggtccatttggtctataatgtagtttaaatctggtatttctttgttgattttctgtataaatgatctatctaatgctaagagtagaatgttgaagtctcccactattattgtactggagtctaactctccttttagatctaataatatttggtttatatatctgaatgctgcaatgttaggtgcatatatatttacaattattataacctcttgctgaattgatgcttttattattatataatgaccttctttgtctctttttactttcaacttaaagcctattttatctgatataagtatagctactcctgcttgcttttggtttgtatttgcatggaacatctttttccattccttccagtttagtctatgtgtgtctttacaggtgaagtgactttcttgtaggtatcatgtgagtcttgttatccattcagccaatctacatctaaattgagaaatttaatctatttacattcaaggttattattgataaatgaggactttctcctgttattttgttaattgttttctggttgttttgtatatcctttgttcctttcttcctctcttattgtttatctttacagtttggtggttttctgtagtgataaggcttgattcctttctctttctctttctctttctctttctcctttctgtatgtgccctttctgtatgtgctcctttctgtatgtactagtgagttttatacttttgcatgttttcatgatgatagttatcatatgttcacttccagttgtagaactcccttaggcatttcttgtaaggctggtctaattctgggtatagtgttcttgcctgacaggtttttttttttttttttcagctcttagaatatatcatctcattctcttccagcctgtgagattactattgagaaatctgttgctagtctaatgaagattcccttatatgtaactttatgcttttctcttgctgtttttaaaattttctctttgtctttgacttttgacattttgactataatgcacctttgagagaacattttttggtttgaatctatttgggaactttgagtttcctggatctggatatccatatttttcccaagaattgggaatttttcagctattatttcatcagataggttttctgcacattttcccatctcttgtctttctaaaacttccataatgtgattatttgtttgctttatggtgttctgcaagtcctataggcttgtttcattcttttttattcgttttttttttgtatgcctggtttatttcaaaagatctgcctccaagttcagaaattcttctgcttgatctcatctgttgaagctcttgattgtgttttttatttcattaattgaattcttctgcgttaaagtttgttttttaaataatatctgttgaatttctcatcagatcatgaattgttttcctgattttattatctatctttattcttttatatcttgctgggtttccttaagatcataattttgagtttcttttataacatttcataaatttccttttctttgaggtctgttactagataattattacgtccctttggatgtgtcatgtttccttgccttttcatgtttcttgtgtccctgaattgatatatgcacatctggtggagcaggtacctcttccaatttatggagcagctttgatagggaaagactttcctggagatgggtcctaaggtgttggtttaggtaggatacactggctttggttctaggtggacacagttattatagtctctgtgcagtttcttgagctgtaatccacataatagatgtttgtgagtacctcaatggcctaggctgcaggagttgtgagtgtggtgggtagctttgctaggggtgggctcctgaacagactgatttccgggcctggggtgtagacatgcatgaggagaagggctgccagactgtttttctagccaaggtcataggcacatggcaggtcagctggttcagagactggtttgccaaccaggggcagggctgctgggctatttctgtgcctgggggcgtgggacttgggaactggcttgccaggggtggagccactgggctgtttctctgcccagggacatgggtccatcaggctgtttctccgtcaggctggtccagggttggctttctactatgcaggaccagagtcatggccattcctggggccaggcttcgagcagctgaggtcatggcactgcagccacctgtgtggggttggtgaaatgatggcaaagagtcaaggttggagaggtacaatggctactggcccccagagtaggggggccaactactgcactcctgcagtagctccagtttcaagatggcactgtactgcagcagctttggtcatgagaaataggaagtgcacaacatgtacttgtactctggagtaatatagttgtgtgaattctaggcagctccccaaactgggctcagcacttgggaggactgtaggattctcctatagtaaggactgcaggtgtctgggctggcaatgagggacggtgggagccttttgcttaccttttccctgcaaggggaagtccctcctgtctctgagccaatcccaataggggagatggggcagcagagccagggtgcctcgctctcctctctatgctgccatcctgggcttttctacttcacagggttcttgctgccagtcacttgctacaccacagtgctctccctcagacactccacttgaattttagttgtttattagttgttttggtccttttttgtggggaagacaagcaccaggcacctctagtcagccatcgtgctctatgttgattctttttttttttttttttttgtcagtacattccaaacatgtgtaaccaatgaacatggcctagggttttttttttgtttttttttaattggtattcacttcagtaacttcaatccacagatacaagcagtatataaccagaaagttacaagtaaacacagattatacatgcacatttctgttcacaaaggtcacatgtgcaggtacatgaattagaagcgtgcatctaggattatggccaaactgtttttaagatgcagaaatataaaattacatcttgaaaatatgaagaggtggtctacacacttcaaaaatcaaatgttgcttacaccagagatgtatgacgattacaggattcaagtgacaagcaataagatctcaaaaattagtactggtcaaagagaatgggaatatttttacgtttcactgaaaatattgactactagaatataaaatctagcaggaactcagggaaaaaaatacaaaacctaaagccaattacttaatatttcttattacctaaacaacagcatgacatttacagaaaactgcacctgcatttgaattgccaatctcattttaatgaagttctccaaaaatgaaatgcaaccaaaaaagggtcaaactccaaatgaaaagtttgcaaggctcagattaaaacatggaatgtttcagatgaaagtaataaaaatactattggttttgttctttattaaatggaatcaaatactgacatttctttgaagcttggaactgctaaatttcattttcccaaatggttctgcatttttttcttagtggtgcaagttgtcttaagtagcttacgaagtcaatctctacaaattacttctataaaacaactattcattaatcgtatgtatttttttgctataacacttaacacatgaacagacattatttctccaccaaaacaaaagagtacaatagttttcttctgtcagtattgtatttaaaaaagtttaacattaaacacaaagaaccattattttctttgaaacccttaaatcttcttgcacatcttaagttgccttcttctgtctgcattcttctgccaatttattcagaaatttatttaatttctcataatgaggaaggctgctgcaatgagtattctttgcaacttcttttgtataaaagagtgaacatagcttaccataaagccctgttttaggtattacatagtctataccaacaggaacattgggctgttatggtccaattctatactcatctgggattgtatagtcctccttgttctcatcactttggccatctgcattttcacttatgttgattcttagatgcattttactaagtgaaaaaaagccaaacctcaaagactacatactacatgattccatttacatgacactctggaaaaggcaaaactatagggaggaaaacagatcagtagttgccagaagttgggaggacagattgtctataaagatacagcactagagaattttgagggtgatggaatggttctctatggacttatgctggtggacacatgactatatgtttgtcaaaagctaaggaattgtatgccacaagaagtaaatttaaagaatcaaccagggtgtgtcaagaaagatggaattcagactgaaaaatgagtctaattacattacaaatgaatcaagtaaccacactaaaaggtatggaaaagaaaggagctgacctaagtcttggaaaacagtgttttgactagatactgcaagcctaacctaaagacaaaaataactgtatacacacactgtactctagttcaggggttagcaaattacagcctgtgggctggccatctgttgttataaatagagttttattggaacacaaccatggtgtatttacatattgtccatggctgctttcaaggtacaacagcagatctgagtaattgcaacagatgctgtatggtctgcacaatctaaaatattcactacctggtcctctatgaaaaagtttgccaacccctgctctagttgataaatttgtttctcaaaggggtactggttggcaattctgaaactactttatctgtacagtaaggttgaccaaataagtaaatatgtagtagatatagtgggtaatgagacctaggtttctcactgttacacatagggaatgggaaaagcctagaatgaaccttgtgatgttggattggagaaggtagtatcagtatgaagtgtgtatgtgtgtgtgtctgtgtgtctgtgtgtgtttaatatagggatgtgtgtcttcctatatgtgtttcctaactttgtccactgagagggcccagaggcaatgagtacacctagtgtccaaatgttggtttctaaatgtcattctcaatgaaaggacttagggctccttggagaagtggttgatttgactggggcagggaggatacaaggggagcctggagtttcatatggttctagaaaataaagaggtactcagaaaagtatggaacatgtcaaaggaacacaggaaccatctgaaaagtgcttctaatggccaaagcagaaaaaatttgaacaataaaataactatcatagtattggattataacccagagaataaatgaaatgtccataagtccatactgatataaataaataactgaaaaatgaataaataggaaagaagacagatctccctaataggagaatgtcaattaataaatgctaaaggaataaaggaaatacaaaattgccattagacaaacacaagaataacaattatttcaggagaaatctactgatggatgctaaaaccagtagacaaaagcttaagcataacgaaggtgttcgaatagtctcacagtatctcccccaaaatatttaatagttacaaatggaaaattacagtggagaaattcagcagacaccactttaaccaagtgatcagggttaacatcaccagtaataggacacattgacatcatgtactctctcatacaatgcactgagaagggcacatcacttctgtggtatccttcccaatatgcataaccgtactctgatcatgagaaaacatcaaacaaaaccaaatcgaggggcattctacaaaataactgatgaacactcttcagaagtgtcaaggtcattaaaaacaaggaaggactgaggaactgtcatagattggaggacactaaggagacatgatgactgaatgcaatatgggatcctgaattgggtcctagaacagaaaaaaggacaactgatgaaatccaaataagttatgggctttggttaatagtatcgtaccaaagttttttttttttttttttttgaaacaaagtctcactttgtcacccaggctggagtgcagtggcaggatctcggctcactgcaacctgtgtctcccaggttcaagcgattctcccacctcagcctcttgaataactgggactacggtcacgtgccaccacgcctggctaatttttgtatttttttgtaaagacaaggtttcaccacattggccaggctggtctcgaactcctgacctcaggtgcctcccgcctcagcctcccaaagtgctggggttacaggcatgagccactacacccagccaccaaggttaattttttagttttggcagatttctatggttatataagatgtgactataacggaatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaaattcagtatcattaaagggattgaacagtcaatatgaagcactttcactggtaatggaaacattgtttaaagcttagatttgatgtttgagagacattatggatttttttaaatcatcgagctcaaactcttctggtctacttcctcttccactttattttttagccttgaatttgacttcttcccctatcagtgtactaaaattatatgttctgaaacatcatcataagctcttaaatgaccaatccaatagccttttctgaatccttattctccttgacttctctatggtacctcactttttacctagccctaaattctcttgaaattcttttcctattttaattttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctctatacataatgaaaatagtttttccccattcattaaagaatatattcctaaaagtatttgaatttcacagataaagacatattgtaaatgcaacgtacagtcagttctgctataatgatacgtatgcaatctttttttgttgtcatttttaagacagggtctctcactctgttgcccagactgtagtgcagtggcgtgatcatggctcactgcagcttcgatctcctgggctcaagcagtcctcccacctcagccccctgagtcactgggactataggcatatgccaccacattcagctatttttgtttgtttgttttttgtagagacgggcctcgctgtgttgcccaggctggtctcaaactcctgggctcaagctatccctcctgcctcagcctctcaaagtgctgggattacaggcatgagccaccacacccaggccatatgcattctttaaaaatcaccatgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaatcaccatgctatgcatatttaagaaataaaaactacagggcttatgagaaaatggggtaaggagtgcagcacataaaatgtaacacatacaaaatgataggaacctaataaaaataatagtatcatggctttatacatggtaaatagttaagaaatacataaataccacaatagttaccgtactttcaccttaaaaaagacccaaagtttgcttgtgcaagtgtgtacccaagttctcaccagctcacccacctggctctcatgcccactacataatgtgcaagaggaagagaacaaaagagggattaaaaagagtgagagaaaacagagaaaaagagcataaaacagagaggaaaatttttttaaaaggctgagaggaaagaggtagaaaactgaagagagggcaaggcatgtggttgcatatccagggtggccatcagaggattgcagcttgtaagttcagtagtggtgaaaggagtgttatctgaaattggacagaaagtagtaaaaacagatgtgaataggtacagttcatcattctcctgagatatatgcatgtgtgttttgtgtattcttacatggcccagttcagctgagtacattctcagtatgaaattgtgcataaccaaacatgaaattcatgttatactcaaatttttccctaatatatcagaagcattggaacaaatttgtttacaaagaaagtgttatagcagaactatttttttttttcatcataaattacagttttgggttttgtttttttttttacattttatatattgctaagctttagcaaatggttaagcacagaacataaacttgaccataatagaacctaatttggcaggtagaaatgcagttttaagacaatacatcctcaaatctagaagctatacttaagatatacatagtggaacaagacaggcctttggaagcagactgccatggctacaccctggactcaactgtgtacttgctctgatcttccacaaatttacaacctctttgagataatttccctgtaaaaaggccttaattacacatagctcctaggatagtttttaaagttaaatgcattaaagtatgcaaaactcctagcataatatttggcctataacaagcatttagtaaataccctttcctttctattttactgggtgaataagctcctttgcaataggaccttctttggctgcaaccttctcctgggtccccaaagggactctctgtaagtctttttttcctgcctttcttttatctgcaggttcaagaatataaagaggctcttgaagcagtcctcatcaagggcaaaaatggagtcccacttctgccagagctgtacagtgttcctcctgacagggtgagtcagacagtgccataacatgtagctgatagagaagaggagcagtaccttgatcagactacctcatttgagtcaaataatttttaatcttattttgttgttctgaaagcttgtctttaggtacaggacaacataagtatgattttatttcttcaaaaataaaattttaaagcagtctcaatgatggtactgttgcacagtcagacaaggacaagaccaaaccttaatcttgagaatgatgtagagatcactaggaaaaactaggatgatgttctgtgtggactctcaagatttggtattctctatttttaggccagtaatcccggattgttttaatagatcagtcttggaaaatgaatatgtcttgttttcagactgtcattttcccaaaatgccagtcgggtgtaacattgttcctcttctccactgcaaaagagcattagacatggaagagaatagtcttccattccggtgagaatgagtagaataagctcccagcaacatcagcagcaccacctgagagcttgttagaaatagatttcaggccctacctcatacccactcaatcagaatctgcattttaacaagatcctcaggtgatctgtatgcacatcacagttggggagcactgccctagattatagtgatagtgcttcacttttcagtgcattgcatatgtagctacatagggtataaattacaatccagtccacctttttattatccagtatcttaaaccttctattattcctcatctggcctcttcatcttttcttttaggtcgatgaagaatatcagaatcctcacactgtggaccgagtccccatggggaaattgcctcacatgtggggtcagtctctatacattttaggaagcttgatggcagaggtaagaggaatcttcaaggctgtcccacttttttctgccttaagtcaccataataatcagatttttaagtagctcattaaatctgaaggatgtcttctgccttttgcactttgccttaattatagttttcctccaggtcttcagagtagggagcatggccaaccctcacaaaaagctcttgctgcctggcaaccatgtccctcctgctgcccggggctccctactttggcactgtatttggaactgctcaggccccagatctatccctttcaaaacttccctcagtgccctgcctggtgactaacagatgcatttgtgcttagctagttaattactgataatggattaagtgctaatgcttccaagcaacatgtttcattctttaactaaattaactgatatttttaggtgccatgataagtgactaggaacatcatgactttttttttctttgcttgggtttttatgtttgtttgtattttgttaagggtctctctaaatgttccttatatcagattctgttgagattgcccttaatgaggcatttgggagtttctgactttgtgtccaccttctttgtgacattttgagcctgcacagaggcattctgtttctcagaagtttttcatatcatctggcaagtctacttccccactctatgttattttgataagatataacccaggctcctagaggatcaagagtgggacttaactatcctatctgagtcagactctttgacctgtttatgtataaccactgatttttgcagctgttttgttcattttccttgtgtggctgtggccatggctgtttgattactcttagtcgacattactaaatgagtctagcaaaagtgggcagaatggtttgtttaagtaatccttacctggtgactctctcattcaattaaaataaagtaaaggcattgataaaaagaataccacagtgattggtattctttttttttctttttttaaaatttattttattttattttactttttgagacagagtttcactcttgttgcccaggctggagtgcaatggcacgatctcggctcaccacaacctccgcctcccgggttcaaatgattctcctgccttggcctcccaagtagctaggattacaggcacgcaccaccatgcctggctaattttgtatttttagtagagatggggtttctccatgttggtcaggctggtctcgaaagcccaacctcaggtgatccgccctcctcagcctcccaaagtgctgggattacaggcgtgagccactgcgcccggccagtgatttgtattcttaaggaaaaaataggtgagttcatcccatttcataaagggcagaaactcaagtcaaaagatttctgatgtgcagaaggcatagtagatacatgaacaaatgagaatacagcaggactaatggcttaaattactgataagctgtgtgatctaatcatctaatcatatgtatatccagagaagatagaggaataaccagaaaactttgtttatttataatttatacccagctgggtgcagtggctcatgcttataatcccaccactttgggaggccaaagcgggaggattgcttgagtccaggagaccagcctgggcaacataagtgagaccttgtctccatgaataaactaattagccaggcgtggtggcacacgcctgtggtcctagctacttgggaggctgaggtgggaggatcacttgagcccaggaggttgaagctgcagtgagccatgattgcaccactgcactccagcctgggtgacagagaaagaccctgtctcaaaaaaagaaaacaaattataccctacatatttataccctacctaaaaaagcatttgtggcagccaatagcaattaactctggataaaaggaattgtggtgtgaatttgggaattcaaacattttcatacagtgaaggcatttgtttcctttctacacctgtctcttgaatgttatggtgcaaggttatgggcatagggatgttgttttccctcaagtattagtttctcttttgagacttaataatctgtctttttatggtttttctttagggatttttagcccctggagaaattgatcccctgaatcgcaggttttctactgtaccgaagcccgatgttgtggttcaaggtatgtattcttattcccagtggaagaaactttatattaaaggtctggttatgggcagagatctttaggctagtaaattatgactttattctatatgttgcactttattaggcttcaaaatgtatacaatgaactttgttcggtttggtttcaaaatgctggttatcttaataataaacaaatgaatgatgttctatgtcagatgactccaaaatattatttgacacccttaaccactccttatatctggaaattattttcttttcattgtcataacattttagcctcctggttatctctgctttttctctgaccactccttctgtgctatttctactgtacttctttctttatatatccttctaatggttctgcgcttagtatttttttttttttttgagagggagtctctttctgtcacccaggctggagtgcaatggggcaatctcggctcactgcaacctccacctcctgggttcaagcaattctcttgcttcagcctcctgagtatctgggatcacagtcgcgcaccaccacgcctagctaatttttgtatttttagtagagacggggtttcaccatgttggtcaggctggtctcgaactcctgacctcgtgatctgcctgtctcggcctcccaaagtactgggattacaggcgcgagccactgcgcccggctgcacttagtcttatactcttgtctttctgtatttacactctgtattaggtagctaagcctgcctccttcatagtaaatttgcttccatggccccaactattacctctttggagaatactccaaacttttgtttttattcctaacaatttacttaaatttggggcatctactttctgcagaactctaggctgagttctataaacatgttaagaattctagtcccaatatctataaaacttctgtgccatttacatttcaaacacaaaactgacctcttttgtctccatcccatccttttcctctcctaagaaatgcaaatcgttctaccttccttatttctctcaatgatatcaccattattctagtctcttagggtagaagacttgaggtaagtttttactctctaacatcacaatccaatgtggtgttgtgaaactcctttgagatgtctccaatcacttgactttggggttggttctatatggaaaataatctcgtgtgttttctaaattttcttatacttggcatcccatgtggtcatacaggtagttcttgcttatcaatgtatatagcaaacattatataaaagtcattactcttcccttcccatgagagatcttgttctcctttgaggtttattccacctgtctatgttgatctcctggttgctctaattcattctttgaagactttgaggcctggctacagccttcctcttcctctccaaatcctgccatagaactagattttagcattgacgtcagtgcagtctaacacttcagtctcaaagttctagatatccataactctagtgacctttccttctacctatacttttagccattcactcaaaggaccaaactttaaggctctttcacttcagatacctgaaattccaatattctactctgtgatcatagtcataacattatttcaagtttctttttcttccctttacccttgtttctattttcccctagtttacccttctctacctcatggttgttcatctaaatctcccagtcaccaatgcaccataatttctattagaaccactcgaaaaatcacagccccaggtcagtgttacagtctgcattttctgatcctttacctggcctgctaaaaagctattggggaaaaaaaaagacacaaatgagcagagtggtggcactggaaatcgtggtctccaactcagctaggtttacagtgcctcctgttcatccttgttcttgttagtcagcattttcatacttctcaaccactattccacaccttctctgttttcaatccccacctctttttttcagcctaattcttggcctgctgcttcatgcctgacaatattctgatctttgtcagtgtctcagccctccccacccctacagtcttacctatccttgcctcattttctgcaatctcaggaaaagggtttcttctcctattcaaggacaagtcttccttctgatgtttgatcattatcttcttccccagcattctctagaaacttactctttcctggaatcctcaaactctcccattctgttggttctattttgtttagtctactgacatgttcatctccctctagttacactatatagcttctttctttctcatccaaacttccacttttttatcttccctttattctgcagtattttgtagtctggcttactactatgaaaatgatcttgcttaagttaccagtgacctttgtattgccaaatttggtaggtactttttaatctgtatcttactggagtatttaatctgtatcccatgtcttctatgatgccatactctcttgaatttccttcaacctagattaagcacatttctttctcattctggtcttcctcttcttctttgccccctaactattagtatttatgagaattctgtccttagcccactgctcttgcttatataaatatttctttctgttcctcagcctcctcctattccaaccttttccttcttcccttttccctctttccaccttcttacttcttccctcactctcagaagatgatctcacctcctataccatagatgaaatacaagccatgatgtaagaactcctccacttcacccccagcttttcttcatttgcccatgtcttttatgttggcattttccaaggttatattctaagtccgcttctccttttctctatgtattctccttgacccatctcatctctttctatgctaatgactcctgaatctgtatcagcttcctttaaggtagcctcacttgggtgtctcacttgccctgtaaatttattcaacatgtctaaaattattcagctataccctcctagtactacatcacccatacctgcttttcctcctatatgcctgtgtcattaaatgacacaccatcctcccagttacacaagtaaatacctagggaatcctctctctcatctcctacattcaacagttaacaagttctggctgctttatttcctaaataattctgagatccatccagttttctccagtaccaatatcttgatcctaatggaggtagtcaacatctcttccttgcattactgtagtaactttttttttttttttgagatggagtcactctgtcgcctaggctggagtgcagtggcgcaatctcagctcactgcaacctctgcctcctgggttcaagcaattctcctgcctcagcctccggagtagctgggattacaggcacgcacctccacacctggctaattttttttatttttagtagaaatgaggtttcaccatgttggccaggctggtctcgaactcctgacttcaggtgatccacccacctctgcctcccaaagtgctgtgattacaggtgtaagccacagcgcctggccctgtagtaactttttagctggtctctctgtcttactacagtctatcagtttattctctgtcaatctgaatgtactatttttaaggtacaggtattaatatggtattcctctgattatgcctctacaagggcttcccattggcagtctccttaatatgacttacaagaccctttagatctagccccgaccccatctccagcttcattttttatcactgcccctttatgctacatgttcctgttataaagggctttttataattcctagctctgccttgttttctgttcccttgagcctttgcccatgctatttcttctgtctggaacaatttcttccttacctttaccatatcctgttgcaggttaacttctattcaggcctctaggaggactctatagccgtctcattttttccatgtagggatcatgtccttaacatatggcagtgcctagcacataagaggcactaaataagaattttctaaatattttataaaacaaaaaaatgagttgcttgggttgaaggtactcctggggccccagagtattgttcacttgactgtctttcagtcccctctactcttacaaccaattcccatgaagaatcctaaggctcagtagaaagcagtttggaaagcatggcccaaagatgaaatacaaaatccttcaagtgatgcatatgcccttcacgatgctctaactcctgtctatctttccagatccatttcttttgccactatgcaaggtatattatgctacagcaatattgaagtgtatgtggttcttcccacctccctctatacatgcagccatgctgtttttcatctctgtgcttgataagttcattctggactctcttcctagaagggctatatccttcctaatcccttgtttctcctagctaacttattcattatttcaaactcagtttaggcatcaacactttgcagaagcctttcctgatactactcctcccaaccccacactacctaggtgtcactcctggatggtctcataaagttttgtgcacttatctctatttacctagcaggtcattttacaatccatgtgtatgccacttcggttacactgtgagctccttgagggaaagactaatttatccatttctgtatccctagtgactagcatagcacctcatccattgaggtacttaataaatgtttactaatgaatgaatgaattgccaaatgttttttcctggactgtcctcagccccctatcattcttcctctgcatatttttccctgaagaatctcttttattttcatgttttcagttagaagtaatcaagatggtgttatgtccaggggactctgtgatcaacatatcctgctatcctggcccagacaacagcagcccattagcatgaggttcccaagatagaaaaatacacaaaggataatggcaaaggaaggcaaagtagcactttgttaactaagcctttgcttcaaaaactcaatgtagaaaataatggtaagccaagcagtgcattctttttcctgtgaacaatccatcacatctaccagcactagaggagcaggagtagagggcacatttgccacagttgcttagtgtcaagacagctaaagcctcaattggattactggcccccagccaggtgtctgttccatatagcgaaagtgaaaaaagaatcaggaagctggcctagcctcctctcttgtagttgggcttcctacttcagtgacaggagtataagaggaagaaaagagagctgtccaggcttgtcaggctctgaatctagagaagtttcatcccccatctctccccagcacccgctacctgctgcctaaaaaacacacagtttcaactataataccttctatatgttgatgactcaaattgttatccccaattcaccatgccttctatcattctctagctataggcaactcttgtcattagggtgttctttattacccccacatacctggctctgaccttaggtttactgatacaaaagaactcggggaatcagtttttaccaaagctataccaaatctcatgatggatttttctcccatttaaacatggaatcttagatataaaaagagtgtggtattctctaggagcacataagtatttaggcaaaaagcaaaatctaatgctctagtcttgagatcttttcattttccttttccttttagataatattatttagcatgatacttattttatcaaagttcctcaataactgttcatttcctcccatttcctttttttctctttaaaagaaattatataacttgagagattgttaagttgctattgaaataaaattttctgttgacctcatcttctttgtctcctctagtctccattctagctgaaacagaagaaatcaagaccattttgaaggacaagggaatttacgtggagaccattgctgaggtataccccatcagagtacaaccagctcgtattctcagccacatttattccagcctaggtaaggagattggctagcctgctagaatcaaagcattattcattataggctggtttccatccttttttcttcttcatgattgtgtattgctttattaagctggatctgagaaggaatttagagtctctagaatccaattttcttaccttctctattctgagcaggcctgataattttaggtgtgttttatgaaccctttgggtacataaggcatgactattatcagccaatattgtatctttattccaagtgtgtgcttaaataacatgttctctcctttcttggagcctatacctctttttcaaatacttgcttattttatatggaatgatagccaaggaacttgtttttaggtcttttatactttgtcatttaatgaactagttgataatataaaagattccttaatataatacttatttttaattagtacttatttttttaattaattcacatattaaacttagtgatagattttttgcattaaacaaattactatattgttatctaaaagaaattctaaactactcttgtggaagactgaataatgactccccaaagatatacaagtcctaattcctggaacctataaaccttaacttatatggccaaatggactcatttgagatagggagcttatcctggattacccaggtggtccctaaatgtaatcacaagtgtccttataaaaggaatcagaggaagaccagactataaaagtaggagatgtgacaacagaagcaagagattatagtgataaggctatgagccaaggaatgcccacatcatctagaagctggaagaggcaaggaatagattcttccctggagcctccagaaggaatcaaccctgctgacactttggttttgattttagtcccataatgctcattttggactcatgatgccaagaactgtagaagtataaatctgtgttgttttaagccaccaagtttgtggtaatttgttatagaaccaatagaaaagtaatacaatcttaaaccacaagggagtagatttgtaaaagattggatcttaggtagtggattgccacttacaaacccagaagttagtttgtatatgtgtgtgcgcgcgtgtgtgtgtgtgcgtgtatgtgtgtatgtgtacttttttatcacccaagaatggtatgttagtaattacagttaaggcaagtattcccagcttaaaaccagtctccttcccttttctctggcacgtaactccagtcacttaatttctttgtctaaattgagagggaatcaaccaaggaggaaaggaccaagagtcagagctgacttttgtctgtctctaggaacatatatttaatgccaacaaggcttgaactccttgcattccggagctattaacatggcttctggctttaggagtatatggatttctttcttccatcttagctatgatgtaggaatgtccctttcctaaaaattcaaatataacatgattagaattttctaaagaaactttgctttaaaaagataatgaaaaactaaaatatatacacaaagaaattaacaaatttgttgaatatgtctcagatcctaataaatttctaaaatctagccacaaattagcttgaatattataaaatactcctggttccctctatttactcaaccctaactgaggtaaataccaagtcaaggctcctgaaacttctgaggctgatttgggtggatgctttgctaggtgggttacatacctcaccccttcccagaacctgcttcctgtttttattttttttggccattccctgtcaccccagacctataatgcacttctagtctccagatactagtccactagcactaaatcccttgagataaggaaggtatttccctatttagccaacatcttacccacttgagtactagttgatcttacagtcaccttctttgtaactcttagaagtctctgcagtaatgggtttatgcaagtcctgttggtgattttgacctgattctctctggctctcactcaaaagttaataggttaattttacccattgcctcattgcatctattattctaaatcggcatatcttactgggaaacaggtaacttctaagctctgggccatcatttatggaatctgcctgcctcacatcaggtctctccaacaaatagaagcaatctccttactatttactttttcaaaacctagactccatcttgggcctcttactaagttcttattttctagccaaaggaaataaaaacttaatgatgatcaaacattccaaggactcaagtgacaagtggacatttatcttcctgatacgttctttcatttgcttcattcattcattgataagcatttattgctcacttattatgtaccaggcactgggctagatgctatggaagacatagccatgcaactaaataatcacagtacaatcttataaatgctatgaccacggtgttacatataaaacacagaagaaaggggatagatttgcctggggaagtcaggaaaagcgtgatagatgaggcaacatctgatgacttatcagtcagatgagtgactattcaaaattctattattgcaacagtttcacaataaaaaaattgccctaagggtacgtcaaatgacaaccataattccatgaaggaaaaagggctatttctttaacaggtgtatttgtttatatatgttaactaaacggagttctctttctcccctcaaatgctcagtatttcattgtcagttccaaaacattttttttatttttttaaattatgagattaatcaactttgtgaaagtaagaacttaaaatattaagttcaaatctttatgtaatgctaattcttttctaatcttagtgcatatagatacattttaatagttatctttaacatgcctatattcacttgtgttctgtttgttttcacttattctctcgtgatgcatttccacatattgaaatagctatatagtatttcatcaaatcaaagtaattgtttcctgattattagctgaatattttcaagaatttttatccttctataaatgcctttgtatagaccactgttttcttaattgtatattctcagtaaagggattctggataagcttgtgaacagctttttagctcttgttacatgttgccagatgattatttacaaagacgaactaattcatagtgacataactaagatataaaatatacctttcttttttactaccccactaacattggagttttatttatttttgttagataagtaggttttagtatgtataaattattttaattttctatctttaattcccagggacctgtacgtttttctatttttgctttacctctttttttgaaactatgtgtctacaattgcttgcttatctaatagggtctgcacatttctgtatatatttatcaattatttatattttatggtaagcttttatcagtgagacttatatatatttcctagtctgttactttcttttagataattattttcttgcctgtgtacaaatctttaaatattagatacatccattttatcagatatatttttcagtccttcaagaattatgaatttatctcctaattctatctgaataggtatgctattctggttctctccaaatttcataagttgtaagttatctgattacaaattggtatgtatgcattgactgcagggaactggaaaacagacaagcacaaaggaaaaagataacaatcgcctgtaattccaccactcagaggaagccaccttttattttggcatatttgtttccaatcattttaaataaaataagtacaaacatgtttttagaaaaatgatatcattaagaatggattttgcattctgtttttcttgaaaaataacagtatatgataaactctgttacattttggtaagtagccacctacaatccagtttgatagctgtattaacgtaatttcttcaaaagttattttcataaatagcctttttctgttaattttgcaaatcgtctccttatattcttttgccatttttctactggatacttgttgatttcttactgatttccatgaggtatttttaaatatattagggatactgacactttctcttccacatgttattgaaatattttgctattttgttatttgccctttaattttgtgctgcttttcatgtatagaagttttatattttatgtagtaaaattttctctttttttggattctttccttgctgttacacttagaaagatagtcccatccctaggtcaaatacattttcactgcattttctttgttatttatggttacaattttacatttaagtcttaggctataatattaattttagtttatccaatgaggtaaaaatctgactttttgccaagtaaccaatcgttccagcactactgattgaatagttcatatataggttgttttgaagttccacctttataatttactgtacatgcatatactcactcacatgtgtggatacttttaatcttactttttggtgctgctgatcactgtttcttctttcctagtactatattttttaagttatcatagtttcaacctcaccaatgattgtgaaaatgtaagataaaagaatagtgctatgtaattttttgcccatcaattttacaaaaaaaaggtaagattgccaatatccagtgctgatgaatatgtggagatgtggacactctcagcactcctggtagtgtaaattagaggcaggtaggcattacctataaaaaaatgtaatgcacatgtctttgaccaacaaccttacttctaggaatctacccttttctttttctttttctccccccaagatggagtcttgctcttgttgcccaggctggctggagtgcagtggcgcgatctcggctcactgcaaccaccgcctcccaggttcagctgattctcctgcctcagccttccaagtagctgggattacaggtgcctgccaccatgcctggctaatttttgtatttttagtagagacggggtttcaccatgttggccaggctggtctcgaactcctgaccttgtgatctgcccaccttggcctccttcccaaagtgctggaattacaggcgtgaaccactgcacccagcccagaatctatcctatataacattcgtacaagtacacaagggcatatattcaaggatgttcactacattataatctgtggtggcaaaacaacaattagaagtactataatgtgtataaacaagaatggtagaattatgtatattgtatcatagctaaaaaggtagactttcagcttccagctgtgatgaaatagcttgtattgggctgtcatactaacaataactggaatggctgaattttaaaaatgaaggtgagtgaaggcttcagagagtaattacaacagccagaacttgagaaactaaaaccttggacagaagggacactcaaagaataaactcactattctctgtgcagtttacctttgaggcatttgctgattcttaagttttgcttgcatgaagtaaggggccaagaaactaagcaggaagtctcactgttctacggagacaaaaattgcatttcaggaccttcctatgtggaaggggctgtgataaacaccttgggctttcagttgaaacccctaaagaatggactacaccttaggagtaaggaaaaaccataaatagacgagttcttagaaagcctcaaatacaaatcctaaaacacaatcttcttaattcctgattgggctaagaagatctgcttatactgtatctgcctactaaaataaactgaatcttctctggagggaaataatgtcatccagagcctctacaattctttatacaccgtattcagcattgaaaaaagaagacatgacttagaaaaccatgacttgttattaattggtaaattaataaaattaataaaagacaaaagaaaaaaataaaacagacacccagacttctattcaacatagcttttttttttttttttttgagagaagctctcactgtgttgcccaggctggtcacaaactcttgcgctcaagggatcctcccaccttagtctctgggacaacaggcacacaccatcacagtcggccatcattggaagttctagccagagcagttagacaagaaaaagatataaaagacatccaaattggcaaagaaaaattaaaatggtctccattcacacatgacatggttttatttaaaaaacaaaaacaaaaacaaaaaaaacctgtgagaactaataaacaaattcagcaaacttataggatacagaatcagcacacaaaagtcagttacatttttatacactaaaaatgaacaatttgacaaggaaattaagaaaacagttccatttataatagcatcaaaaagaataaaatacttaagaataggcttaaccaaagaggtgaaagacttgtacactgaaaatggaaaaacattgctaaaagaaatagagaggagacaaataaatggaaagacatgctgtctttgtgggttagaagacataatattgttaagataccagtacaacccaaagctatcaacagattctatgcaagccctatcaagagcccaaatgatgatttctgtaaaatagaaaaattgttctaaaatttatatggaatctcaagggaccctgaatagccaacatgaggatgtggagacatgaaaactcttgtgtactgtggatgggaatgtaaaatgtgtcagcccctatggaaaacagtatggcagtccctcaaacaaattaaacatagaattactatataatccagcaattacacttctgagtatatatccaaaagaagtaaaaataggaacttgaacattttctacatcaatgtgcagcattgcccacaatagccaaaaagtggaaacaacccaaatgtccatcaatgaatggataaacaatatgcaatgtatacacaaaatgtatacccaaaatggaatattattaagccttaaaaaggaaggagattctgacatatgctacacatagatgaactttgaagactatgctaaatgaaataagctagttacaaaaggaaagatattgtattattccatttatatgagataccgaattcatagagatacaaagtagaacagtggttgccagaggctgggaagcagaggacatgaaaagttacttactgttcaataaatagagtttcagtctgggaagatgaaagagttttggagatagttggtggtgatgtttgcacaatgatgtaaatgtacttaatgccactgaacttaaggttattaaaatggtaaatggtaaattttatgttgtgtatattttgcagtattaaatagaaacaaaaagtaaggagtagtgggaaaacctggttgtgacatcaatctcaggtaaaatgtgtgctttactgcatggaccctggaatatgaccaaggctttaacaattctctgatgctagccccctaagagtaaagcaacactaaaactggcatatttgataagtataacacttacgtaaagcaaatgaaaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctacatgataataacaaacctgattgtatgtgtttatggggaggagaaactattttctggaaagaaagcttaaactccccatttgtcatcttacatttgaaatagtgcagctgaggtaggtataaacaaaagagtaatggatcatagattctatttctgactttgtcatttgctagccatatgatttcactaatccacgtatcatctcttagccttatttttcatctattaaaagaagaaaagccctcactggggggttacaggattaaataaaattatatacttaaaaatacttcgtaaactgcagcataccgtaaaaatgtcagaaattattatatgtgccagttaaccccagatactttggaatgtattagacattaaatgtgggggtatcattgccctgtgacatcttggatactcttctgaatatatgagtagtttaaaatattacttgataattgtgagagtaaattaatctaatctattatttttatttgtctcagtttatagaccagcaacagttctacctggctctggacaacaagatgatagtggaaatgcttagaacagacctctcctacctctgtagccgctggcggatgacaggccagcccaccatcaccttccccatctcacacagcatgcttggtaagggctgcatgaggcaaggaacgaatgtattttggaaataagtcatagatttagcccttcaacatcttgttgtttctagagagctacttcttataatttattctttcagcagtatttattggctcctattttatgccaagcacttttctaagcactggggacacatggagtgaataaggcagatgaggtttccgttctcatggagcttatgctttagaaggtgaagacagactatatgtaatacataaatcaacatacaagagtaatttcagagctataattgaatagttttcagatagtttgagagctataattcaaaaaatgtagtggaggataatttaaaacttggttggtggttactttagataattagtttctaggtcaattttcagaaattttattcatacaattatttttaaagacagtaatactgtatctgcatatttcttactctagtggtacatcaagattttatagataatttcccaggctgcttcttccaaagcctaacggaagctgtaaaatctagtaggggaaaaagccaaaaggcttttggcttacgtttcctcttttttttttttttttgactggatttcctgacattgcttacttgaaactgggtgaaaggctttattattctctcagttcctggaggactagagccaatactgaagcgactgcttcctttctgtgtttctcctgttgcttccaaagacctgtttgtactgccaaagtatatagaattccttttcattaaagaaaaatcccttattattaatcattcaaaatccagacagactgttagggattttggtcacatctcaaaagtgcttcaatatcacaggatttgaggaagtagggtagtctttcttctctttgtctttcttcattacttaagacagttaacacaagtacccatttaaaaactactatatttgcagaattgtcttcagaaagtataaagtctaattggagacgaaaagctaatatgcaagaatgatagaaacaacttaagacaatatataaagaattactaaaccattaggtcagtattttacagtgaaggagatccagttgacaaagaaaatttctcaactgaggtaggacttaaccaggctttttggaatggatagtattcagatgacaggagagcagaaggaaaggtactataagtgaggaggaaaataccatgagtgagccctagaggcaagaatgaacttgacctgtgagaggagaatgaagttctcctgaatagagtggagtttgtgtgttggagtataattataagcaaaatgggaaaagtaaggtagggttcaataatgaagaccttgaaaataagcaaagatatttaatatagatttttctcagaagtctgaaactatcaaaaggttttgagcaaggagtaatatgataaaaatgatgtttggggactattggtgacagtacacattgtagtgaggagagactgatgtcaaagaaactaatccacatatgaggtgaagagaaagtacactggattggaggtaataaaagtagaatgaaaaagaaagatatgagtcattttaagcaacacccaactcagatattggataactagatataaggtatgaattaagatagctataacaaaataccaaaaagttggtaatttataaacaatagaattttattttgtactattctgggagctaggaagtccaagatcaaggtgctgacaggtttggtgtctgggaaggacctgaagtctctccttctaagatggtgccttgttgcttcatcctctgcagcagacacacatgtgttcttacattgtagaagggacagaaaagaagcaaacccactctcttaagcccttttataagggccccgatcccatccatgatggctgcacactcatgacttaatcacactagatggcctacttcttaatgctatcacattggtgattaagtttcaacaaacgaatttgggggcacattcagatcatagcactaggtaaatgttgctgcattgatagaatcagagacattttatatgaagaagccagttataaagggacatgaatttgtagtgacaaagagatttcagaattgaaatacctgagagttgggatgagatacatagccacagcttgggaagcagaataaaactaaagatctaggcttaaatcaagcatttttggtacttgatatgtggtcacataacaaaaacaacaataacaatagcaataataactgtaatatttactgaatactttctctgtgccaggcactgagctaagtgttttcaattaattattttgaaatctctacaacactcttattcaggcaggtactcattatccaaagtcacaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattagttaaattctcatattacagacaaagattcctgtaatacataaaagagcaaaaataatacataaatggcatccaggtggatgctatttacaatagatatccctaaaataaaatcataaaaaaagatggaagaaaagaatatgtaaagatatatcatgtaaatgctgacaagaaagcagtggtcgcagtattaatatcaaaaatagcaaataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtatatataactatgtatccaaaaaggcagaacacacaaagaatgtttatggttaaaaagtagaaatcatacaaacgatattgccagatacgtgacataaaactaattaacacagaatagttaaaaagaatctaactataaaggaattatattttttcccaaataattattagattaaagagaaagtcaaatttgaaattatatgcttcttagaaatgaaaaatgataccactacttataatttatgagatttggtcaaaatcatatttagaaaatttcatatccttaaatacttctacttttaaaaagtgacttttagttttgagacaagatggcatagactcacttctccctattcctcctgctaagtgcagctaaaaatccttgacatatataaaacaaacataagaaaactctgaaagttggaaaccaggcagatcagctagagactttaagacctgaagaacagcagagcagtaaatatcctgggccttatatgtcctggactggaagctagagaagctgacatctcagaaatacaaaaagaaaaaaaaaaaaggaaaaacaggtttttttaaagacccaaggaaaatctgctttgtctagctgaaggaacaggaaaggagcaacctagagagacagaaaacttttagaccctattttactaggccccacttatgcccctgtcagcagagactgagtggggactctagacttccacgcttgcacagctctgaagaggcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagtaaaaaaaaaaaaaaaaaaaaaaacctgaaaaaatatgaacagagcctcaaagacctgtaggactaataacaaaagatttaacattttttaacattcacgttaaaaagatctaacattcatgttataaaagtttcagaaagaggagaaaaagtatgagagaaaatcagaaaaagcattccaactaataatgactgaaaaattggtaaaagacataaacctacaaattttttaaaaaatgagaaaatcttaaacatggtaaaatccatgtcaaaacacataataataaagttcttgaacattaaagaagaaatatcttgaaagtggccagaaagaaacaataccatttctataagcaacaaacagaatgacagcaaatttatcatcagaaaccatggacaccagagggaagtgacacaacattttttaagtactgaaaaaaaaaagaattttaaaccaagaattttgccctatccagtgtacttcaagaataaaaggaaaaaagacattctcagatgtaggaaagctaagtgaatttgtcagcaggagatctgccctaaaagaatggtttgaagaaagttcttgaaacagaaaggaaataataatagatggaatcttgaaacatcaaaaagaaaaaataaaaataggagtgaaaatatgagtaaatacaatagactttctccacttcaattttccctttctttctctctctctctctctctctctctcccccacccccgctctttttctttttctttttctttttctttttctttttcagagtctctctctgtcacccagcctggagtgcaatggcacaatctcagctcactgcaatctccagcttccgggttcaagtgattctcctacctcagcctccccagtagctgggattacaggcatgcaccaccatgcccggctaagtttttgtattttttttagtagagacggggtttcgccatgttggccaggctggtcccgaactccttccacttcaattttctaaattatgcttgataagcattgcttaatatagttctcaaagtatgtagaagaaatattcaaggcaagtatattataaatggggaaaagtaaggaccttaatgggagataagattctatacatcactttaattggtataatgttgacactagtaaagagtgatatatgcatcatgtttgtatatataagacaatgcctggagtaaccactaagaaacctatagaaggagataacagtcaaacccagtataggtaaatcaaaatggcattctaaaaaatgtaaaagtaacccataagaaggcaggaagaagaaaatagacaaatgaagaacagaggtacaaatagaaaacaataaaatggcaaacttaatcctaacatatcaataattactttaaatagcctaaatacatcagttcaaatatcacaatatacgtagactgaaaagaaaaggaaggaaaaagatataccatgtaaacattaattttaaaaagcagaagtagctacattaatatctggtaaagtagaactcagagtaaagaaaaaaacaggtagtaaaagtgttaggaaagacaaaggagatatagcaacagaaatagaggagactttaaacactgtaaaagaataccaactacaattttgtacatctagataaaattgacagattttctagaaaagtaagaatacaagtataagctgaataggaacacttataaaagtgtatgagaaaaactataaaactattgaagacaataaaatattttaattagtagagaggtacaccatgttcctagacataaatagttaatattgagaaattacccactttcattatatcaattcaggcaattcccaataataataaaaacataaatttttatgaacaagctgaaccttgatttcatatgtaagagaaaatgtaaatgaataaccagatttttaaaaagaaagtgaaagatccattgtaattaaaacaatgatgaagatagaatttcaaatagagacaaaatttaatataaatacatttgggaaaataattcatttaggcttgctactttactttttttgcaaaaatacattctaaatagattaaagagctaaacataaacaataaacctgtgagagtcttagaaaaaaatatgggaggttgggcagggtggctcaaacctataatcccagcactttgggaggctgaggcgggaggatacttgaggtcaggagtttgagagcagcctggccaacatggtgaaaccccatctctactaaaaatacagccaggtgtggtggcacgcgcctgtagtcccagttacttgggaggctgaggcaggagaatcacttgaacccgggaggcggaggttgcagtgagccgagattgcaccactgcactccagcctgcatgacagaggcagactccatttgaaaaaaaaaaatatatatatatatatttatatgggaatatatatatatatatatatgggaatatttttgttatcttaggttgaagagagctgtcctttgcaagacacaaaaataaaatattgtcagattttgaaacatgaaaatgaaatcttttatatcaaaagcactgtggatgcggttgaaagaaaaataataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacgaaatcaggagattgagaccatcctggctaacacagtgaaaccccgtctctactaaaaaaaacaaaaaaaatacaaaaaattagccaggcgtggtggcgggcgcctgtagtcccagctactcgggaggctgaggccggagaatggcgtgaacccgggaggcggagcttgcagtgagccgagatcaagccattgcaccccagcctaggtaacagagcgagactctgtctcaaaaaaaaaaaaaaaaaaaaaaaagtgtaggaaaaagtctttctatactgttggtggaaatataattggcacaactcttatagtgggtaatttggcagtctctgtaaatttacttagtaagtgtttcatttgtcctaatagttctacttgtaagaatttaacctaaggatataatagaataagtgcatcaagatgtaggtacaatggtcttcattacagtgttgattataatataaaacagtctaaatttagtaagaattatttttagctattacaaaggtaaagttagaaagcagatcatgaaagagtatatgtagtatgattacttccacataaaatcaggtaattgttagctttctagatattttttatgcctatacacagacatatgtgccaaggttctttatatgagataatgtgtataaaatgtttagcacagtgcttggcacataacattcaacaagtagtggctactggtattatcagcattcagtagtcattcagtgttctgccatcagacactgtgctaagtacttctgacaaataagataatgctgacaaataagataatgcctttgaggaaatctatcagtcatcatcccttaccatttacccattcttaagtgttgttggctctcagatgaattgttaaaatcaggatggtcaatgaggagtgtctcatttgtattgtaaccaccagaatgttgatttgaaataattacaagatttctccctacttcagagttaaaaccacaaagattgttttaaaattctgttcatttcaagatgaagatggaacaagcttgaattcaagtatcctggcagcactccgaaaaatgcaagatgggtattttggtggggcaaggtaagtgacctctatacactctttagtgaaatgaaatgaaattaaggggctggatatagtagtggcatacctgtgatgcctttctgtgtatgatagtccccccttatctacaatttgactccgatatttcagttacccgtggtcaacctgtagtctgcaaataggtgagtacagtacaataagatattttgagacagagagagagactacgttcacataacttttattatagtatattgttataattgttctatttcattattattttgagctcttactatgcttaatttataaattaaactatatcataggtatgtatgtataagaaaaaacacagtatatatataaggttcagtactatctgcagtttcaggaatccacaagggggtcttggaacatatcctgcaggagtaagcgggggctaactgtatcttcgataacataatcccatcctacttagaggagtttgatagattgaatcaaggaatttaatgttgtagaggaaggttggaagtttttcctaccctgttctttgcctagatctcaaaggatcagaaaacctgttttgttttgtttttttaatgcctactggattatttgattccagctgcttttcttttctttttccacttaagtttttattttgaaaaatttccagcttacagaaatttgcaagaatactactgaacacccatataccctttctcaagattcacctgttattaacattttgtcccactgtgcattctctatttcttcccttccctcccttcctgcctttccccccttcctttctctcttcctccctacatcctcccatacacatacatatgcatatacacacacacacgtacatactacatatactatgtgttttatatatatatacatatatatacacacatgtacacacatgcttttttgctaaaataattagccatagacatcataactcttcaaccctaaatacttaagttttctttgttttgtctaggaacaagtgcattcttacatataactataatataatcatcacacttagtttgggaggccaaggggggcagatcacttgaagccaggagttcaagaccagcctggccaacatggcaaaaacctctctctacaaaaaatacaaaaattagccaggcgtgttggtgcatacctgtaatcctagctacttgggaggctgagacatgagaatctcttgaacctgggaggcggaagttgcagtgagccaggattgtgccactgcactccagcctgggagactgtggaaagcagtttggagatttctcaaacaacttaaaatagaactaccattctaccctgcaatcccattactggatatatatccaaaagaatataaatcattataccatagagacacatgcatatgttcatcacagcactagacacaatagcaaagataaagatgggcatcaacctagatgcccacctatggtggacttgttaaaggaaatgtggtatataatgcaccatggaatactacagtgccataaaaaagaacaaaatcatgtcctttgcagcaacatgaattcatatagaggccattatcctaagcaaattaacacaggaacagaaaaccaaataccacataccacatgttctctcttataagtgggaactaaacattgagtagacatggacacaaaaaaggaaacaatagacaccaggaccttcttgaggatggagggcgagaggtaggtgaggattgcaaactacctattggatactgtgcttactatgggtgatgaaatagtttgtacaccaaacccctgtgacatgcagtttacccatgtaacaaatctgcacatgtacccctgagcctaaaattaaagttggaaataaataaataaataaagtagaaggagaaataagaacagttacccaattatcccaataatgttttatcatagctgttttcccaccaatccaggatccaatcaaagatcacatgttagcagttagttgttatatctctttggtatcttttaatctagaagagttctccagccttttgtcaatctttcatgagagttttcattacatttttgaagaatgcaggtcagttattttgcagaacatctcacaatttggatttggctggttgtttctcattattagattcaggctacatgtttttggcaggaatactacctgtgtgatgttgggtccttgttttaagttaggatctttaagatggagagcaccccttcaatggttaggagaggcacaagatggaaataaagattttattacttacaggtcctgcaggtgaggtacacagaatacctggaggccacacacactgaggtcagggagcatgtggagagagaaaaagagagacccatgggccaatgcctttattgaggtccagggcattatccaaacagatattccttggggagttttaattggtgggtttaaagcaagtaggcatgacttcctggaggtcacactgtgactgagaggtggtcactgtggcatattggcatagttcatgtaggatgtgaggatcagtgaggctagtcaaatagatcatatttagctgtcccttagggaggtggttaccaggaggaagttgtataaggcagatatgtggactgaccacagtgaggaactgagggaggtgtagaactggaaactgtcaaagattcctgaactctgcttctggtatgagaaagttaagcttatattcaaaagagatgccagggaaacatacaattataagaatttactacagtctctttcagtgcatcatatcagaggcacatgagatttgtttgtgacattattgggtgatgataaccttgatcacttggttaaagtgttcaacctggtatctgccaggtttctgcatatcctttctccaacagtctttgatcaaatcgtattagcttccgttgatccttgcgtgaattcacttattactattggagttattaaatggtgtttctatcattctgtgtacatttattggttgaaattcttatgttaaaaaaaagagctttcccttccccccttttattttgtagtttagtatcagcacagattcatagattattattttattcaatatgccatgatccatttctgttattatttcaatattttaattatccaaggtgtggccattgatagccccttcaagttggcctctttagaaatttggtaatgctgactttgcttttgggttttgtaattgtcttcataagtaggagacgatatggcttacagtctactataatttacagaattgtcaagtaccatcctttatgttcaaatgacctttgggtatttttttaatgaagtgatgggtttgtgatgatttatcttcattctctccaggcttctccagtagccaatgcaaatttttaccagatgtttggcatagttagcaacgtaatatatggcagtagaagagagcaaaactggtctgctggtggattgttaatccataattgtaacctttattaatacagtcccctaaccatttaagatgtacaccatgcctaggagtgctgtaaaattttatttttataaaatttatattaatgtatgcacattagtaatcccccaacaaaacatgttaggtgtccttttatcactaagattgtgttgtttaaaaaggatcacccctgattttctgttttctatcctcctctaatttttagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatggtaaggaggcttcataaagcactggcctggctggacaaaactacaaaatattgtttagcaccatccttaataatttatgctgccagcagtctcacagtgttctatcctcactctagatctctacttttgtttggctttacttttcctccctctacttacctttggtttctggtctaatattcctgcggtaattgtggagtatggagttggacagtcccttactaagattggggaagattcctctcccaggcatttgaagtggctggtgattttgacatgggaagaagcagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaaaaaataaatttgctgccctcagtgaggtcagccagcacaatctcatacaataggacaacacattagcagtcagaaggactattttcttttttgggcccgacatttactcactaagcaccacttcattcattctgtgtttgtttttgtaagatctaaaacagttgaatttctttgttggaaaagtacattaaatacaaggctatttactgttatcagtaataacaaaagtcatgatgtcttggcataaaatactttgaaaattaaatgagaagatcatatattgagattgtttgctcttctatgggtagttgtgatttttatctgtagtactcattccattggattactaaaatatatatttctaatgatacgtgttactgaatttgacattatggcattctgagtcactttcctagttccgggtttactcatcagtgttctcaaaatgaatgtatttattgcttgccagcccttctgtgggtaaagagcttctctccatattcttcataatcctccactcaagtctctagattgtattcaaggttacaatctttgtcattaggatgtcactgaatatgagctccattcttacagctctactagttcgcattagtcacatcagagcacagaaagacatctggagagatcagtaaatatcatcaaaaaccagaagactcatgactgatacagcagactttggtatcgatctgaatagtgtgtttttctaactataaaccttgtgaatattcatgtaaagtctgaaatattaagcttccacaggatatatgtatgtttttctttccattacccatactcagagataatgttatagaaggtatatgggagaaggggagcccaagaagatagggaccatatccatcctcttcaccactgaaatgtcagcacctagtacactgcctggtacatagcagccaacaaatatttgctgagtaaacaaacgaggtgactaagaagatttttgccctttcctggcccttcctcaccaaagtcccctcacattagtgtgacctgaagctccctgttctgttcctcctccatccctgccaccattactatcacatgcacacacacaaatacacagattgctaaatgcttgctccaatgtaaaacaagctcatactgctttcaagaaccctgaccttgtctcagcaagttgaagaggaggtggatcctagtaaatggccatggtcactggatcttaaagtgatgaggttatatcatgatcacaagcttttcctccatgagctaaaaacaacctacttctggtgctgtgttgtgagcacaggagccaatcattctctttgctggggtagattgtaaagtaactaaaatattttcattcttttctcttccccctccccccactaaccttgcagctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagagtgagtaatgccgtgactcaccagagtcaggcacaggatgacgtgaagcccaggataggggcgggcattgattacaatgtaagcaggaactttagttttcttcactgctttatcccccgcatctcagacagcacctagaacatattagacactcaaatatttgtaaaatgagtgaattgtgtatagttatgctgcaggtagtgctatgtagtctggtttaactggtaacatggtaagaagaggcagaacaagagacatggagcatattcaactataacattaaagtttgaaatggtagaaagggtttttcctttgggaaaattacttctatggaattttcttgttgttccagcaatgtagagctgttttgtcaaatataatactcattctttacaactttgccattcttctccccatggccactaccctccttcagttgtattcacagtggagggtgtcttctgccacacattgccaggagtagtcatagttcctaagagtgttcaatgtctttatagtagctggatatgaaaggagagaagggctccttggccacacctagaagacctgaatgttaacattttacagatgaggagaatgactgagatgcatgctcttgctgtctaaaactttattgaccattactaaccaaatacattaaacatgaacattgggaatcatttaacatttataatagggaaaagctcagcataccctctgagtatgcttcctcgagaaagggcttatatgaagagatgaaatttattgttatacttctcaattgtgaaccagaaaacttgggcttaattcccagctctgctacttacttgcttgaacagttatttgagctctgtatctctctttctgtatctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcaaaatatacttattaattgcacattatttaaattatcttatattcatatttattttctttgatattaccaagaaaggagaaatttgtcattcttgttctatgaagaactgactcacatgtgacttaattgttgaagtcaactgtgcatttctattagtctcctaattacctaatatttcccataaatgtcatatttttgcagatgttcacatgtatcttcctacgaagttatttcaggcttcccggccttcattcaacttacttgattcacctcatccccgacaggagaaccaggtaaatttgtgcaggaggtatttctattagctttttgaaaaactgccatctttatgggaaataataggactagtcattatggttcttgttactaactagtggtacgcaaaatgctattctggtgaagatacatgttcttttcagttcacttttacattgggcaagtttgtctggtcagactttgggaaaactagattgctgtattatacatctggaaggtttcattacttttgctttgcctttcattagtatttaaagaattccttggaaaaggtttagaggtgaaaatatgactcattctaggacattatttaagttgagcacttgtgaacttaatttcttgtcatcatttctcaaactaaaggttccctctgttcgtgtagaaatacatcttcctagagaccagtctggggaggtggactttaaagcactggttttacagttgaaggagacctcaagcttacaggaacaagctgatatcctctatatgctgtatactatgaagtaagtggtggatattatcaatctagtttaatgttcataatcagaggaattatagcataataaatagagcacagcttttggagtttcgctgatctggaattgaatatagtttaacaacctatccatcatgtgacttcaaaccctcagttgtcctcatttatagaatttggattatatatacctcatagagttattgtaaagattaagatataatatccatgaagtctctaatacaatgcctggcacatggtgggtgatcaataactgataaatattactgtcattaggttatttttaagcctccattatttggtcaaatgtacagataagtttttaactcaagaaaagtaagaatatagaggtttataggagaaagaaactaacatttttgtttgctatgtgtcaggcatcctgctaggtactttgtattagtacaaactcaatatgtccaaattgaactcctctctcctaaaccccacaagcttacacaaaaataatctgttctccctccttttccatgttgtagtcaccatgaagaggcaggatggactttcttcccctaaatttggtttggatgttgagatagatggtgacatacacataccaagaaggtgtggaatatttattactcacataataaggctttctaggaagagcaaagaaggttcccagcttgctcccaaaaaggcttgagagcccagggaaaggagactaaattgggggttttataatcattacaggatgagcattctcactggcttctagttttctttttttgttgtgtccttgtttggttttggtatcagggtaatgctggcctcataaaatgagttcggaagaactctccccttttccttttttttttttattttttttattttttggaatagtttgaaaagaattagtattagttctctaaatatttggtacaattcagcagtgaaaccatctggtcctgggcttccctttgatgggagactttttattactgattcaatctcctttgttattgatctattcagattttctgtttcttcatacttcaatcttggtagattgtatgtgttcacaaatttatccgtttcttctagggtttcctacttgttggcatataattgttcataacagtttctaacaattcttttaatttctgtggtatcagttatatctcatcttctttttttgattttgaagtgaggtctcgctctgttgcccaggctggagtgcagtggcatcatcatggctcactgcagccttcactgcccagtctcaagtgatcctcccacctcagcctcctgagtagctggtaccacaggtgcgtgccaccatgtccggctaaatgtttttttaattatttatagaaatgaggtcttactatgttacccaggctatatatctccttttcatctctcattttatttatttgggtattctttctttttttctttgtctagccaaatctttgttgatttttgtttatcttttcaaaaaaaccaacttctcattttgttaatcatttgtattgcttttttagtctctgttttatttatttccactctgatgtttattgtttcttccttttactaattttgggtttagtttgttcttgtttttctagttactttaggtgtaacattatgttgtttattttagacctttatactttttgatatatgcattcattgctataaacatctctcttagaatagcattttctgtatcccatatcttttggtatgttgcatttccttttcatttgccaaaagaaatttttgtaatttccttcttaatttgttcagtgaccccttggttgtttaggagcatgtttaatttccttgtatttgtaaagtttctgtggtttctcctgttattgatttctagttttatatcattgtgatcagaaaagatacttgatatgattttgatcttcttcaattcattaatacttgtttgtagcctagtatataatctaccctgcagaatgttccatgtaaagttgagaataatgtgtattctgtagcttttggatggaatgttctgtaaatatcaattaggtccatttggtctagtgtgcagtttaaatccaatgtttgtttgttgattttctgtctatgtgatctgtccattactgaaaatgggctgttgaaggcccgtactattattgtattgtagtctatctcttcctttaggtatgttaatatttgctttatatacttaggtgctccaatgttgggtgcatatacatttacaatagttgaatcctcttgcttaactgatcccccttatcattatatggtgaccttctatatcactttttagtgttttacttaaagtctatttttttaagacagtcttgctctgtcagccaggctggagtgtagtgccatgaacatggctcactgtagtctcaaactcctgggctcaagtgaccctccaacttcagtttcctgagtagctgggaccacaggtgcatgccaccatggccagctgatttttaatttttttttgcagagctggggtctggccatgttgcccaggctggtctcaaactattgggctcaagccatccttctgcctcagcctcccagagtgctgggagttccaggtgtgagccacagcacctggccctgaaagtctgttttatccaagtagagttacgtctgttgtcttttgctttccatttgcatggaatatcttttttccatccgctcacttttagtccatgtatgtcctcacaggtggagtgaatctcttttaagcagcatatagttggctcttggctttttttattcattaagctactctgctttttaatgggataatttaatcaactcacattaaaggtaattattggtaggtaagggcttactactgccatttaattaattgttttccagttgttttgtagaatcaatccttccttccttccttccttccttccttccttccttccttccccccctccttctttccttccttccttccttcccccctccttctttccttccttccttccttttttatttctctcttactatctgtctttatggctaagtgattttccttcataatatgttttgattttttgctttttatttttagcatatctattatatgtttttgcattgtggttaccatgaggcttacaaaaaatcttaacaatttaactatgattacagtaaaagagaagaaaaatctctttaactcaacctcccaacattttgagtttttgatgtcacaatttaaaatttttatattgcatatcccctaacaaattattgtagttactatttttaatggttttgtcttttaaccttcatactaaagatgtaagtaatttacacaccatcgttagattaatagagtattcatatgactgtgtactcagtgacatatatcttcagatgttttcatattattcattaatgtctttttctttcatcttgaagaactccctttagcatttcttgtaaaacaggtctgatggttatatatttcctcagcttttgtttgtctggaaaagtctatgtcttcttcatttctgaagtattcttggctggcagttttttcccttcagcacgttgaatacctcatctcactatctcctggcctataagggttctgctgagaagtctgccgttaggcttattaagattcccttatatgttatttgcttcttttttctcactgctttcagaattctctctttgtctttgatctttgacatttttattataataggttgtgacatagtcttatttggagtagaatttattttcaaatatatatcttcctattgaacatgtctaaagtcaaattcactgtctttactacaaacctactgctgttgtctttcctgactctattctgggtatcatcattccttcaagtaacccagacttgaaattgtgtcattgtcttcaattcctccccatcccctgcctctcgctacagcatcaacactaccacagggaatcattggccaaatctaaatcctctatgatttgactttcaacttttatttaccattgctcttcccttacaatgtgaatgctgtcaccaaaacagtctatttatcatacccaaagcacagcctctacatgcctaccttcataccttgattcttattttttcttctgcctagaatattctcctttaccacactccatttctacttcttgcatttctctctgtcaaggcctaggtcatctgtcacccacatgaaacttcctccaatctgtaatagtaaaaataatcttccactgattctgagatctcatagcacttttttcatatctttaaaatttgacagtgtcagacttggagaaaagttgtgaggatagtacaataaaaattctggatagccctccttcagatccatcagatgtttccactgagcttttaatctctctctctctctctttcacgttgatgtcatcatctatactcaatcacacacgcatattatttttttctgaaccatttgagagtaagtggcagacacgatccccatctaaccctaaataattcagtgtttatttctgaaaaattatgaactctcctacataagcacagtataattgccaaagtcaaggaattgtttaacattaaaccaatactattaactatctacagatactattaagatttgtcatatagcccaatagtgtctttatagaaaagaacatctaaaatcatgaattttattgagttctcaggtgtcttgagtctccatttatctggaacagttcctgagtcttcatttttcatgttgttaacatttgtgaggaatacaaaccagttattttgcagaatatccctcaatttcagtttatgtgttgttttgtcatgattaaattcagattatacattactaaggtaatgccaagttcttttccatgtgtcatatcatagtgttgattagtcccattgctgatactgtaaactttgatcgcttggttggatcatttggttaaggtagattcttccatgtacctacactgtaaagttattatgtcatcttttgtaattaaaaaagtatcctgtagagatgtactttgagactacgtaaatatacggttactcttcaaacttttgctcactgatatttttcatccattaatgactcttcctatagcacattttatttcatgttttttaatttaatatattgaatagatatattcctatggttcaaaaatttttaagtacaaaagaatatacagtgagagggtaaaatgtctttctcccatctctgttcccccagataccctgttccccttctcatgggcagtcagtgttgtgtgtgtgtgtgtgtgtgtgtgtgtgtgtatcctcccatggacatttatggatatgtaggtaaacacagacatatatggggataattttacccctatttatccaaaaggtagcatagtatacacacagctctaccttgctttctttcactaaaactatatatcttgatgataactacatatatattccaattatctattgcttcataacaaatcactctgaaactcagtagcttaaaataacaaaaatttaaaaatttttaaattatctttcacagttctgggacttgcctgtgttcagccaggcagttctcacctgaggtctctcatttagttttggtcaacaatttctggggctggaatcttcacaatgcttgcccactcatatgtctaggggttgatactggctgttggctagaacctcagctgaggttacctacagctggtacacccacagatgacctcctcatgtgtctctccacatcttcacagcatgatgactaggttctactagtaagtgtcccagctgggagctctattactttgtatagcctagcctcagaaattaggtaagtcacttttgccttaatcacaagcatgcctgggttcaagggaagggaacacagaactcatctcttcatgggaggagtgcgagagtcacattgtaagaagagtaggttggataggaaattgttgcagctattgttgaaaatatattaccacaatctagatctacttcatattttctgaataattgtgtcattccattatttgaatatatcataatttacttagccagcctcttattgatgaacatttgaattgttgccagaattcacaatcacaaaaatgctatggcaagtaccctcatagcatacagcatttcacgtgtgtgaaatttatcatgcaagtaaaccagaactcgaattgatagatcaaaaaataggtattttttaactgtacaattaaatggctttgaatgtattcacattgttgtgcattcttcaccactactcattttagaacatttgcattaccccaaaaagaagccccacttcctttatccatcaacccccaatccctccattcccccagccctaggcagccactaatctacattctgtctgtatagatttgtttgcttgggacattttatataaattgagtcttgcaatatgtggtcctttatgacaggcttctttcatttaacatgatattttcaagattcatccgtgttgtaacatgtatcagtacttcattcttttattgccagatattatatcctgtataaatataacacatcttatttatccattcatcagatgatggacatttgggttctttctactttttggctattatgaataatgctggtataaacattcatgtacaagttaatgtggacatatgtttttatttctattgactgtataactagtagtggaaatgctggattatatggtaattctgcatttaaccatgttaggaattgccaggctgtttttaaatattttcaatactgatatatatttccaaatagctctccaaaggaattgtccaatttttattccgatcagcagcatattgatggtgcctgttttctcaaagcctcaccaaaatagtgttatcaactttagggacttttgacaatctgataggttaaaaatgttatcttggtatagtgctaagttaaagtttttctaggagtgaggttgagcaccttttcctatctttaaaagccatctatttgttttgccagcagtatttgttttgccagcagtatttgttttgccagattttcttttgtttttaattttttaaatctacatgttggagttctttatatataagggaaattatcctatgaattgcaaacattttttcctagttggtaatttgtcatatgactttccttacagtgatttttgaaataattcatttgttaaatctttgtctttaatttcaactatattgaagcccatgaatagggtaaaagaatgcattttgtcaaaagcacagctaaaactaagacttattcttgtgtaggtactggctttcagagctgactgttaatcatagttttataaggattcttagtaaattacattgatttcctagtgagagagacctatcaaaaacaggcatgttcattataacactgaaagaaaagatgattgccagaagctttacttaaaactgatgtagtcctgtcgttaaaattctagaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggtactataaattcttgaatttataccaaatctaaataagcgtgctttttaaaaattggtttctataattgttttttaaaacaaccatagcctctaaccatttgagatgtcttttccacataaaatttgatattcagttcttttagtttgtgaatgacaagtaagaattgtagatttataaaatgttataaaccataacatctttataatgatattaagaattctatatcttaagaatgaatttacactaggttcctacctcctagaaagggaaacatccatacaccattagtgggaatggaacttagtatagctacttatgtaaaacactatggaggttcatcaaaaaactaaaagtagaactaccatgggatccagcagtccaactgctgggtatatatcaaaaagaaaggaaatcagtatatgggagagatatctacaactcccatgtttattgtagcactattcccaatagcaaaggtatggaataaacctaaatgtccatcagaagatgagcagataaagaaaatgtggtatatatacacaattggatattattctgcatcaaaaatagtaaaaccctgtcatttacagtaacatgaatggaactggagggcactatgttaggtgaaataacccaggcacagaaagacaaataccacatgttctcactcatatgtgcgagcttaaaaagttgatctcatagaggtagagagtagaatgatggatactagaagctgggaagggtagtcgggagtgggggatagagaaagtttagttaatgggcatgaaaatacaactagattgaaggaataagatctagtatttggtgtcacaatagggtgactatagtttacaataatttgttgtaaatctcaaagtaactagaagagcagatttggaatcttgccaacacaaagaaatgataaatattgaggtgatggatgtctcaattacccaggtttgatcattacatgttgtatgcttgtatgaaaatatcacatgtactccataaatatgtataactcttatttatccataaaaattgaaaacttaaaaatttaaacaaattttttaaaaagaaagaaaaaaaccccataaaccaaccaaacaaaaaagttcctactttctaggagatagatgaaaagacctcattgtttcttcctagaaatccttcttttctgatcttcatggtattttctgaggaagagagttcagtgtgtcattatgttaaagaggagcaaaggtttttcagctgaaaagagaaatgtttgtggaaacctgaggtgttacagaaacgataatattatgctatctcttgttaggcctgcacagaccttctctcccaccagaaacatttgacagtaggacttcctccagaacctcgagaaaagactatctctgcgtgagtatggctgggtttggtcaggcttctctgagaaggagtggtgtggacttagaattcccttgccctaatctgtcagtggatgataatgtcctacatatgttcacctctatcagagacacctagtggaagaatgttggtaatggtagggcaagagtaaatgaaggagaaaactcacagagtagtactcaaactctttttacttgttggattttccatacctgccattcaaaaaacaaaacaaacagggtaccctgaattagcaaccacaaaatgtcagccatactctggaaagagcaagtgaaagaaagtggctagagcacagggctgaccatgaaactccatgctgctcatggggaataaaggggatggaggtcatagtcaaagaggaaaaatggttacttacagagcaatgtgaggtagcacccctccaggaaccctgtaatcagagtgccactgtctgaggtctgccacagcctccaattggaaacagtaccctaagataggcttggcctggagggagatgtaagtcaagtgatggggctgggatggaaaattcagtctttatacatgagtcttccttttgccattggccatgccagtaaaattcatctgcagtaaatgtgtttaatttcatatcacaccagtgccaaaatttaaatcttgcaaacagtctgtatctccaagaaatatttttagagagattctaacttcattcataaatgatctgaagaatctgtttttctactaggagtaatttttaaaaagggtattcccccctgcttgccagttctacttctgtagccaatgtagttaaaaaaaaacttttgtcaatatttctccctcattttttcctggttaaactctatccagagcatgttttttgtttacaaaattttttttactacattggctacagaagggatacttttgctgatgtctgcatactccttccttcctggtttatgtccatgatttctgttacccttgagttccagttcaagctcccatatgaaggcttagagaaacaaaagttccagcaagcttcaccaccgcgggcttaaagtgctctgggtactaaatagactcaaaaagcagtctaggccacaaggactgcaattcctgggcaaatccttgtgctatgctggactcgaagccaatggacttggggtgcatgcggcctagtgagacatcagctagagtgggcaaaggagtgcttgtgccacccctcttccaactccagatagtgcaactctgggagagaatccttccttccactgaggagaggagaggaaatagtaaagaggactttatcttgcaagttggataccagctcagccacagtaggatagggcaccaggcagaggcatcagactcccattccagtccgtagctcctggatgacattttgacacataccttgcaccagaagggaacctgctactttgaagagaagtacccagttttggcaggatttatcacgtgctgactaaacagcccttgggacctgaacaatcagcacagtgaccagacattctggttccaagtgtgaccaaacacatgcccagccgtggtgggtatagggagagactccttctgcttaagaaaaggagagggaagagtaaaggggactttttcttgcagcttaggtaccaggttggccacagtggggtagagcaccaagcaggtttttgaggtcccggattacaggcctggcatttggcctaggaactgctaacaaatgtacagtgcagtggtggttcaagaagttttgcaaaggagatgagagccttgaagatgaggagcatagtggcctgctattgaaagttgacaacgaccaattgagagcagttgttgaagctgatcctcttaaaactgcatgagaaattgccgaagaactcagcatcgaccattctacagtcagtcattcagcatttaaagcaaattggaaaggtgcaatgggagaaaatatttaccaactacctatctgataagggattaataaccagaatgtataaggagctcaaacaattctatagggaaaaaaatctaatagtctgttttaaaaatgggcaaatggtctgaatagacatttctcaaaagaagacatacaaatggcaaacaggcatatgaaaaggtgctcaacatcattgatcatcagagaaatgcaaatcaaaactacagtgaagtatcatctcaccccagttaaaatggcttttatccaaaagacaggcaataacaaatgctggcaaggatgtggagaaaagggaaccctcatatattgttggtaggaatgtaattagtacaactactatgaagaacaatttggaggttcctgaaaaaagctaaaaatagagctgccatatgatccagcaatcccactgctaggtatatacccaaagaaaggaaatcggtatattgatgagatatctgcactcctgtgtttatttcatcagtattcacaataaccaagatttggaagcaacctaagtgtccatcagtagatgaatagatcaagaaaatatggtacatatacacaagggagtactattcagacacaaaaaaaatgagatcctgtcatttgtaacaacatggatggaactggaggtcattatgttaagtgaaataagtcagacacagaaagacaaagttcacatgttctcactgatttgtgggaactaaaaatcaaaacaattgaactcatggagatagaaagtagaatgatggttaccaaaagactgggaagggtagcagggtttatgggcgttgggggtggagatggttaatgggtacaaaaagtagttggagagaatgaataagatcttgtatttgatagcacaatagggagactatggtcaaaataatttaattgtgcgttttaaaataactgaaagggtgtaattggattgtttgtaacacaaaagataaatgcttgatgagatggataccccatttaccctgatttgattattatatgttgaatgcctgtatcaaaaatctcatgtaccccagaaatatatacaccactatagacccacaaaaattaaaaattaaaaaaaaatttaaagaaaagaatttgaggagaggacataattcaatccataaaatcttgcttctggaaaaacaatcttttttgtatcagttttgtgacactgtaggtaatccaaagaagatggcatggttcatgccccagagtgctttgtgtcagcaggagaatcagaagtgtgtgaggatgtgtgtatacgtgtgtgtgtgtgtgtgtgtgtgtgcatgtgtgtgaattgaaactatagaaaatcaaacaactctgtcaactgtgattgtaaagtaataaaatggcttcaaaaaggcacagctagtattccattgtaggggtgggatgctgaagagatgttggttaaagaaggaatacattctaatgttcagtagcagagtagggtgactattgttaacaacaatgtattgtatatttcaaaataactagaagagaggacttgaaatgttcccagccaaaagaaatagtaaatgctcaaggtgatggataccgtaaataccctgacttgatcattacacatcctatgtatgtaacaaaacatcacatgtaccctgtaaatatgtagaaacattgtgtattacaaaaaaagcacagcttaaaattaatttagtactttgtagccataatagttacttgtcaaatgttcaaagctaactatgaaagactagtctagaagaacatcatggtgtgagttttaaataaattttgaaggaggaagagaatccagatttagagagaagagagcagagctcctctaagttgatatgggccagagtggtttcaggaggcaatgaatgagctttgaagtttgaaagaatcagaatgctattggtaatgatgaaatgttgaggcagtgacttggacttggataaagcttcttcattttttcaacatatttaagattaagtggttgtagaatattgtctttctttgctgtctttttccttagacctctgccctatgaggcgctcactcagctgatagatgaagccagtgaaggggatatgagcatttcaatccttacacaggtgagaagaattgtaaaggctaatctggtgactgatattttaaagtttgttttcaattgatctagcaatttccaaagacaacaaaataggcattgtgagacctaggccattatttttgtctatatctactctgtgtgcaggaaataatggtatatctagccatgtatatgcgaacccagcctggcctctttgctgaaatgtttcgacttcgaattggtctgatcatacaagttatggcaacagaactggcccactcccttcgatgctcaggtacttaattcagtaactattttaggtggaattcacttttgatgtaagtttatagagtttggaataaggaaagaaagaaagctaaaacatttttatccatagctcagaagctggatatggcaaccttgttcccctgttggtcactatttatgcaagtcaaggagctgatatgatgacacatttgtgtatcagttcgcagcttcagaatgccatctcctgtgggctcttcactccaaatccctcttgacttatcactcgttgctaacttcatttctctaactctggagagtatttgagtgtgacagacagagttgggttaagatttaggcagtggagcgtctgtacaccaagaatgagtcactacatcagtggatcatggtgtcagtattctgtctagtcaccatcatgactgaataaaggaagatgacattttcattaacatctatctgacaagactctctttgaaattaactataggtgtatttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaattgttttatacctaccatatgccagatactgtgctttttgctttaagtttacatatattgtgtcatttaatcctttcaagaatcctctggagaagaaggtattattgtgtcacttttaccaataaagaaactgaaactcaagaaggttaactaacttccccgaagcaacatagctagtaaatagtggaatttgagtctgagtccacctgattgcaaatgatttctagttcagtacattgttatagataaacattatatagtataatgttgtttttttttttgcgagagagtgtgattgctcaataataaacctcaataagggataagcccctgaatattcacttttccttaatttagcctgttatatttcttgttttcctgtggattcatgaaaaccatggctctttattccttataggataaagtcaagatccctgggtctgatgtttaataccctcaacagtctggcctttatcttctactcccacagtacttcccactaattttgtcagttccagtccttggagattgatgtctccattgatttcaaaggcaattattgtctatacctctcatttggcacatagaatatgcaatgttttattgtttatcttgttttcatgttccatcactcccaaagagatagtcagactcaagattaggtatcatgtcgtcatacctgcttgcacaaatgttacttaaaatgatgacctgcatgtagtctacttttaataaatgtgtgatgctgattaacatgttcaagttatcctcatatattcataatttcatggattcaaatctatctcttttaagtctctattatttccaggctgagaagttttaattattttagtttatctgcatatatacattcattgtctttctctgaatggcctccagttccattgttcttctttcattcttcccaccttcaaataaagattttactaagtaccctaatggtctggaagcagggtgaagaagaaatcaattacctcgctaatccacaaactggatagtcagtccttaaataattaagaatctatggaagtaagaatacctaagcagtagggtgctatcaatttattttgtaattctgttcttccaatcaagtgactcagaaattctaagcaagaaaagaaatagagaaaatatagagagggcatggcaggcaaattagaagtccttctgttctaacatttctgctgactagctgaggaagccacagagggcctgatgaatctcagtccttcggccatgaagaatctcctgcatcacattctcagcggcaaggagtttggagtggaacgaagcggtgagattgaataactgcattttcatttcatactgtttggtttaagtgtctcattggttttaaaatgtttttccttcatcacagaaacctttttccccaaataaataaactccaatatataaaacagaaaccaagctgtcttctggaacaagatttggaaaccactatatttttccttaaatggtatatcaactaagtggattgattactatcatgtttcatttttaactgtttaatgcattccctcacattatcttaagcctccactttaggacaactagcaacccatatcatctgaaactttcttgtattctaattggcaataattcagtagctcttacagtattgtattatgtgtatagctgcttacagtacttctaatgtaacccttcaactttaaactcacaaattaatagtccacctacatttgtggttttggttggatttggcattgcgtacctaaagcagcagagcaaatgaaaagtggtcatctctcatgctcaactttcaaggttagggtaagtagatatatatggtcagatggatggatgtcagaccttagagtggtaaaagaaagttgaaaagcagtgcgtttcaagaagggtatcttgctaaaatgcacattttgattcagtagatctggggtgggacctgagattctactaacaaacttgtaggtggtactgatgctgttggtccatggaccacatttcaaatagcaaggttatagtttttaaattaagttaaaaataaggatatatatgaaagttttttttaaatgtgatggggaagaaattgaaccttattatcctctctctttctctgtaatctctcatactacatagttcgtcccactgattcaaatgtcagtcctgctatttctatccacgagattggtgctgttggagcaaccaaaacagaacgaactgggatcatgcagttaaaaagtgagataaagcaggtaagatactacctgggagattagctgggatattgccatgtttcagaacattcttttggaatcagactttgttgggtcatttattttgtttcacattctgagtttaatttgagccatttatgtttcaggtggaatttcgtagactgtcaatctcagctgagagtcaggtgaaacaactagggatcatttaacatggtttaacttacctttagttctgtataacatgcatgagctcatggcctttttacaaataagataacaagtcatggagtagattgtttgaatcgcctttataacagtcattttgcagatagctttcctttttctggaccaaagtactttgttaattttagaaggaaagtaacttgcatctgataataagaaattgaagtttctcttattaggactgatgtaattttggaattaattttctttataaaacaagacttagacttcaagcaaagagtctttgcttggccagagtttaggtgggcttctcaaccttttcctaggcccatttgtgcacttccttgtaaaatccagctttagcaagagaaccctgctaagtcagtttagccagaaactcctatcctcgatatcttatcatccttgacatctgatcaggctcctcatcttctaccacccccaggtgatgtccaatcaccctggcctgtcttcagcaaaaatcctgttaagatggtttagccagaatcctccctacctctgatgtttccctcttagtaattttccaccacttggctataaattcccacttgattatgttgtattcagaggggagcccaatctctctcccttactgcaagacctcattgcaatggttctgtacctattaacaatggtcctgaataaagtcttccttaccgtgctttaacaagtatcattgaataattttttctttaacaagatgtagaaaaggtgctgtggacacagagggagaaacatctaaatcagtctgggagatagtgggagtcactaaataccatgttgtagcctcttaatttttcctgcaggtgagaatagagagcggttgctttatacaaggaaatagttaacaaaagcttccatagcttctttttaaaactctaggaagtcatgtggtttcaagatctccaagttgagaaattactgatttggcctctcctagaagcacattttatgaaaagcttaaaactactcctgttttcagaatagaattatgatagcttgcagtattgaaacccccagaagaggagtggtgaaatggaaatttggagttttgtttttagttttcgtttcttttttttagctttttagcactggggtctcactatgttgtccaggctggagtgcagtggctattaacaggcacaaaatcctggattcacgcaatcctcctacctcagtcaccagagtggctgggactaaggcatgccaccaccttgctatttggtttttttaaaaggaattagaaaccatttaggaagacaatgagccagtgcttgaagcttaatttgaggtaacttgagtacactcatcaaataccctatggcatttatatttatgcaagaataagtatgaaaatggagtaagaaagggccttgtattcactttacagttttctcgaataatttgaataatctgaatattttcctatttgaaacgtgaaagaactacattcagtactgaatagttagttacattggcattatctgtaaataatctttgatttggttgagagttattggataaacattttataattgttgatagtcactcagtattacttataagttcattatatatttacaacttgaagtacatgttcccagctacattaatatgatgttgagacttgatctacccagctacatcatttaagttttttctaaacattcactacctataggttttcaagggagccaaaatcactaggactataatttagaggattgagagtcctaaatttgcattactttcttatttctaaatattaacttccatcctcacctgcctgtctggtattttgtattgttctaagccattttttccctatcactcaagaatgccctcttttctgattatgaaaaaaaaaattataagggtatttttatttcttttcccttcaccatggcttctagggtaaagctatttcatcagctttttaatgattatgtgctgactacatactgaaatagtctgtatttttactccactagtgacttaaaagtacaaataattgtttcctggcctcatatcttttaaaattttattttctcaatttgttctcatagtccaatggtggtcatcccctgggtatagatttgatgtcaccgtcttttatggtaactgctgtgatcttctcgtatatgccattcacatgtgctttgaatatgctcttatataaatcatgacatatactggttgattaaaaaaaaaattaatcaagaattaaaataagtataaagcaatttcatatatgggggtgaatcttttcatttattttccaataacatagggaagggagttcaactccaacctctttgcgatttcagaaaacaaaattcaatttgctaagtattggttaagtataaattcttggtcccaccctaagtacacagagtcagaaagactgcggatgaggcccagtaatctgttttatttagatgattctgatgcatttttaagtttgaaagccactgggttagcttttcttctgattatgaattcatttagtaaatattaattgagtgccagttttgtgccaggcactgtgaacaaaatggatgtggtctttgccctcgtgaagcttacaatttaggaggactgacctctaattaaatttatttggtttaaatcaaagactcataatggcctatgatttcagatttctcaagctgaagagatttaggctagacaattaccaaacaaaaaatggaaaattattcgaaacaatattagtatttaggttaacctaaatcaaataccctgtaatgaactaataagacttggccaactctatcatatccacactaacataggacaggggtatagaagaaaatttaaaaactcaaaatgattgatatttggctttggaaaacagtctgaattgtactttatcagatctataccctttctggtttgacctcacaatcaacagcctaggatcttggtggtataaacaagacaatgaagataattaaatggcagttcatctactcaatagatcagtgcgatagtcacttgccagtagaaatgtttgggggctcttttcttttttacattgcattggttggtgatttaggcatttggcccaaattaaaacgtgagaagttattttctcagaaaatatttctattatcttctatcttatatttatttctgaatttaaactgttaaccactttgcccaatgtattttatcctttacttagtataagtttttcaaagttcattatgttttagcatgtatcaaaagtttatttttttcattgctgaataatatcctactaaattaatgtaccacattttatttatccattcatcagttgatggacacctggattgtttccactttttggctgctatgaataattctacaatgaaccttcatgcacaagtttttgtatggacatatgttttcacttctcttggatatatatctaggagtggaagtcctgggtcatatggtaactatgtgtcgcattctgaagaactgccagacatgtccaaaagggctgcaccattttacattcccaccagcagagtatgagagttccaatttctttacatcttcaccaacccttacaattgtcttttttattatagccatcctgatgggtgtgaactggtatctcgtagtggttttgatttgcattgccctaatagctaatgatactgagtgtcttttcatgtgcccaatggccatttgtttatcttctttagagaaatgtcaattcacatttgtacctattttaattttttttgtctttttattgttgagttgcaaggattctttatatattctggatacaagtcccttttaagatataaaatttgcaaatatttctcccatcctgtgggttgtcttttcactcaataccattaagtattcttcaaacaacaaaaatttttgatttccacaaagtccaatttgtctattttttcttttgttaatcatgatgtttttggtgtcatatctaagaaggctttgcctaacccaaggtcacaaagatttattcctatttgtgttctaagggttttatagagttagctgttttatttaggtctatgattatgtatggagggatccccaagatcaccctcagatttaatgattcactaggaagactcatagatctcagcatatagtcatactcactgctacggtttattacacctaaagggtacaagatgcattgggcacagtgtaactacagtcaacaataatttattgtacattttaaaataataaaaagtataattggattgtttgtaacacaaaggaaggataattgcttgagataatggataccccatttaccctgatgtggttattatgcattgtatgcctgtaacaaaatgtctcatatacctcataaatatataaacctactatgtacctacaaaagttaaaaaaaatttaaaagagtcattggtcaaagtctagggaaaacagacacaagcttccagagtactctgtcagtagagtcaccctgcaatgagttgtgacaagatgtcattgccaaccaaggaacctaataaagactcagcacccattgttcttgttgagggctggtcacgtaaacagcctctgtctggcgtgtatcaaaactctggactcccagaaagaaagcaaacgttcaacataaaccatagcgtttgtacagtttaggcatggtaagccactgttattagttctgggaatggtgagaactctcccagaatccaagtttctaagtttctaaatgccagccaagggccaaccttgtaagcaagcctttccaagaatagcagttctggcctactgtcttaactcttttctgcacaatgggcttaatttttgtgtgtggtataaggtagagttcaacttcattcttttgcatgtggatgtcactgttccagcaccatttgttgaaaaggctatttttccctcatttaattatcttggcgtccttgttgaaaattaattgaccaaaatataatggtttatttttgaactccctgttctattccatcgatctatatgtccatcctataccaatatgacacagttttgatagttttgtagttttgatagctttagagtaaattttgaaatcaggaagtgtgagctctccaacttcagtcttctttttaaatatgaatgttaggatcagcttgtcagtttctgcaaagatcccagctggtatgttgatagagattgtgttcagtctgtacatcagtttttgaaatattgccatcttaatgatgttaagtcttctgacccatgaatatggaactatatttcaatttatttaggtctttaatttttttcaacatgttttatagttttcagagtatttgttttggacttcttttgttaaatttattcctacatattttgttattcttaacgttattttttaatggaattgttttcttaattttattttaatattgttcattgctgctgtttacaaatacaactaatttttttattatagtaagacatttaacatgagatctatcctttaaaaaatttttaagtgtacaatatagtatcattaactataggcttgatgttgtacagtagatctctagaacgttttcatcttacataactgaaactttatacccattgaatagcaagttcccattttcccctctacccagcccctgacaactaccgttctactctctgcttctatgagtttggctgtttcagatacattacataactggaatcatacagaatttgttcttctgtgactggcttatttctcatagcatagtatcctgcaggttcatcgacactgtcatattttgcaaaatttccttcgtttttaaagtctgaataatattccattttatgtattaccagattttcttttgccattcagttgttaatatatatttaggttgttttcatatcttgactattgtgaataatgctgcatttgaacatgggcatgcaaatatctcttcaagattctgacttcaattcttttggataaatatccagaagtgggattgctgaatcatatggtagttctatttttaatttttgaggaacctccataatgtgttccatagcggctgcagcattttacattcccagcaacagtgtacaagggtcctaatgtcttcacattctcaccaatacctgttatctttgggtgtttttttaaccacggtcatcctaacaggtgtgaggtgatagctcattgtggtttgatccgcatttccatgatgattagtgatgttgagcatctttacatgtgtgtggtggctatttgtatatcatctttggtgaaatgtctactcaagtaaaatttaattgatttttgttattgatcttatatcatgaaacttcactgaactcatttattagttgtagttgcttgttagtgaattccttagaatttctatatacaagatcatgtcatctgcaaatagtttttacctcttcttttccaatctggatgccttttatttcttttcttacttaatctccctggttcaggccccccataaaatgttgaatacaagtgataagagtggacattcttgtcttgttctgatcttcggggggaagccttcagtcttcaaccactcattatgatgttagctgtgggttgttgtaggaaaaaaatctaaacttttattagattgaggaggttcccttctgttcctagtttgttgagtgtttttatcatgaaggtgtgtcgaattttgttatgtgtttttttctgtatctattaagatgatgcgttttttatcttttattctgttgatgtagtgtattacattaattgatgttcagatgttaaaacagccttgaatttctggaatcagtcccacttcatgttgtataatccttttagtatatcactgaatttggttttctagtatttcctggaggattttcgcatctatattcataaaggatattggactgtagttttctggtgacatctttgtctgattttggtatctgggtaatattggcctcatagaatgacttgggaagtgttcccttctcttttctggaagagattgtgaagagctagtaataattcctctttaaatgttttgtagaattaaccagttaatccatctgtgcatgggctttactactatgtgggaacgtttgtttatttgtttgtttgttcgtttgagacagagtctaacgatatcacccaaggtggtctcaaactccggggctcatgcaatccttccgcctcagcctcccgagtagctgggaatacaggcacaagccatatgcccatgcaccacgagccaagaacccatactttgaaggaagttttgtacttactaatttgatatatttgtttgtaatagttctattaagatgttatctttctttatgagttggtttgggtagtttgtgtctttctaggaatttgtctgtttcattgagattatgtaatttgtccgcatatggctgcggatggtatgcccttataatcctttttctttctgaaggtcagaattgaggtctttatttcccctttttttcttggtctttctatctaatgatttgtctattttgttgatattttcataggaaaaaattggggattcatatgctttccctattgtgtttctagtctctatttcatttctttccactctaatccttattatttccttccttctgcttgctttcaatttagcttgctcttctttctttattgtcttcaaatggaaagtttgtttattgatttgagacatttatcctttctttaatataggcatttataacataaattgttcgttaagtgctgttttagctgcatcccataagttttgctatgttgtgctttcgttttcattcatttcattattttctaattttgctagtgatttttttccttaatgcatttattatttagaagtgtgttaatttccacatttgtaaatttccttaatttatttcgattactgacttctgttgtggttagagaacatacttcgtatgatttcaattttaaatttattatggctcatcttatggcccatgagggcaacaaactaaaccatggacgagctagaagtttaacagagataatcaggtcaagagacagctaagaatgtcccaaatcatcagtatttttatgacttttctcatgtatcaccagattgctttcaaaaaggattgtaccagcgtacagcactgctagctacatataagtctactagcttcactataacctctttgtcttggctgcttcacttaatatttggtttataattctgcagagtaggtttattgttcactataaagttcaaagacttgggccgggtgtggtggctcacgcctgtaatcccagcactttgggaggcccaggcgggtggatcatgaggtcaggagatcaagaccatcctggctaacatggtgaaaccccgtctctactaaaaatacaaaaagttagccgagcatggtggcaggcgcctgtagtcctagctactcgggaggctgaggcaggagaatggcatgaacccgggaggcagagcttgcagtgagccgagattgcgccacgccactgcactccagcctgggcgacagagcgagactccatctcaaaaaaaaaaaaagttcaaagacttcatcatagaaacagagataacttttgatttatgttctttcctctcctcttccaagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaaggtgagcataatacattgttgatgtctcatttttgccccttgaaattctcagtctccttggcagagatatgacatgactaatataatcactgcaattatgtaaaagtcataactcagatagacaaaaccaagaagaaaacataaaaatgaaacagttgatttgttattgtggcattattaataatttagtctctttctattattgttgccatagtcttgtttctaaattagacttttaaaatcatcacctctctgcttctggccatagttggacattgtgatacatttgctgctaatcaaacgaatttgttactaaagagctaactttctttgtagctgtggagggttgtaaatgttatttgtagcaacgtgctatcagtagagtaaaacaaatgtatcagtagagtaaaaccaagtatcagtagagtaaaacaaatgcagtacttggggagtttgtgttaggagttattacctatattttttcttggatgaaaactactaaataaatgcaaagtcataatgatggtaatagttcggagactctttgatgtgaccaatatttatttttcttttgaaggcctatttggccaaagaaatttaagggcatgccacactattatggtggtgacagttttagagggccaagaacactattatgctcagcataggtctcattcatagtctcttaggtgccactttctgcatcactggctttaataaggacctgaagatcacttcatccaggacttaaaacccttcagttatgttttttcccctttgggcatggatattcttccaaggacagaatcaggtgatcttttggaaaggtaaaagttggttcctcagactatgggctctggcaatcttcctttaaagagtactgataacttgctttttttgcagctaacttctatagcacaatggtgacaaatattattttatctcttcagttatgcatggattatggcaatgttctatgtgctcatacagcaaagaacaaaacagataataatcttcattctccttgaacttatattctactagggaggaacaaattataaataataaacagtaaataagcaaagtatctagaatgttaaaagatgataagtactgtgtaaaaacaagaacagggtatgagtatttatgaagggatgggatgcttagctagcaaatgtagtaacagtacatgtccgataaatgcatgtcttgatttcattttcaaattaagactttatgttcaaagaaaagcacttaaaatttaaatgaaaatatattgttttaaatcattcataaaccaatatctctcatatacaacatgcagtgtacagtaattaaaattggcatttctgaaagctttgttataaagatatttagagttatacccagtaacagatagctttgttgaatactgtaatatggaacaatagccagttctataaatgactttaaaattctaaaactattggtgtgctaggaatgacaaatttgatttgtgtgaatactctttaaattctgtaaaggtttttttttctttttttttaattatactttaagttctagggtacatgagcacaatgtgcaagctcgttacataggtatacatgtgccatgctggcccactgcacccatcaacccgtcatttacattaggtatttctcccaatgctatccctcccctcgccccccaccccatgacagacctggtgtgtgatgttccccaccctgtgaccaagtgttctcattgttcagttcccacctatgactgagaacatgtggtgtttggttttctgtccttgtgatagtttgctcagaatgatggtctccagcttcgtctatgtccctgcaaaggacatgaactcatgcttttttatggctgcatagtattccatggtatatatgtgccacattttcttaatccagtctatcattgatgggcatttgcattggtcccaagtctttgctattgtgaatagtgccgcaataaacatacatgtgcatgtatctttatagtagcatgatttataatactttgggtatatacctagtaatgggattgctgggtcgaatggtatttctagttctagatccttgaggaatcaccacactgtcttccacaatggttgaactagtttacactcccaccaacagtgtaaaagcgttcctatttatccacatcctctccagcatttgttgtttcctgactttttaatgatcaccattctaactggtgtgagatggtatctcattgtggttttgatttgcatttctctgatgaccagttatgatgagcattttttcacatgtctgttgcctgcataaatgtcttcttttgagaagtgtctgttcatatcctttgcccactttttgatggggttgtttcattttttcttgtaaatttgtttaaattatttgtagattctggatattagccctttgtcagatgggtagattgcaaaaattttctcccattctgtaggttgcctgtgcactctgatggtagtttcctctgctatgcataagctctttagtttaattagatcccatttgtctatttaggcttttgttgcaattgcttttggtgttttagtgatgaagtccttgcacatgcctattgcctaggttttcttctagggcttttatggttttaggtctaacatttaagtctttaatccatcttgaattaatttttgtatgaggtgtaaagaagggatccagtttcagctttctacatatggctagccagttttcccagcaccatttattaaatagggaatcctttccccatttcttgtttttgtcaggtttgtcaaagatgagatggttgtaggtgtgtagtgttatttctgaggcctctcttctgtcccattggtctatatctctgttttggtaccagtaccatgctgttttggttactgtagccttgtagtatagtttgatgtcaggtagcgtgatgcctccagctttcttctttttcttaggattgacttggcaatgcgggctcttttttggttccatatgaactttaaagtagtttttttccaattctgtgaagaaagtcattggtagcttgatggggatggcattgaatctataaattatcttgagcagtatggccattttcatgatattggttcttcctatccatgagcatggaatgttcttccatttgtttgtgtcctctcttatttccttgagcagtggtttgtagttctccttgaagaggtccttcacatcccttgtacgttggattcttaggtattttattctctttgaagcaattgtgaatgggagttcactcatgatttggatctctgtttattattagtatataggaatgcttgtgaattttgcacattgattttgtatcctgagactttgctgaagttgcttattagcttaaggagattttgggctgagacgatggggttttctaaatatacaatcatgtcatgtgcaaacagggacaatttgacttcctcttttcctaattgaataccctttatttcttcctcttgtctgattgccctgtccagaacttccaacactatgttgaataggaatagtgagagagggcatccctgtcttgtgccagttttcaaaggcaatgcttccaatttttgcccattcagtatgatgttggctgtgggtttgtcttaaatagctcttattattttgagatatgttccatcaatacctaatttattgagagtttttagcatgaagggcttttgaattttgttgaaggccttttctgcatctattgagttaatcatgtggtttttgtcgatggttctgtttatgtgatggattacttttattgatttgcatatgttgaagcagccttgcatcccagggatgaagccgactcgatcatggttgataagctttttgatgtgctactggattcggtttgccagtattttactgaggattttcccattgatgttcatcagggatattggtctaacattctctttttttgttgtgtctctgccaggctttggtatcaggctgatgctggcctcataaactgaattagagaggattccgtctttctattgattggaatagtttcagaaggaatggtaccagctcctctctgtacctctggtagaattcggctgtgaatccctctggtcctggacttttttttggttggtaggctattaattattgcctcaatttcagaacctgttattggtctattcagagattcagtttcttcctggtttagtcttgagagggtgtgtgtgtccaggaatttatccatttcttctagattttctagtttatttgcatagaggtgtttatagtattctctgatggtattttgtatttctgtgggattggtggtgatatcccctttatcattttttattgtgtctatttgattcttctctcttttcttctttgttagtgtagctagcagtctatcaatttttttgatcttttcaaaaaaccagctcctggattcattgatcttttgaagggttttttgtgtctctgtctccttcaattctgctctgatcttagttatttcttaccttctgctagcttttgcatttgtttgctcttgtttctctagttcttttaattgtgatattagggtgtcaattttagatctttcctgctttctcttgtgggcatttagtgctataaatttccctctacacactgctttcaatgtccgagagattctggtatgttgtgtctttgttctcattggtttcaaagaacaccttcatttctgccgtcatttcgttatgtacccagtattcattcaggagcaggttgttcagtttccatgtagttgtgcagtattgagttagtttattaatcctgagttctaatttgattgcactgtggtctgagagacagtttgttgtgatttctgttttacatttgctgagaagtgctttacttccaactatatggtcaattttagaataagtgccatgtggtgctgacaagaatgtatattccgttggtttggggtggagagttctgtagatgtctattaggtgtgcttggtgcagagctgagttcaagtcctggatatccttgttaaccttctgtctcattgatctgtctaatattgacatggggtgttaaagtctgccattattattgtgtgggagtctgagtctctttctaggtctctaaggacttgctttatgaatctgagtgctcctgtattgggtgcatatatattaggatagttagctcttcttgttgaattgatccctttaccattatggaatggccttctttgtcttttttgatctttgttgctttaaagtctgttttatcagagactaggattgcaaaaccctgcttttttttgctttccatttgcttgggagatcttcttctatccctttattttgagcctatgtgtgtctctgcacaagagatgggtctcctgaatacagcacactgatgggtcttgactctttatccattttgccagtctgtgtcttttaattgcagcatttagcccattcacattaaggttaatattgttatgtgtaaatttgatcctgtcattacgatgttagctagtgattttgctcgttagttgatgcagtttcttcttagcattgatagtctttacaatttggcatgtttttgcagtggctggtaccggttgttcctttccatgtttattgcttccttcaggagctcttgtaaggcaggcctggtggtgacagaatctctcagcatttgcttgtctctaaaggattttatttctccttcacttatgaagcttagtttggctggatatgaaattctgcgttgaaatttcttttctttaagaatgttgaatatcggcccccactctcttctggcttgtagagtttctgccgagagatcagctcttagtttgatgggcttccctttgtgggtaacccatcctttctctctggctgcccttaatatttttttccttcatttcaacctgggtgaatctgacaattatgtgtcttggtgttgctctttttgagaagtatctttgtgttgttctctttatttcctgaatttgaatgttggcctgccttgctagtttggggaagttctcctggatagtatcctgcagagtgttttccaccttggttccattctccccgtcactttcaggtacaccaatcagacgtacgtttggtcttttcacatagtcccatatttcttggaggctttgttcgtttctttttacccttttttgtctacacttctcttctcgctttatttcattaattcagtcttcagtcactgatatcctttcttccgcttgattgagttggttactgaagcttgtgcgtgcgtcacgtagttcttgtgccgtggtttgcagctccatcaggtcacttaaggtcttctctccactgtttattctagttagccattcatctaatcttttttcaaggtttttaccttccttgtgatgggttcaaacatcctcctttagctcagagaagtttgttgttaccaaccttctgaagcctacttctgtcagcttgtcaaagtcattctccatccagctttgttccgttgttggtgaggagctgtgatcctttggaggagaagaggcgctctgggttttagaattttcagcttttctgctctggtttctccccatctttatggttttatctacctttggtctttgatgttggtgacctacagatggggttttggtgtggatgtcctttctgttgatgttgatgctattcctttctgtttgttagttttccttcttgcagtcaggtctctcagctgcaggtctgttggagtttgctggaggtcccctccagaccctctttgcctggttatcaccagcagaggctgcagaacagcaaatacttctgcctgatccttcctctggaagcttcgtctcagggggcccctgcctgtatgtggtgtcattcagcccctagtaggaggtgtctcccagttaagctacacgagggtcagggacccactagaggaggcagtctgtcctttctcagagctcaaacactgtgctgggagaaccactgctctcttgagagctgtcagacagggacgttcaagtctgcataagtttctgctgccttttgttcagctatgccctcccgctagaggtggaatgtacagaggcaacaggccttgctgagctgaggtgggctctacccagttcaagcttcccaggcagctttgtttacctactcacgcctcagcaatggcggacacccctccaccagccaggctgctgccttgcagttcgatctcagactgctgtgctagcagtgggcaaggctctgtgggcatgggacctggtgagccaggcatgggatataatctcctggtgtgctatttgctaagaccactggaaaagtgcagtatttgggcgggagtgtctctattttccaagtacagtctgtcacggcttcccttggctaggaaagggaaatcccccaaccccttgcgcttcccgggtgaggtgatgccccaccctgttttggcttgccctccgtgggctgcacccactgtccaaccagtcctaatgagatgaaccaggtacctcagttggaaatgcaaaaatcacctgtcttctgcattgatcacactgggagctgcagactggagctgttcctatttggccatcttgaaatggagacccaaggttttttataaacatcttttttattaatcaatcataacatggcaaaattgcacacttgccatttctgaaaagtgatccaaactctacatccacagatgaaaaattcttatagaattttgtgaaaagcatacattttgagttaaaaaaattttatagctgttggagtgccatgaaattaatacttgcattttggactgctgtagtttatactttttatatgtttcaaatcaggtgtgcaccatttgtacttagaacaccacaaaatgaagtatctaaaatcccttgattttaatatgtgttttggtttattaacaaatgatagtaatttcttacacatttttggaaattacttgtataagaatatatgcatctgcttatggatacagtgtgtaaataaaacttgtgctcaccaaactatcgcaaggacagaaaaccaaacaccgcgtgttctcactcataggtgggaattgaacaatgggaacacttggacacaggatggggaacatcacacactggggcctgtcatggggtggggggaggggggagggagagcattaggagatatacctaatgtaaatgacgagttaacgggtacagcacacccacatggcacatgtatacatatgtaacaaacctgcacgttgtgcacatgtaccctagaacttaaagtataataataaaaaaaaaacaagtgttaaaaaaaaaaggaaaacttttgctcactaaaatataagtaaataaataaatgcatgtcttgagttttttcctatggcctaaaattttttctaaggcctgtttgtgatggccgtgcgacctagtatgatatctttccagatagtctctgaatatttgggactagtctatcccaaaagatagagctttcctactcattccatttccctaagtagaggatgaaccttaggtctcctatagtccaatcctgcatcttggcacttaggcatcacaactccatggcaagggcacttggactgcagagccccttgctagtctgtgattactcagcatataccacatgaggcacacttagaaatacagcgtctcctcatagcctccccgttgtttgtctatccttggtgatatggtttttggtgatatggttttttttctgttttgcagtgtcacggactttctgttgaagggtttgtccttccttcctctaccactagagaggtaagagtctctttcttgcacatttatgtgactgataactttgctggctaaagtatcccagtgatcacttacttttcaaagtgacagatccatgcttttataaatcaactgaacatgaaatgcatttgaagaaaagacaatttttttaatggaaagagaatattatagaataagtatggattactttatatgaagacaaattcttttaatggttgattaagttaggccggcttatgtgagcgttgtgagggttagacaaggcagagggatcaaaatctatgaatgcatgacttctcatgtctcccgtccttcacattcctacctttctctagtaggatgtttgtagaccattagaacataaaccagtggttgttagctacaactatatgttggggtaacccgggttccaatttccaatttagtggattagaatctccagggatgggacgtgagcatctgtattttttttaatctatagaatgattctaatatataaccgtggttggaaaatattaccatgaaccacagacatagattatcagatgcttttatattttcctttttgtccaaactacacagaaattataaaaactagcttttacacagagtcaacaaaggagctagtgttagcatgattgaagtagtaagattcaatagtagaaagttctcaaaaatgctggggttgtttcagatagcatcttgggggacaggtacagaaagctaatgttatgcttcagggcttcactattgcctacaggccttttctctaatcaagaatgccatgtcccccatttgtcttttctctacctttacgcaagagtgaaatgttcatataattaataatacatacctgaatagtacctttaagagtcttcaaacattatttttacatttttaaatttggccttaaacaccattatgtaaaataggtaaagaaggaattatcattcctaatttatggataaggaaacaaatttagagattaattgtctaaggttgtataactagtaagtaacaaagataagacttgaacccaagtctttatactccaaatctacattgcctccctagaggatatactcaatacaagtttaccaaagtatacttctcaatccccttcaccccaaaataactttacatttcttaatgccctttttaatctaatagtatatggatgttttacataattctaatttttatgtattatacatacaattttaagttttacctcagtttttcctttatttacagtgatcagattttaataaacagtcatgtaaaaactcatgaagttgctatgccatgatatgccgttcccatgtttaggttacctctagttttacacttgtgactaaagctactataagtactcttctatatggagctttcttcctcttttgaattactatcttaggatgaactctcagaaataggattatgggttagagggcatggacactcttatagctcttgttatgcgttgccagattgccctccaaaaagattgaagcagtttactcactcagttattttgaagggggctgaatcaatgctcatggctacagtgtttttactgcctttcagagcaggtgattgatgtttcttggatgatggactcttaggaagtgattttctttttctctatcacagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacaggtaggcaaacctgttgttttctcaatagagaaatgtttttactccaacctgatgacattcagaggtctttgaggagccacggtcactttcttgtgccctcttcctcatacttcttttttgggccccctttgtagcggctctgagctctgtttgcaaaagaagtaggccgcaggaagacctctgtctttcaccatgtgtttttggtttgtgttagagggtaaagttgcctggaactcaggaggctttatgcttttccctgaaaggccctgaagcataccattagcatcatatttcaaatttctgatcacagtgctttttgtagctttaaggacttaataagaaactattggatggcatatcctttctgaactattgaggaaaagagatttggttttagttttactttgcttttgctattcacctataggaaaataagaaagtgaaacttttactcctacatttttcttattttcttaataaatcttcttccaggaaattatccacattcaaaaatacaaactattgaaagtgtcccaaatgttgcccgtattaacagtaggagcacataagtgaaggacaggcactgttggcagtaaaaaaattttcaaaacatataatagctgttttcattctgttagccactgggaggagatgcaaaagaaaaatatccagggctttctaagaagattctaattttaaaaattatggattgctgtcagtccatgtatctaaaaatgtgttcccttttaggcatagacctctagcctcagaaaacttagtctatttgaattaagtcgccttagaaagaaatcatgatcaaatgcaggataaaagaatacaagctgaaattagtagtactagaaggagtcagaccaaagctctactacggtgatttgtgttaacatttgtctattaataggtatgactcaatagatgaatgattatatttaacttttagaaattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 4730 - DNA, 135364 bp, human; identical to SEQ ID NO: 4728

SEQ ID NO: 4731 - DNA, 135503 bp, human
tcgcgcccgccccgcctcccgctcgcgtctcccgcaaggtggaggcggcgcagcggtcgttgacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccacatttcagactcgaaaggcttcagccaccgcttaccccttattcaagatagtatttgcaaagggcacaaagtttcagttataagatgagtaagttctggggatctgatgtacagcagcatggtgactgtagttaatcatactgtactgtatacttgaaatttactaagagagtagatcttaagtattctcaccacaccaaaaaaaaaggtagctgtgaggtaatagatgtgttaataaacgtcattttggtaattttccaatgaatacataaatcatcatgttgtactccctaaatatacacaatttttaatgtgttgaatatagctcagtaaagcttgggaaggtgggaagatagcatttgcctgcaataggtcagaagaagaggaggttataaaactcaagagtggagaagtagaagaaagaccaaagtccctaaaaaacccatttggaagattctgtttcctgatgttaacacctatggttaccttcctgccctctttttcttgaccttgcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcaggtactcaaaataaaaatacaaagagatctggagctatgtgtgattgggggttgggggcagagtggggactgaaggaagtgaaacccaccaaaagctaagagaactgtattttgcctttccctctttcatcatctttctgaaattatattccagaaagctttcctgtattgtactgaagtggtattcttgcagtggaaacttgaaacttgctgatttgagggagagggaacagtctgttctgttacagtggaaaatcctatcctgggatctttcctaaaatgcatgactctctaagttaatctatcttgtagtcaccactgtatttattctcattgagaaaatgtttgggagcaggtatctactattttatttcatttttaaaaattgtggtgtttgtatgagggtaaatgacatgaatcagcaaaccttctggactagacacagtaaagactttatctgttgatttttatagctgtggccactgtttcagagcctgttgcttcctccctcccccaactcctgggcaaaatgaggtcagagtcagcagatgcctttaagccaacttttaaggcacttcccctcagtaaaccagcatcctttatagaactgttgagacgcaaaggtagctgcatcctcttcaacgaccaagaaaataatattaagaaaacaatattctgggctatggtgggagttgaagtactctgttgtcagttataagatgcatgtgcattcatttccattagtgggaaaaattctctctataccagccattttctccagtggtctctccaagacttaggcaatctgagctccagtcttcatctataaatcagaatattgatatttggttattttacgagtatcaatataatgtggggttgcactgtgttgtccttagcaacagcaggcatttgttgttctttcaagccattattgagagatacataggtccaccaaaaaaaaaaaaattattcaagtttttgctccacaccaggtagtacagatcattatttttatgactttttttgttgttgttgagacggagtctcactctgtccccaggctggagtgcagtggcacgatctcagctcactgcaacctccacctcctgtgttcaagcgattctcctgcctcagcctcccgagtagctgggactacatgcgcgtgccaccacgcctggctaattttttgtatttttagtagagacggggtttcaccatgttagccaggatggtctcaatctcctgaccttgtgatctgcccgcctcggcctcccaaagcgctaggattacaggcgtgagccaccgcgcccagccttttatgacttttataaaaataccattgtagaaatttggaaaatatagaagagtgtttaaaaaaattcacctgtaatcctgcccactcccctcccccaaatcctacatcctactcaacgttttctagtttgagctcagtgttttgtttgttgctatttttactagaaattaatatcagtagaattggaatttcatatctggtacaatttgaccaattttttcaattctattagaagaaatctgttatctccctgtaatgttaacactttttcttatttggcccagttataaagaatttaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaataaaaaataaaaataaaaataaaaaaaaaaataaaaaaataaaaaataaagaatttaacagaggaagggggaatagtagggaaacattgaattgcccattctaaaattttaatattccattaaataatttttcacatagccaaaaaatacctttcataccaccttaatagtaattaggaatgtttcaaaacattatagcaatgggaaacatctttcaaaaagaaaagattttgtgggaatttttaaatttatatgaactttccttattaattgcaacaggtttttattattaggtctcaatttttttctcaaacctgattcagtgttaatcaaggaccagaaaatcatatctttttttgtcattagggttgtaggtcacatgtggtctctatctaactactcagctctgtgattgtggtgcaaatgcagccagagacaatgcagtcatccctcagtatatgtgcaggatggattccagtacaggctgcttataaccaaatctctgcatactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacaccagtctgttgattcatataatttctcttgaatctatcccctcttttctcttcccttctgcctcaaccttagtctaagcccttatttcctaacacttctgtgaaaaccacatttaaattatgttatttccatcctcgacaatctttctgtggccctcatttctccacaagtaaagtcgaaacattttggattgatagacaaggccctctatgggttggtcccagcttatttttttcaatattatatcacgctggtgccctccattatacccccagttccagccaggctgatgtctttattactcctctaatcccttaataaaaatacctaacatttgtataaatactttccattgtacaacacacttccccataattaccagtattttattctcacaataccctgtgaatcaagtattatcctcaatttccaagtgaagggactgaggcccagagatgaagctggaatttgatggtaccatgaatgcaacctgggtcttatgacttcggaatcagtattgtttgaatttttgcctccgtgggagccatagacattgccacctgcaaaaatttttatgggcttcttcttctacctgcctattccctttcaatctaaactaatatcctttgaaagcctagcaccaatcccactttttctgtggtccctgtccttcctcacagaccactcacttgtacagtgatcacttctttctcaggactcctttcttggaacttctagatcacttaccatctgtgccattcaacatcttcatttttttaaatttaaaagactgtgtaatcatcatgtgccaggccctataatagatgttaaaaagaaaatggtacaaaatgtttatatgtaaccctcaacttttttttatggaaaatttcaaacttacaggaaagttgcaagaatagtaaaataaacatatttgcatatactctatctaaattcgctagttgttaacactttgtcatatttgcgtacccacccctccacacacacacacacacacacacacacacacacacacgattttttgataagccttttgagagttacttgcagacatgagtttgttttttaattcaacttccttcgtccattgacttgaaggtctttttctgaacctggcctctgcccctttttctcagggagttcattgtctgatgggggagacagatatataagcaagtagttacagtacattaagataggtactataggtactgatttatatatttgagataactactaagctctgtgggaacacacagaggtgggaatgtctaaacttctttgggacgaggcaaggaagacttcagagaggagttgggttttaaaggataattaggaaatgctgggtagactatgctgtagttagtttttaaaacatatctgtcccatttcccttttctttatgttctacaaaacctgatagaggttcaataaatatctgattgcacatatacctgggggtagagagaaagaggtacacagatatggttgtgtagttatatattcttataaagtcagttcacagatatatattgatttatgtcgtcaaaaagaataggcaagagggagagtcacttggtatggggtagaagccctgatgtatgaatgtacatgtataattaatgccatctagcacacctggatcagaaaacagttagtttggggaacacagagtacagatacctcccatcattcctacctcccgatacttcctactaattttatcttgccttggaaattagaacttgaggatagaaatggctgacaatggccactaattgagatcctccactgagtccttgattccccagatttgctgtttaaagaaaatttagatgggagtagtggggctagagggtaaagggagttgatgggtttgcaagagaaaagatgactaaggcagtaaaatagtgaagaagccaatgacatgagcccaggattcttacagaatagtataaatgctgagttctatattggtcgactagaggcccttaatatgtttttttaaaatgagttcctttaggccattgatataaagacaagactattcaagcccctccctctgcttcccattctaattcattgacttttagaaaagacagaatatggtagaaacctttgagtatgtggtgacatgtatcagaattgaataaagtttccccacagaagaggttgtgttaaatactttccataacaggtatattaaagagatggactctttcattagcatcaaagtcatatagatgtcttcttgtaggggttacagtaagtttccttgctttataataaatgtttcaggctttaaaatgtgacaagatcatgcactgcctattctttctctctttttaaaatttcttcttttgatctgtaaggggaggggaccatttatagacagaaatgacttaagaaaggggactctcccacagaaaccatttttattcttatttttccctcaataaaaggcttcataaagagttggaacttaataggtacttatccttatcatgactattgcttgtagtcccatttgaatatgttttgaagaaataacagaatcatgtggcttccaagtagattagttttcagaggtgtcctgaagttacctctgagccagcataccctggagtaacctggttggatttcttttggactgtgaaacagaaagctttttggagaaatagagaaactgttcagtgctatgttcttccaaaacacatttctacccatgccacgattgatgggccctttagtgtcatgtagtatatagttggtgatcagaattttgagatgttatgattggaaaacaaactactttaaattatcaagccccagtaagagaaatagtgatgacttgaaacttaagaatttgtgactttctttcaaggaaaacgggttgagtcaaatgaacagatcccctttatacttattctttattaaaattcactttattctttagaggacatgtccagataaatatttctgtggactcttgaagataagtcttggctagcttagaaaaaatgaaagcaatgttgtagtgaagtctttctaggccataggatgtattttagaatatcctcagagccttaggatttttgagctgacttgcccctttctccaggtggaatgtcctctaataggatggttggcttatttttacataaaccagttgaagcttggatgatttttttgacttgaaggaatcataaagtgtagcttttgattccacttttagctgtaatctgctcttctgtgtaccaataaagtaaatgtcatgtaaataggaacacaggatagggttacttgttctcaaaaggtcatgtaccatctgcagttgctgagtaagtgttcctgtatctagggatgtttataactgtcttgtttccatttatttctgcagagtgtagtgaagctgatgagaggactactgcactgcatgatcagacaggtatggtattgataacaccttcctctctaataaaagcacattgtaatagtatctctaccctttagggaatgtttatagcttatattttctttcagtttcacaaatagtacacactaattttagaaaattttgaaaattggagagggataatgtcacccataatctcacaatgtaattaccactggaatgtttctttccagtcttttttgaccctctacaaatgattttcaatgtgtttcatcattactgtacatgcaattgtgtatgtagggtgaaaagatgatacaggtttaaaaaccctcatttgaccaggcactggtggctcatgcctgtaatcccggcattctgggaggccaaggcggatggattgcttgagtccataagttcgagaccagcctgggcaacatggcgaagcgttgtctctacaaaaaatataaaaattagccgcgcatggttgtgtgttcctgtagtcccagctacttggggttagcgggggtgaagtgggaggatcacttgagcctgggaggtcaaggctgcagtgagccaagatggtgccactgcactccagcctgaaacccagtctcaaaaacaagtaaacaaaatgcacacacacacacacacatgcacatacacaaaaccctcatttgaaacccttggggccatcaactttagaatttaaagtttttcagattttaaaaaggcagtacagtgcatactcctgccaacctttaattatatggtgtatggtatatatacaccatatattaccttatgccttctgcgggtctagaacagcactctataatcagaaacattaatatctctgtagggaaacatgcaatttcatactaagtagaataaataaagacttaatttgaatctggtgttgccaacaaatgaattttaatgcaaaatttaggggaaaagccttttcaaagtgtttcagattttaagattggagataagaaaccttgaatttgcatctccttgcagtaatttgcattttcctgacctccagtgaagttgagcatccttttatgtgtagattgaaaatttgcatttcctcatggatgaattgtctgctaagtcctttgcctatcatctaggttctctttcctgcctgttgaaaagttattgtacattatagacattagtcctttgtcatatgcattgcgaattttttagcagtctatcatttatttttgaggcttgtttgtgatatttttgcatacaagagtgtttttactttaaaaaattgttttatcctaggagatcttaaagcattttgcccacactcaatcttacctgtcttttctgaagatcaagattgtgttttattagaagaagaaattgaggcccggattgctaaagtgactgcctacaggcacagaagtctatagtagaaggaaatatatagtagatagaaagtagtacatagaaatatatgatagatagaaagtctttgctactttattttgtattttagatatttgcactttcgtttttttctttttagataggggtctcactttgtcgctcaggctggagtgcagtgatatgatcatagctcactcactgcagccttggcctctgggctcaagtgatccccccacctcagcctcccgcatcactgggactacaggtgtgcaccaccatgccttgctaattaaaaatttttttttgtagggatggaatctcactatgttgcccaggctggtctcaaactcctgggctcaagcgatcctcccaccttggcctcctaaaatgccaggattataggcatgagccaccttgcctggccaatatttgaactttttaccttaccaaataggtttaaggtcactaatttcaggaaccaaatttaaggtataacggttactgtcatacatcagaggcattaattatcaaatttaaatttcaggaactaagtctttcagttgtcctttgcacaatatttccttctgacttctagttttagctttctgttttgaacccaggaaatctgagacagatctcagttaatttagaaagtttattttgccaaggttgaggacccacccatgacacagcctcaggaggtcttgaagacatgtgcccagggtgattggggcacaacttagttttatacattttagggagacatgagacatcaatcaatatatgtaagaagtatagtatattagttccatccagaaagggtgagacaactgaaagcaaggcctccctccactatgggcttccaggtcacaggtaggtaagagacagatggttgcattctcttgagtttctgataagtctttccaaaggaggcaatcagaatatgcatctatctctgtgatcagagggatgactttgaatagaatgggaggcggattttccctgaccagttcccagcttgtaggggcccaagttattttcctttcacatccccccacctttgttttttcaaatcttttggagaaagcattttacaagaaaatgaatctctgatctcaggtttcgcctgatctctcatgagtaggacagtttatttctagatgggtaggtcccaaaagctcatttttagcaggttgtgaagtctcatatcctgtgaagagaaaatggggggaggtaagggagaaaaaacaataacaaacaaaagaacaatcctggaaaaatcagtataggccctattactctgaagtccatacattattaggcaggtatgaaagtggcttatgaatgtaaataggttactgttgttttttgagatgaagcctctttctgtcacccaggctggagtgcagtggtgtgatctcggctcactgcaacctccgcctcccgggttcaagtgatcctcctgccttagcctcctgagtagctgggattacagatgtgcgccaccacactcggctaatttttgtatgtttttagtagatatggggtttcaccatgttggccaggctggtctcaaactcctgacctcaagtgatccaccagcctcggcctcccaaagtgctgggattacaggcataacccaccgtgctggccaattactgttatttttttctgaagtttgagttgtctggcttcagttcccagggttttaagaaagcacagctgagttttcagggactccaaattaggaaaaatgggggaaaaaaaggaaggaaaaagttgaaaacattattttgaagacttgtagccaaaaaaaattagaattccatccaaactgtagaaactaataaaaattgaaacaaaaattaggcaagactagaatctaacaatgggtgtcctatcgttttgaaatataattttttctctctccggtttccccttttactaaagacaaatcatggtaggactggtttgcttattatacttggcctaattatttgtatacagtgcagcaagaataattattttttacataggcttttaaatgggctttgatggaattttgttccataggaggaatctcagataagatttttttcttgagatggagtcttgctctgtcacccaggctagagtgcagtggcacgatctcagctcactgcaacctccacctcctgggttcaagtgattctcctgcctcagcctcccgaggagctggggttacaggcgcccaccactgtgcccggctaatttttgtatttttagtagggacggtgtttcaccatgttggccaggctggtctcgaactcctgacctcatgatccacctgcctcagcctcccaaaatgctgtgattataggcgtgagccaccacacccagccattagttaagacttcttgaaagccgagcccagccatgaatttatgccatcaaatatctatgagttgtttgaatttctcctcctcttggggttccaagataaacctgaggcttctgtgcctgtcggaaagtgacattctttacttaccaagggtcagaaaccctatatgtggtctgtgtacatgaaatatgaggccagtttttccaagggctttattggcttcacaagtcaagtttgattctttaaaggaaagcacaccattccagtcaaagccttggtaaaattaccagtttctccaactgtgtcccgttacaaatgaaaacagattcttattgcacttacgcaaataactgtattgccataagttaagaatactcacaaatagtttccaaattctagagaaaatcaggtagagagaaataaatatgctccaaatcttttttatggcagtatactaaattgttaaaagctgtcagtagctcaaaagaaaagttttaagtatctgaaaaacaaaacaaaggatcagcaaacattttaagcaaaaagtccaaaaaattagttcagtccatgcagttatttcttgttctgcttgatattcatgaacattttagttctccatgagtcctggaaatttttcctctattctgatgtcacaatcttcaaaagttatcagaaacctgcatttaagagcacctattggaattttatagctgattataaaaccgtcttctaaaaaggaccaaaacaagacaacaattgtccatggatgaaaaaaaagttttaaggcagccataatcaaaagacacaattgacaaagaaatttgttacctctgtggcacacaataattttaacataacaattaggaatattactgataatgtacactaagttatatcagaatttcaggagtttctcataattttggaacacataccaataacatatttatacaaatacagcccaaagaaaaccaaacaacatttcatatttgacagtgcttcctgtataatttttataccaaataagccaaattatgacatttttggacttcagggaacctaatgtcttaaaggattaattaggttagaaaaagacataatttataatttgattttggaaaatttgtcaaatataaaagtttgaaatgcttgatattacaaaagaatattacaggtcattgtttaaccaaagtgataattcaaggacttcaaaaaaagtgaaaaccttaattctttgagagaagagacttaattttctaaacaagaagccctaataaaaacagcatgaagccaattacatttgtttttcaaaattttgtaaacaatctataaagtttaaccttgattataaaatataacttccataaggcttttataacctttattaaggagttggaggagttggttaatgctttaagaaaaacctgttaatctgacacaggggtccatatactggttttgcatcagtgtgcctttcatactaatgattaatttatagagaaactgaacttattttatctttaaaaattggcctttacaatctgtgcactgtcttcttccacgatagtccctggctcatgaggaatcaaatagctttaattgttttttgccctgtatttcaggaatgcagcttattttgattggcatcttccatggggcctgaagatgaggctttaattgctgttagtgtttaagatttagcaggacttgatgtcctttttagacccaggagttaaagccctctaactcaatgtcacaaggactttaaaagcccatataggaagatacatggatgtaataaccttagtttaaaaaaatttttttttgttaatctcagtttttttcctaagcaaaaccaaaacttaataataatatttggactttctggtttgtcctgaacatccctctttttttttttttttttttttttttgagatggagtcttgctctgtggccaggctagagtgcagtggcgcgatctcggctcactgcaacctccacctcctgggttcaagcaattctcctgcctcagcctcctgagtagctgggactacaggcaagcacgccaccacacccagctaatttttttttgtatttttagtagagacagggtttcaccatgttggccaggatggtctcaatctcttgaccccctccacctgcctcggcctcccagagtgctggtattacaggcatgagccactgcgcctggcctctttattcttataactttctttacatctccttttgtttcctggttgtttttaccttgttttatacataacctttaaataagctttgaattagacaaaacttgttcaccttttattttttagcaagaatgttttcctacaatatatatttattggaaaatacccaaataattaaatatctattatttaatataactttatatcctaaattatgaccagtttttctgcaagtacttatcctattacatttacgtaattattttaattgttttaccctgattatttatgaaaactgtgatagtcgtgatttaaagttatgaaactgccattgaaaattatgactgagacagtgaaaaaagatttgacctaactgactccatcttgctcttagccccaagccgtccttgttcactcctgggcataggccaaactaactttgggaggaatttagcttatagattagctttgaaacaaagagaataacagtcctttcccaaaacaaacctccttattgtctgtgcatactgcctaaagccacaagattcgaagttacggtaatattactaaattcaagatgcagctattttcattaagcccatatcaatgtcttatttattaaaaattacacaagcaaagaatcgttctgttttgggctgggcttatagtttgtaacccctatgccaaattttgacacctgatagtatttggcagggataagtatgaaattgcttgattcataaatgtaaaacaaaagaatgtatactggcaaatcttaagacatttctaatgttactttaccaaataattttaaaactagcttatttattacagattttacttaagttacataaacttcaaaaagcatttgacaattcttttttagtatctgatttaaatgcttttatttttctttaagccaattaattagatctcttatatatgtttagtagtgaaacagtgtgtacacaacacataattacatataaggacacattaggcatgccaatggatttataaagaccccctcttttttttttcttagattttcatattcttgataacctgtttcacaaccctacacagttgtcagctaaacagctttaaatttgcacattgaaggaaacagttcaggtgaaatcaaatagcaaaatttacatcataatgtacagagagaaaggtctggtggtgcagaactacagggagatgcttttacagtgcacttaaaaaaaatttttttttttttgagacagagtctcgctctgtcacccaggctggagtgcagtggcgcagtctcggctcattgtaacctccacctcccaggttcacgccattctcctgcctcagcctcccgagtagctgggactacaggcacccgccaccatgcccggctaagtttttgtatttttagtagagacagggtttcaccgtgttagccaggatggtctcgatctcctgacctcgtgatccacccgcctccgtctcccaaagtgctggtattacaggcgtgagccaccgcacccggccaaaatttttttaaacaaagacatttctgagtgtcttccttaaaaacccaagtgtagcctctgttgcgataactattttagtcaaaaaatcaggtgaaaacagaattcagtcaactgagaagaaaaaaaaaaaaacttttgctcaaaaaaaagacaaggtcttaggagaccttgtttttttttctcaaagaaaatcaacctcaaaacatgaaggccttttaaatacaaacatgcccacatgcacacatatacacacacatcttggatgttaaccttttaattaagccgacttttaaccattgagctcttttaaaaaaaatcttttaaaatcttattactgtatttcagctaggacaaaatgctgctaaactaacaatcatcacacaaattctatgatttctgagcactctaagtgtaagcagaatttaacaccagctggttgttaatgctaacttcagtcatttaaaaagaattttcaagacagaatcccaaaccagtttcttacataatgatgggtctcaggctgtagactgctctctacggtcctagaaacaggaaaaacaaaaacaaaactcatcttccccgttagaagcgtgttcaaactccataaaggagttacctgccttccatcgacatggaggcaggaaaacttgctttccttgtgttggaagcaagtaaaactccaaaaaaagaggagttgtaacagcaaaataagctttagatctcaaccaaattttgagagatcagggattctgttgagggggtgctctcaggcctcagcaaattgtcctgttggtttgagccatcaagttagctcatgctggtaccaagcaccaacaggagatttgtcaaaggtcaggggcatctccactcagaatccaccccaccttgaggttaccaaaatgtgaaccctgaaaatctgagacaggtctcagttaatttagcaagtttattttgccaaagttgaagatgcgcccatgacacagcttcaggaggtcctgaggacctgtgcccaaaatagttggggcacagcttggttttatacatttttgagagacatgagacatcaatcaatatatgtaagaagtacattagttcagaaaagctgagacaactcaaagcaacgccccacaactgggggcttccaggtcacaggttggtgagagacagatggttgcattctcttgagtttttggtaagtctttccaaaggaggcaatcagaatatgcatctgtctctgtgagcagagggatgactttgaatagaatgggaggcagattttccctgagcaattcttagcttgaaggggcccaagatattttcctttcagactgtcatacctttactccctcactctatgtgtctctcagcagctcttttcattactccttcaaaatatatcctcttattctaatttacttcgaaatttctacctcagtttcaggaacaaatgtatcttttcacattcagttacctcttactaagctgttctcactcaagcactctgaatctcagtttatctacaatgtgcagtgtggcaaagcaaccatatgaagagtaaacaagaggcaatgaataggaaagagctgtttttgactatttggtattattttctgattaaatcacctaaattgaaaaacaacaataacagactttccagttatattagtgcagggaaaaacaggtaacgagtattttaaatattcacaattgcctgaagatagtgtatcttcacattgcaataatgtatgttagagtattacagaagtgtggcatatgggttgatttttcagtatatccttcttttaatgtttttgttcttttcaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggtcagtacaaggagagaagtgctgggagcccctgagcatggagtctggggtactaattaatattcttttaaattgagaaccgggaaggctggggtagatcttcatgaaacaggtattttttattatttattaattctcagatatcatgagatggcaaagaagggctaggtttcattgcttgttctcattacagtacattgacaagcctgccagttagtataaatacaaactcaatcacctactttatgctactctttatgaatatattataaacaaggcatctgtctataggcatctaaattatattaagaaaattaacttaggaatcagaatccaaattttttaattattgaatactatatccttttcagatggttctcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactagttaggaagttagtgaaatactttaaggcaagattgattcagaatttatgtaaggcagttaccttgagaatgaaagggcatatgtgagatttaagtggtagtatgcaagatcttcacagagtatttagcaatgctctacacatttttgaatacacaaatctccaccttggttaaaagagaggcttagacagaacttgactgcaacttacagaatgggggcaggaggggctccatggaacctcccccagcaaaacaaccataaatgttgaaaattattttttaaaaaccagccactacattattggaaattgtctgaaggacatacagcaggtagagaaacatttactccaggaaatctaccaagtattggtaaaagcagtgagggagtgtggcatttgagtctaaatctactcccccctccaccccacctcagcatggcagaagcaatattcaaggcgggtacaaccaagagcacaatctccccagctagttcccagtttagggacactgtatctctctgagggaggtaaggagatacatcctctccagctccatgttgcaaaagctagttcaggcaagaatagctgacaggcctggagttcccctcctccccaggaaaaggcagggtgagaatgctaggccctgattaaccttggcccacttcactattagggtggaggttccccactgggaggggcaaactaagaagatcaaaggctaccatcccttcccagcactcaatttgtaaagcaggggtgtcactccaaaagaagtgggccactgttctcaccactagctctggagcactggcacggaaattttgctggggagagaggcaggctgtaaggacacaaagctctgtagcttttcccaaaggaattgactttatttaacagagtgtggaaaagttaaagcctaaaggcaatctcaaaaaacaatggagatttgggttctaagcaattaagaggaggctagtagctcaataagagcaagaagctaaaccatatactagctcaatggcacatggaacatttttcaggatagattatatggtataccataaaactagcctcaataaatttgaaagatttcaaaatcacacaaagtatgttctatgaccaaaatggaatgaaattaggaacagaaagaaacctaggaatctcacaaatatatggaaattaagcaatacacacctaaatgaccaatgagtcaaattgagaaaatactttgagctaaatgaaaaagaaaatacaacataccaaaacttataggaagcagagaaaacagtgcttagagggaagtttatacctgtaaacaccaatgtaaaaaaaaaaaaaagaaagaaaaatcagtaacctaacctcccaccttaaggcactggaaaaagacaagcaaactaaacccaaagcaaagagaaaggatgaagtaataaacattacagcagaaattaatgaaacagaaaatggaaaaaacaatagagaaaatcaacaaaaccaaaagttcattctttaaaaagatcaacaaaattgataaatctttagctacattgaccaagagaaaaagagaggatactcaaattactaaaactaggaataaaagaggggacatcactacaaccttacaaaaatataaagaactaaaggggaatactatggacaactggttaccaaaaattagataattttgatgaaatgggaaaatttcttgaaagataaactactgaatctgactcaagaagcaaaggaaatctgagtagacttactacaatcgaagagaattagtaatataaaatctttccacagagaagtaagcccgggtgcagatagctttactgataaatctaccaaataaagaagagtgaacaccaattatttacaaacacttccaaaaatagaagaggtgacacttgcaacctcattctgtgaagccattactctgatgctaaaaccagacaaagatatcacaacaaagtacaattatagatcaatatctcttattaatatagacataaaaataaacaaaatactaggtaactgaatccagcaatatattaacaagtttatataccttgaccaaaccatatatattccaggaatgcaaggttgttttattatctgaaaattaatgcaatacatcatgtcagtggaataaaggacaaagatatattattgtctcagtagacacagaaaaacatttgacaaattcaacaccttatcatgataaatacttaccaaataaggaatagaggagaattttttcaacctgataaatggcatctttgaaaatccacagctaacatgacatttgatggtgaaagaatgaatgcttttccccatagatcagaataagacaaggacatcaactcttgccaccagtatctaaaattgtactggcagtttagcaagggcaaatagccaataaaaagaaataaaaggcatcaaataaatgaaggagtataattatctccatttgcagatgatacgttcttacatagagaaatcctaaggaattcattaaaactctagaataaacaaagttcagcaaggtaacaacgtacaagataaaaatgcaaaaatgagttatgtttctaaacagtagcagtgaataaccaaaatgaaatttaaaaataatttctattacaataggatcaaaaatgaaataatgaggaataaatttaacagaagaaatataaaatttgtactttgaaagatatgaaacattgttgaaagaaagtaaatatctaaataaatggaaagacatctatattcaaggatcagaagatttattgttaatgtggcaacatttcccaaattaatctacagatttaacatcaactgactttgcagaaattgacaggctgtttctaaaatttatatggaaatttaaaggacccagaagagctaaaacaatcttaaaaaagaagaaagttgaaggactcaaatttcctaatttcaaaacttactacaaagctatattaattaaaacagtacaggtactggcataactatagacatgtagctctttggaatagaattgagaggttagaaataagccatcactttatgctcagttgatttttgacaaaggtgccaagataattcaatggggaaagaatagtctcttcaacaaatggtgctgggacaactgtatgtccacatgcaaaagaatgaaattggacttcttcctcacaccatatataaaaattaactcaaggctgggcgcggtggcccatgcctgtaatcccagcactttgggaggctgaggtggcaggatcacttaaagtcaggagtttgagaccagcctggccaacatggcaaaaccccgtctctactaagaatacaaaaattagccaggcgtggtggtgtgttcctgtaatcccaactactcaggaggctgaggcaggagaatcgcttgaacccgggaggcggaggttgcagtgagccaagatcacgccattgcactccagcctgggcaacagaatgagactccatctcaaacaaacaaacaaaaaaagaaattaaatttaaaaaattaactcaaaataaattgtaggcctaaatgtaagaaggaaaactaaaacactatattagtctgccacaacagaataccacagaataggtggcttaaacaacagaaatttattttctcacagttctggaggctggaagtccaagagcaaggctggtagggttggtttctggtgaggcctcatcttgcctttcagatggctaccctttctgtgtttttacatggccttttctctatgtgtgtgcactcctggtgtgtcttcctcttcttataaggacggcagccctattgggttagggccaccctcatgacctcatttatcttcttaattatctccttgaagtccctatctccaaatatagtcatattaggggttagggcttcaatatacaaatttttggggggaggacacaattcaatacataacaaacacttagagaaaaatacaggagtaaatgtttctggccttgggttaagaaaaagcctcttagatatggcacgaaaagcataagctactgaagaaaaaatagataaactggaatgtatcaaaattaagaacttttgtgcttcaaaggaccccatcaagaaactaaaaaagcaaccaatagtatagaagaaaatattcacaagtcatatatctgataaggtacctgtatctaaaagaactcgcagaacttaatataaaagataaataacctaattaaaaatggtcaaagaatcagaattgacattcctccaaaaagatgttcagataaccaataagtacatgaaaggatagtgaacatcattaattttgaaagaaatataggtccaaaccacaatgagataccacttcacacccatcaggatgactgtaatcaaaaagacagataataagtgttgctgaggatgtggagaaattggaaccctcatacactgctggtggaaatgtaaaatggtgcggctgccttggaaaagagtctggtagttccttaaaaggcttaaaaaagagataccatatgatctagcagtttcactcctaagtatatatatacccaagagaaatgaaaacatatgttcactcaaaagcttatacattaatgtttatagcagcattacttatgatagccataaatgaaaataacccaaatgtttatcaactgataattggataaataaaatatgatacatctgcacaatggaatttttaaattttttttcatgttactgctacctctcaagatggaatattttgggcaataaaaaatgaattacaggtacatgccacaacactgacaaaccttgaaaatattatgctaagtgaaagaacccagacataaaaggccacatattgtatgattccatttatatgaatgtcaactaaggcaaatcatagagacaagaagtagattagtgattacttaggctggggggcaactgtagaagggaagtggggagtgactgctaaggggcacaaggtttcttttggagtgatgacagtgttctaaaattgattgtggtgatggtcgcataactgtgcatacactaaaaaccgttgaatatatacttcttatgcatgctttttacatatctcaataaggttgtttctaaaaatgagagaaagaggcttaatgttatacagatgagtgcagaatataagtgcaatagaccactgatttagctccatttctggagccctgtatgccttagtattctttatatagtcacctttggtctaatccagccctatctcattttatgtgtactcacctctgcattctttgttcgacaagcagtgtctgggctctacaggaggcacaggatccagaggtcctccatttatgacctttcctcaagaggctgatccctttcctgtggttaacagaggtgtttaaaatcacttaataaattttcaaacatctactgttcaatgctatttaataccgttcagaatactacgtgagatacttttagtggctatgtgagataattttagaagatgcagatataaataagatgtagttctttccttaaaattcaagtacacatttgtctataatacagagtaaaaaaataagttcataaaagtaagaaaaacaaaattctgtgaatcacaaaataggagaatcaatgatagcatcacagaggacatagcatttgagctgagccttgaaagaacagtaggatttcaagatctggagagaagaaggccatttaaatggagaatataacaagcaaaaggacataaatggtagaaatgtctggcatttgtatgatatagctgtgatgcaagtctaacagatgaataataccagtttcatacttttgccttctctgtctctgctcaatcgcattgtcacacaaagatgacaagataaagctatgaagctgatgtcccatgtcactatcatctcttctctttaccggcgtctttccaagaagttagtgtcattacgattgcaagaaaaaacacactttgccactttgcttctgcagcttccctgtgctatggatgctattttgacagagccatggatcaggaggagtttgcaatctgataataccaatcatatagttctttttaattataaagttacacagttccatgatttaaaatatatgttaatagatcaaagatttagatgtggccaggcgcagtggctcaaacctgtaatcccagcactttgggaggcttaggcgggcggatcacaaggtcaggagttcaagaccagcctggccaacatggtgaaaccccttctttactaaacatacaaaaaaattagccgggcatggtggtgggtgcctgtaatcccagctactcaggaggctgagacaggagaatcacatgaacctaggaggcagaggttgcagtaagccaggatcatgccacagcactccagcctgggcaacagagcgagactctgtctcaaaaaaaaaaaaaaagtttctgataataaaaaaatactataaacaagtccaaattccaacaaactagcaaaaatacttgcaacacatatgatgtgcaacggactaatttccttaatatttgttaaaatatcaataatagagaaagaagttttttttaaagtttaatgctgagcaaatacacacacacaaacacacacacacagtatgtttgtgtgaaccacagaaaaggggaagcaatgacagcatcacagaggagatagcatttgagctggaacttgaaagaacagtgagatttcaagatatgggaaggaagggaaggccatatgaatggagattatgagcaaaaggacataagtggtagaaatatgtggcatttgtatggtatggctgtgatacaaatctaagagatgaataaggccagtttcatacttctgccttctctcagcctctgatttctattgaattgccagtctttctggcaatatatacttacaatgcatactttttatgtatctcaataaagtttttaaaaatgacagagaatgaggcttaatattatacagatggtgcatgtatatatatgtatataccaagaccatacatatgccattttatatatatatactaagaccatacatatgcaaagactggtatatgtatgtaccaggaagaccagcaattcagtaaaaatctgaaggacatgaccaaacagttcataggaaaagaaatatgaaacacagatagcttataaatatatcaaaagatttacaaccttactcataataaaaaactggaaattaaactacaaggggcttctatttcttatccactaaagtgagacaaagattaaaaattttttttaaagcctgtgtttgcaaagatgtagggaaacaggcagtcagtgttggtatataaactgtagaatttctttgaagaataacttggagatgattatcaaaatttaatatacatgatgaagtatttagagggaagtgtacggatatctgcagcttactctgaaatgtatcaaaaaggaagatggatagatatatgatgaacaaagtatactaaaatgttaatggtggagttcagatggtgagtatacaggggtcctctgtaaaattgttccatatttttctgtttgtttgaaagtgttcataataaaacattggaaaataatatgcatacatctttgggtcagcaattccaagaatctgccctgatatactggcacatgtgcataaagatatatttccacaaatactcattgcaacattgtagtgaggaaagatttgatacaaccgaaatgtccttccgtagggaactggttacatgagtaaccgttcagtgaaatgttctgtagctattaaaaaaatgagacagatgtatttgaaattatctccaagttacttatatatgaaaaagcaaaatgcagtataatatacagtactaccctttgtgtaatgtttgtacatgcataatatatctctgaaaggatacagaagaaactggtaaaacaggtttctccagagagatttggcagtggtgaaggtgatgtggttctgggtaggaggaagactcactggttatccttcggcacagtttgatttttttcatgaaagagtattactaagtgctgacttacgaagggcgtgttaggtcttagaattctttctgaactggaatgggtgttcaggatattcacagtggagttcatttgaaagctgacattaagaaacatttgacaatcattttacatcatgcttctaagaatgtgagaggactttttccattctcaagtccttttaaggaagtttttttcatctagatctaattgctctagatatgcccactgttcagcaaactagaatttcttggctttttctggctaacacaactacatagctggcacatgtactcatttccattaaaccaacacatctgtttttgtgacaaatgcgaacaaaaaatgttttgtttaaatagaatagcctccaccaagtaaatatgagaagcttaaaagtttagtctctatagctaacctgatgttcactttttcctcctgtttgttatagaccagaaaggaaaaattagcttcctgatttttaaattctgaaatgatttcttagtttagaatcaaatagtccaaaccaagtctttcatatgtaaacagtaatatttattgttataaaagaggtatattaaaagttaactgcttagtaaattttaggtgtataaaaacttttagtgctcaggattaagtaattttgtataaaattttatgaaatatatcctgcagttttctgatttattatgattttgctttttaatataactttaaattacaaaaaattacaaaagtagcacctgtttcttgtagaatactgtaaaattgcaaaaatgtccagaaaagataaaataaaactaccttgaatctcaccaccaaagataactgctattaactaacatcctcctggttatatatttgtgtagttctgtatgtttgaggggggagatataaagagaggagtttttaagcaaaaatggatcatattatacatattaggaggcagtatagcatcttacctcctaatgaaactgcattcagcattctctgaaatgaaactgaaatcaacagtcaattgagtcccggttccactatttgttagttacatgaccttaggaaaatttttaactcctttaagcctcatggagaaaatagaggtgcttacctcttagggtggttgttgaaaaattaaatggataattcatgtaaaacattctgtgtgtaagttataatatctttgtatggcttacatttagaataattatcatttttacttaaaaatgcaatttaagtcctttttaaaatcataattttatctatttcttgcttagtatttagaccccttccagctcagttttgaaatatttgtcttttattccccaagtgcttaggtttgtacatttaagcatattataaattagttacctatagaatcagattttactttttggtaaaatctgtaaataacagttaaaattcttccatgttgaaatatgcttatatctcgcttagttggagactagcctaggacttgtttgtggtcttgtttttatagtttaagatcaaagtgccttccattgttcctaggcaggagtaggattgcttgggattagtgagatcagttagtcactatggctgcctataaagcttatagtgataattgaccagttctgtatctttattccctctttcctcaggactccatatcatccacagcctagatgaagtcaatttcatacagaaccttgtgttttacattgaagctgcatataaaactgctgtaagtactgattttagaatggattttagacatatgatgtttttgttttctaaatactgggcaactcagttgttttcttaatgctactgctcatagtgaaccaacctaaaaggcttctggcagaaattgtctttagcctctttctttattaagacctgtcatcctgtgtcttctcttcaagggggttacagagacaagagggtcaggatgctatactttcattcctttcaaactctgtgatatctcatggtatgtatttggcaatctgggctaaattgtggtcttattttaatgatttaagttcttaagagcaagatagctaggttgtattgtgggtcagttagctacttagaaataaaatttagtcatgtttgtaatattatctgtaggtgttgattcagtgcttacaatgcaaataagttatttttccttacaactaccatatgaggtaggtttctgttaaatcataatatatttaacatcttctctgtataaaatgttaagttagacactatacaggaatgcgatttttttcttcttcagtctaacatagacaacttttctttgttgttcattgaagctttattcataatctccaaaactggaaataacccaaatatctatcaacaagtaaatggataaacaaactgtggtatatccataaaatagaatactactcatcaataaaaaggaatgaactgttgattcatgcatcagtgggtgaatctcaaaggcattatgcttagtgaaagaagttagacaaaaaatgtacagactgtatgattctactcacataaaattctagaaatctatagtgacagaaagcagatccatgattgcctcaggagaggagcagagggagagataaattacagaagagtatgaggagacttttggaaattttacaaatattcattattatgatgatagtttcacgcatgaaaacatatcaaaattaatcaagttgtacactttaaatatgtgcagttctttgtatatcatttatacctccataaaaatacaaaagttgttattatttgttgaatctgtgtttccatttctgtttctgtttttgtctgttgcccaggctgaagtgcagtggcatgatcgaggctcactgcagcctcaaactcccaggctcaggtgatcctcccacctcagcctcctgagtagttgtgactaaaggtatacgccaccacatccagctaatttttgtattttttatagagacgaggtttcgctatgttgcccaggcaggtctcaaactccttgactcaagcaattcaccctcctaggcctctcaaagtgctaggattacaggcatgagccaccacacctggcctgttttccacttcttactaaccaccctcctcctttgtgaccaacacattattttttatttctgttaattggacagttatcttttaagtatatttaaataaaaattagaaattcatttaccatttctggtgtacttcttttcttcatgtagattcagatttccaactggcattatttccttctgcctgaaaaactttcttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcccggacggggcggctggctgggcaggggggctgaccccccccacctccctcccggacggggcggctggccgggcggggggctgaccccccaacctccctcccggacggggcggctgacccccccacctccctcccggacggggcggctggccgggcagaggggctcctcacttcccagtaggggcggccgggcagaggcgcccctcacctcccggacggggcggctggccgggcggggggccgaccccccccacctccctcccggacggggcggctggccgggcggggggccgacccccccacctccctcccggacggggcggctggccgggcagaggggctcctcacttcccagtaggggcggccgggcagaggcgcccctcacctcccggacggggtggctggccgggcaggggggccgacccccccctcaacctccctcccggacagggcagctggccgggcggggggctgacccccccacctccctcccggacggggcggctggccgggcagaggggctcctcacttcccagtaggggcggctgggcagaggcgcccctcacctcccagatggggcggctggccgggcggagggctgacccccccacctccctcccggacggggcggctggccaggtggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccaggcggggggctgacccccccacctccctcccggatggcacggctggccgggcgggggggctgacccccccacctccctcccggatggggcggctggccgggcggggggctgacccccccccacctccctcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtcttggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagcgcgccaaccaccagccgcggccaccatggccagacgggctccctcgaaaaactttctttaacatttcttcattcttctagtgatgaactatttcagcttttgtatgcctgaagaaatctttatttcatcttcatatttgaaaaatattttcactaggtttagaattttatgatggcagatgtttttgtctttcagtactataaaaatgttgttccactttcttcttgcctgtattgtttctgatgacaaatttgttgtcaaccttatgtttgttccgctacatgaatgtgcctttttctgctgtctgcttttaaaagtttcttttatggctgggcatggtggctcatgcctgtaatcccagcactttgggaggccgaggtgggtggatcacctgaggttgggagtttgagaccagcctgaccaacatggagaaaccttgtctctactaaaaatacaaaattagctgggcgtggtggcgtgtgcctgtaatcccaggtacttgggaggctgaggcaggagaatcgcttgaaccccggaggtagaggttgcggtgagccaagatgatcacaccattgcactccagcctgggcaacaagagtgagactctgtctcaaaaaaaaaaaaaaagtttcttttattactgactttaaacacttcgattatgatatcccttggtgtcattttcttcacgtttcttctatttagggtccatttagctccatagatctgtgcatatatcgctttcatcaaaagttttcagcaattatttcttcatattgtttttatgttcccccccttccttcgagtattcaataacatgtgtattaggctgtgtgatgttgtcccacagctcacagatgtactgtttagttttttaattcttttttccctctgtgtttcattttggatagcttctattactatgccttcgacttcactaatctttttatttacaatgtctaatttgtcactaatcccacccaatgtatttttcaggtcagatacagttttatcgctaaaagttgaatttgagtctatttttctatattccatgtatctactaagctttctgaatgtatggaatatagttataatacatgctttaatgtccttgtctgagtattctaacatctgtgtcagttccaggttggtttcagttgattgatttgtctcattatgggctatattttcctgcttcttggcatgcctagtaattttttactggatgaaagacatcatgaatcttatcatgttgcatcctagatattgttgtattcctgtaaatattcccgagctttgttcagggacctagttaatttagttgaaaacagtttaatccattattacttttaaaatgtgttttgtgggaccagagtcatgtctagtctggggctagttattctccactacataggtaagacacttctgaatactctaccccatgccccctgaattatgaagttttctagtctggctagttgaaacaggcactatttcttgtcctgtgtgagcactaggtattttttccctttaattctttgggtggttctttccctagcctcaagtagttttctcacttacatgcattcttcattattctgctgaatatttgagggggaccctctgcagatttctgtggttttctgtgtagctttctcttctccgttagtctgtcctgcaaattatggttaccttggtgtatctgtacttagcgccatttcctcaactcagggagtctgccaggctctgtttagttttctccttcctgtatagtggcctgcaaactcttacaacagtaagctgggacagtcataggactcatcctatttgctgccctttctcagaaatcactgtccttcattgtgtagtgttcattgtattgaaaaccattatgttataaatagttttttagttgttgcaggtgggaaggtaaatctggaacctgtgacttcatattcaccagaagcacaaacctaacatagataattttatgcaagcagacattatttgttgactgatggctttgcttctgacaccacaggcctgctgtggttcagtgcggaagttagggttctttggcctctccattatatccaatgattataacagtagaattattgatatttctgtattctcatactctaacctttgctgcacaaactagaatggagctggattgggggacagataaggccagtcatgggttaaacatggcttaccttcctgaaacttcactttaactcagagatttggcatgaaaagtaattaaaggtagatacagagatacagatgtgtgtgggagggtgtgtgtttgtgtgtatgcacatacacatttgcacatgtctgtttccaagttccatttaatgagagggcctagaagcaatgacacctcagtgacaatgagtgtacccagtgcccaggtcttggattctgactctcattttctgatcaagtaaaccaggacttcttatgaaagtggttgattccagggctatggcggggaaaatatgagataagattggagcatcttacagtgccaaaaagtgaagaaacgttcaaaaagggagtgttttattttgttatgttttgttttgagacagggcctctctttgtcacccacactaggattcagtggcgcaatcatggcttacttcagcttcaacctcctggactcaagctatcttgccacttcatcctccctagtagttggaactatagaagcaccatcatgcctgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaacaaaaaaatagtaacagtggaattgagaaacccagcagacatcacgttaaccaagtgatgagggttaatatcaccagtaataagacgtatcagcattgtatatccctgctatgatgcactgagaaggacacagcataatgtctgtaatacatattcttgcctaaaatgcataatctcagtctagtctaatgagaaaacattaagcaaacccaaattgaggaaaatctactaaatacctgatcactaatcttcaaagagtgtcaaggtcacaaaagacaagacttgaggaactgtcactgattagaagagacttaaagaaacatgacaaatgcagcatgaaattctggattggatcctggaatgtaaaaaggccattggtggaaaaagtggtaaaatccaaataaagtccatagtttggttaatagtattgtgccaattttaatttcttagctttaactattacactgtggttatgttagacgttaacatcaggggaagctaagtgaaaggcatatgggaactccttgtagtgtttttgcaacttttgtataagtctaaagttattccaaaataaaaagtttttaaaagtaattttaaaggctatatgattcaggggatttatagagctctggctaagagggtaggctttggagtgagattccttggattctaatcctggctctgtcacttattaactgtgtgactttgagtgagtcacttaacttctctttgcatcatcagtttcatcatctataaaatgtaaggattaagaaagataatgtaaaatgcgtaaattagtgcatggtacgttgtcagtaccaatagagagtaaaattagaatgaatgtttacaataaaatattgggctgctatttaggctccatcttgcagatctactgggtatttgctttaatgaaaaattttgagaaacacctctccagatagacagagttatagttcttagccctcctgattaactgttgaggagtcttccaatggcttggaggccccagtagaatttaaagctattggcaaagtagctgcaggggccaccccacacattagcatctccttaataagcattgtgggtatatatatatatatatggcaaattagttactcctagtgtcttttattcaagggtaaacacttcctgcatctaggaagtatttagtagttatgacttgctaattgtatattggttattttatgccaggacttcgggatatgggaacgtggagacaagaccaaccaagggatctcagagttgaatgccagttcagttggaatggcaaaggtaattttcctttcctgtttgtactaagtatgggatgaggaagtctggtatccctttgtcacagataaaacttaatgtgactgtggaccataatcaaattaattattattttaaaccacaggcaacattcagattctcctgtagaaccatggatatgtagatgaaaactttcataagctgcagatttgatatccaactgcttttgtggcatgtctctacttatattatatgccataaggacttgaaaggacttaaactaaacttatcatctctaccattacaaaaacaagcaaaagaaggcttttattcctttcgtttaccagttgaccaagctttatatcaaggaatcatctttcaatcctctatcctctttattttcctccatcccccaaatcatcatcatcatcatcatcattagcagcagcagcattactattcaacttggctctactttttcatcctacccactattgtcttctctggaaacagcaagaagacatacaataagatagcaggaataagatcaaacatatccattatgagaaatatgcatgatttagtctgtcctactaatatgcaaagatatagattgattttaaaaaataaaaggaaatccaatatatgctgtctataagagctctaatataacaaaatgatacagaaaggttaaaaacagaaggatgagcaaaatacagtctgacaagcataaaatgagctagggtgactgtgaatgtcaagtgaagtagaattcaaagtaaaaaatattgcatggaacagagaggacaaagggagtcacaatagaattttattccatttttttattttatttatttttattttatttatttatttatttatttattattattattattattttttgagacggagtctcaccctgctgcccaggctggagtgcagtggcacgatcttggctcactgcaacctccacctcctgggttcaagagattctcctgcttcagcctcccgagtagctgggactacaggcatctgccaccatgcccagctaatttttttttttttttttagtagagacagggttttgccatgttgacgaggctggtctcgaactcctgacctcaggtgatccatctgccttggcctcccaaagtgctgggattacaggcatgagccactgcacccagcctaacaatctcatagtgcactgaacaacataaccaaacatccttctatgtcatttcacacagacaaatttagttcattcttttcagctgctatacagtatttaataattgctccattgacagaattgtctttattttttaacattctagataatgctttagtgaagatccttgtacatacatccaggtaaatttacacaaatatttttataggaaaaattcctcaaagtggaacccttaggttaagggatgtatacttttaaattgcccttcagatatgaacagacacttctcaaaagaagacatttatgcatccaaaagacacatgaaaaaatgctcatcatcactggccatcagagaaatgcaaatcaaaaccatagtgagataccatctcacaccagttagaatggcgatcattaaaaagtcaggaaacaacaggtgctggagaggatgtggacaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccacatgtccaacaatgatagactggcttaagaaaatgtggcacatatacaccatggaatactatgcagccataaaaaatgatgagttcatgtcctttgtggggacatggatgaagctggaaaccatcattctcagcaaactatcccaaggacaaaaatccaaacaccacatgctctcactcataggtgggaattgaacaatgagaacacatggacacaggaagggggaacatcacacaccggggcctgttgtggggtggggggaggggggagggatagcattaggagatatacctaatgttaaatgacgagttaatgtgtgcagcacaccaatatggcacatgtatacatatgtaacaaacctgcacgttgtgtacatgtaccctaaaacttaaagtataataaaaaaaaatttcaaatgaaaaaaaaaataaattgcccttcaaaaatatttccactagtttacatttcccatcctcatatgatagatatacgtcattatgtaccatagatgtcatttttcttttcttttttttttaatcatatgctgtttctttcagtgaatgaaagtgtttgacagagaaatacctttggaaacaaatattgagaacatgttattacaacttgtttctttttgcactggtacttattattacaaatttacatatagagcttttttgccacttttctcaaactctcactacctggatattatcaatatttttgtatatttgatttaaagttttttaccatttaaacttttttactttttattttgtaatcatttgtgacttagaggaaagttataataattgtacaaagaattcctatatagtacccttcactcaagttccctacttgttaatatttgctttatctttttctctgattaaacaaaacaaacacacaaacacacaattgtttttttctgaaccagtagagagtacattgcagacatgatgccccattactcctaaatatttcagtgtgaatttcctcaaggactcttttataaccatgatacaagcatcaaaatcaggaaatgaacactggcattatactgccacctaattgatatagcccattcaaatttatttagttgtcccaataatgtgatttatagcaaaaaaaaaaaatccttttgatccaggatccagtctaagataacatattacatttaattgtaatgtctctttaggcttcttccgtctgaaacagtgcctcagtccttacttgtctttcatgaccttagcatttttgaagagcataggccagttattttacagaatgttcctcgatttgattttgtgtgatatttcctcacgatataggttcaggttatgtgtttttggcaagaataccacagaggtgatgctgtgtccttagtttatcatcaggaagcacatgatgtgaatttgtcccattactgttgatgttatcttttatgacttcattaaggtggtatctgccaggtttctccactgtaaattttctattttccctttgtaattgctatgacttgaatgtttgtggtcccccctcaccaaaattcgtattgaaacttaattaccaatgtagcagtattgagaggtggagcctttaagccgtgactggatcataagggttcttccatcatgaatgcattaatcaattcatggattaatggattagtgagttatcatgggaatgggactggtggctttataagaaaaggaagagacacttgagctagcacactcaggccccctcatcatctgataccccattccaccttgggactctgcagagtttctacccgccagaagccctcaccagatggggccccttgacattggactttatcagcatgatgaacgggagccaggtgctattcctcaagacaatggaggaaagaccccaaggcatttcagagatcttagatgctgccttttccatcacaggtccaaaggcctaggagggcagaatagtttcaggggacaggcctggggtgttctttatgggctgtgcccaggactgccttggaactgtactcccggcacccctgcttcagtgttcactcagctcatgccactactccaaaaggtccaagtgataaaccttgaaggtatccatgtggtgttaattctgcaggcccacagaatgcaagagctgcagaagcatgacagtttccacctggatctcaaaggatatataaaacagcttctgttctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccatcggtctatatctctgttttggtaccagtaccatgctgttttggttactgtagccttgtagtatagtttgaagtcaggtagcgtgatgcctccagctttgttcttttggcttaggattgacttggcgacgcgggctcttttttggttccgtatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttctatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtcagagagggcatccctgtcttgttccagttttcaaagggaatgcttcctgtttttgcccattcagtatgatactggctgtgggtttgtcatagatagctcttattattttgagatacgtcccatcgatacctaatttattgagagtttttagcatgaagcgttgttgaattttgtcaaaggccctttctgcatctattgagataatcatgcggtttttgtctttggttctgtttatatgctggattgcgtttattgatttgcgtatattgaaccagccttgcatcccagggatgaagcccacttgatcatggtggataagctttttgatgtgctgctggatttggtttaccagtattttattgaggatttttgcatcgatgttcatcagggatattggtctaaaattctcttttttggttgtgtctctgccaggctttggtatcaggatgattctggcctcataaaatgagttagggaggattccctctttttctattggttggaatagtttcagaaggaatggtaccagctcctctttgtacctctggtagaattctgctgtggatccatctggtcctggactttttttggttggtaagctatccttcacgtctaaaacaccaaaagcaatggcaacaaaagccaaaattgacaaatgggatctaattaaactaaagagcttctgtacagcaaaagaaactaccatcagagtgaacaggcaacctatagaatgggagaaaatttttgcaacctactcatctgacaaagggctaatatccagaatctacaatgaactcaaagaaatttacaagaaaaaaacaaccccatcaaaaagtgggcaaaggatatgaacagacacttctcaaaagaagacatttatgccaccaaaaaacatgaaaaaatgctcatcatcactggccatcagagaaatgcaaatcaaaaccacaacgagataccatctcacgccagttagaacggtgatcattaaaaagttaggaaacaacaggagctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacgtgcacccgtatgtttatagccgcactattcacaatagcaaagacttggaaccaacccacatgtccaacaatgatagtctggattaagaaaatgtggcacatatacaccatggaatactatgcagccataaaaaatgatgagttcatgtcctttgtagggacatggatgaaactggaaaccatcattctcagcaaactatcacagagacaaaaaaccaaacaccgcatattctcactcataggtgggaattgaacaatgagaacacatggacacaggaaggggaacatcatacaccggggcctgttgtggggtggggggaggggggagggatagcattaggagatatacctaatgctaaatgacaagttactgggtgcagcacaccaacatggcacatgtatacatatgtaactaacctgcatgttgtgcacatgtaccctaaaacttaaagtataatagtaataaaattaaaaacaacaacaacaacaacaacaaaaaaaaagaaaaacagcttctgggcccaggcagagacttgtcacaggggtggaaccacaacagagagcccccgctagagcaacactgaagcagaaacatggggttgcagcttccacagagagttcccactagggcaggaccaccactgggatgccagaactgtggagtcactggcagcatgcaaggtctgcctgagaaagcttcagataccagactgcaacccatagaagcagccacctgtgctgtacccatcaaagccacaggggcagggctgcctgaggccttagagacccaatcccaacctgcgcgcagagtcaaaagggattattcttcagctttcacatttaatgtctgctatgctgggtttaagacttgctttaagcctgttactgctttctttttgcctgtttctctcttttagaatgggaatatctctgtctgtcttatgcctgtaccaccattgtatcttgaaagttgataacttgttttgatttcagactcacggatgagattttggacttttgagtcttatccttggtgctggaatgaattaagactttgaggctatggggttagaatgaatgtatttatatgtgagaaggacatgagtttggtgagggtaaggagtagaatagtaaggcagtaattaatgagtattttgtgcctggccaacttctacttaccctataggtctcagtttaggtgtcatttcttcagggaagactttcaaaactggcttctacccccaagactaggtcaagtctgccctttaattgaggaattacagataactaataaatactagaaataatattcaatcttgttaacaatttaatgcatatgaatgcaacagatataccattttttaatcacattaggaaaaaatgtttaagataatacattgtttgcattaaggaaggtattgtcatatactgctagtgatagctatgttggtacaacttgcaagaaaagcaatttagcattatgtcttaaaaattattcatactcttttacccaatgattctacttcagggaattgatgcttacaaaataactcaaaatgaatacaaagagttattttattagcttgacagtcattattgagagcctaccgtatgccatggtttgtgctagatattagtgaagacataatccccgacctcaaggaatttataatttagcaagagatgtttatcaaagttctatttctaatagcacaaaattaaaggcgacctaaatttccaagaattggtaaatggctaaatatactttattatagccatatgagataatagtatgtcaaaatagtgtttgtaatgtggaaaaatacttacactatattattaattgtaaaaagtaggataccagatgtgatctcaactgtacacaaatagacatagaaaaaactaataaaaaacatgtcaaaaatgttaaaagtggttgttttgggtgattttcttgccctctctgtactttactgtgttttcaaagtattctataaggagtgtgttttacttttatgatcaaaaatatatttagaaaagtaagaaataaataaataaattctattttaaaaaacataatatctcatttatatgtggaatctaaagaagttgaactcatagaaggagagagtacaatgatggttaagtatgatacttgatagtgctacagactcctttttaactttctctgagacaatatgggagacaaagaaaaactcagaatgccctgggaataaataatgtttttgtattatatattctgtcagacatattcaaaagtgacatcatgtgtgttgataagatactgggatatagggagaagaaatatatatctttctaatgctaaacttgtccatttctttcttgttcctcacaggcagccctggaagcattagatgaactggatctgtttggtgtgaaaggtgggcctcaatcagttatccatgtcctggctgatgaagtacagcactgccaggtaaaatattatggaaaatggaaatagcaaattttattcttgcccagactcagatttaagcatgagctttagattaaggatagctgaatgagagacagtgcatcatctgattaattaccatgtaccaaaaatatatttaacaagcatactatactgagataagccaaatatagcatgggctataaaatagatcatagtcctgttctctagccaaaggttataaagggatcccaccatactatgtggaattatccaccactatcatatcaaagggatatggtctctctttctgagtatctccttttctaaatatataaagaaaaccagagatgatggatttgtagtattcttgttagtgtttctgaaacattctcttgttcctggttggctctaggcttagatatttggagattagactttaagtggcaaatatgtattttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctatgttcatcagggatattggcccatgggttttttgttgttcttgtgtcctcgtcagttttggtttcagggtactgctggccttgtagtgagtttggaagaattccctccccttcaatttactggagtagtttggttttagctctttaaaagtttggtagaactcagcaataaagccatccattcctggacttttcttcatcggagtacattttattactgattcagtcccattactcgttatttgtcttttcaggttttctatttcttcttggttcaatcttggtaggttgtatgtgtccagaaatgtatctgttttctctagagtttccaatttcttggcatatactttttgataatagtctctaataatcctttgtatttctgtggtatcggttataatgtctcttttttatttcttattttatttacttgggtcttttattcttagtctggctaatggtttgccaattttgtttatttaaaaaacttttcattttgttgatcttttgtattttttggccttaatttcacttatttcttgtttggtctttgttatttctttccttctattaattttgggttctgtttgttcttttctaattccttgaggttcatcattaggttgtttatttcaaatctttctactattttgatgtaggcatttattgccataaacttccttcttagtactgcttttgctgtatcccacaggttttgggatgttatgtttccattttcgtttattttaagaaattttaaaatttctttcttaatttcttcattgactcgttggtcattgaggagcatgttgtttaatttctgtgtatttgtacagtttcaaaagtttctcttgttattgatttctagttttcattgcagtcagaaaagataattgataatgatttcaattttttaaagtttgttgagacatgttttatcacctaacatatgatcaatcctggagaatgttccatgtgctaatgtattttctgtacctgttggatgaaatgccctgtaaatgtctgttaggtccatttggtctataatgtagtttaaatctggtatttctttgttgattttctgtataaatgatctatctaatgctaagagtagaatgttgaagtctcccactattattgtactggagtctaactctccttttagatctaataatatttggtttatatatctgaatgctgcaatgttaggtgcatatatatttacaattattataacctcttgctgaattgatgcttttattattatataatgaccttctttgtctctttttactttcaacttaaagcctattttatctgatataagtatagctactcctgcttgcttttggtttgtatttgcatggaacatctttttccattccttccagtttagtctatgtgtgtctttacaggtgaagtgactttcttgtaggtatcatgtgagtcttgttatccattcagccaatctacatctaaattgagaaatttaatctatttacattcaaggttattattgataaatgaggactttctcctgttattttgttaattgttttctggttgttttgtatatcctttgttcctttcttcctctcttattgtttatctttacagtttggtggttttctgtagtgataaggcttgattcctttctctttctctttctctttctctttctcctttctgtatgtgccctttctgtatgtgctcctttctgtatgtactagtgagttttatacttttgcatgttttcatgatgatagttatcatatgttcacttccagttgtagaactcccttaggcatttcttgtaaggctggtctaattctgggtatagtgttcttgcctgacaggtttttttttttttttttcagctcttagaatatatcatctcattctcttccagcctgtgagattactattgagaaatctgttgctagtctaatgaagattcccttatatgtaactttatgcttttctcttgctgtttttaaaattttctctttgtctttgacttttgacattttgactataatgcacctttgagagaacattttttggtttgaatctatttgggaactttgagtttcctggatctggatatccatatttttcccaagaattgggaatttttcagctattatttcatcagataggttttctgcacattttcccatctcttgtctttctaaaacttccataatgtgattatttgtttgctttatggtgttctgcaagtcctataggcttgtttcattcttttttattcgttttttttttgtatgcctggtttatttcaaaagatctgcctccaagttcagaaattcttctgcttgatctcatctgttgaagctcttgattgtgttttttatttcattaattgaattcttctgcgttaaagtttgttttttaaataatatctgttgaatttctcatcagatcatgaattgttttcctgattttattatctatctttattcttttatatcttgctgggtttccttaagatcataattttgagtttcttttataacatttcataaatttccttttctttgaggtctgttactagataattattacgtccctttggatgtgtcatgtttccttgccttttcatgtttcttgtgtccctgaattgatatatgcacatctggtggagcaggtacctcttccaatttatggagcagctttgatagggaaagactttcctggagatgggtcctaaggtgttggtttaggtaggatacactggctttggttctaggtggacacagttattatagtctctgtgcagtttcttgagctgtaatccacataatagatgtttgtgagtacctcaatggcctaggctgcaggagttgtgagtgtggtgggtagctttgctaggggtgggctcctgaacagactgatttccgggcctggggtgtagacatgcatgaggagaagggctgccagactgtttttctagccaaggtcataggcacatggcaggtcagctggttcagagactggtttgccaaccaggggcagggctgctgggctatttctgtgcctgggggcgtgggacttgggaactggcttgccaggggtggagccactgggctgtttctctgcccagggacatgggtccatcaggctgtttctccgtcaggctggtccagggttggctttctactatgcaggaccagagtcatggccattcctggggccaggcttcgagcagctgaggtcatggcactgcagccacctgtgtggggttggtgaaatgatggcaaagagtcaaggttggagaggtacaatggctactggcccccagagtaggggggccaactactgcactcctgcagtagctccagtttcaagatggcactgtactgcagcagctttggtcatgagaaataggaagtgcacaacatgtacttgtactctggagtaatatagttgtgtgaattctaggcagctccccaaactgggctcagcacttgggaggactgtaggattctcctatagtaaggactgcaggtgtctgggctggcaatgagggacggtgggagccttttgcttaccttttccctgcaaggggaagtccctcctgtctctgagccaatcccaataggggagatggggcagcagagccagggtgcctcgctctcctctctatgctgccatcctgggcttttctacttcacagggttcttgctgccagtcacttgctacaccacagtgctctccctcagacactccacttgaattttagttgtttattagttgttttggtccttttttgtggggaagacaagcaccaggcacctctagtcagccatcgtgctctatgttgattctttttttttttttttttttgtcagtacattccaaacatgtgtaaccaatgaacatggcctagggttttttttttgtttttttttaattggtattcacttcagtaacttcaatccacagatacaagcagtatataaccagaaagttacaagtaaacacagattatacatgcacatttctgttcacaaaggtcacatgtgcaggtacatgaattagaagcgtgcatctaggattatggccaaactgtttttaagatgcagaaatataaaattacatcttgaaaatatgaagaggtggtctacacacttcaaaaatcaaatgttgcttacaccagagatgtatgacgattacaggattcaagtgacaagcaataagatctcaaaaattagtactggtcaaagagaatgggaatatttttacgtttcactgaaaatattgactactagaatataaaatctagcaggaactcagggaaaaaaatacaaaacctaaagccaattacttaatatttcttattacctaaacaacagcatgacatttacagaaaactgcacctgcatttgaattgccaatctcattttaatgaagttctccaaaaatgaaatgcaaccaaaaaagggtcaaactccaaatgaaaagtttgcaaggctcagattaaaacatggaatgtttcagatgaaagtaataaaaatactattggttttgttctttattaaatggaatcaaatactgacatttctttgaagcttggaactgctaaatttcattttcccaaatggttctgcatttttttcttagtggtgcaagttgtcttaagtagcttacgaagtcaatctctacaaattacttctataaaacaactattcattaatcgtatgtatttttttgctataacacttaacacatgaacagacattatttctccaccaaaacaaaagagtacaatagttttcttctgtcagtattgtatttaaaaaagtttaacattaaacacaaagaaccattattttctttgaaacccttaaatcttcttgcacatcttaagttgccttcttctgtctgcattcttctgccaatttattcagaaatttatttaatttctcataatgaggaaggctgctgcaatgagtattctttgcaacttcttttgtataaaagagtgaacatagcttaccataaagccctgttttaggtattacatagtctataccaacaggaacattgggctgttatggtccaattctatactcatctgggattgtatagtcctccttgttctcatcactttggccatctgcattttcacttatgttgattcttagatgcattttactaagtgaaaaaaagccaaacctcaaagactacatactacatgattccatttacatgacactctggaaaaggcaaaactatagggaggaaaacagatcagtagttgccagaagttgggaggacagattgtctataaagatacagcactagagaattttgagggtgatggaatggttctctatggacttatgctggtggacacatgactatatgtttgtcaaaagctaaggaattgtatgccacaagaagtaaatttaaagaatcaaccagggtgtgtcaagaaagatggaattcagactgaaaaatgagtctaattacattacaaatgaatcaagtaaccacactaaaaggtatggaaaagaaaggagctgacctaagtcttggaaaacagtgttttgactagatactgcaagcctaacctaaagacaaaaataactgtatacacacactgtactctagttcaggggttagcaaattacagcctgtgggctggccatctgttgttataaatagagttttattggaacacaaccatggtgtatttacatattgtccatggctgctttcaaggtacaacagcagatctgagtaattgcaacagatgctgtatggtctgcacaatctaaaatattcactacctggtcctctatgaaaaagtttgccaacccctgctctagttgataaatttgtttctcaaaggggtactggttggcaattctgaaactactttatctgtacagtaaggttgaccaaataagtaaatatgtagtagatatagtgggtaatgagacctaggtttctcactgttacacatagggaatgggaaaagcctagaatgaaccttgtgatgttggattggagaaggtagtatcagtatgaagtgtgtatgtgtgtgtgtctgtgtgtctgtgtgtgtttaatatagggatgtgtgtcttcctatatgtgtttcctaactttgtccactgagagggcccagaggcaatgagtacacctagtgtccaaatgttggtttctaaatgtcattctcaatgaaaggacttagggctccttggagaagtggttgatttgactggggcagggaggatacaaggggagcctggagtttcatatggttctagaaaataaagaggtactcagaaaagtatggaacatgtcaaaggaacacaggaaccatctgaaaagtgcttctaatggccaaagcagaaaaaatttgaacaataaaataactatcatagtattggattataacccagagaataaatgaaatgtccataagtccatactgatataaataaataactgaaaaatgaataaataggaaagaagacagatctccctaataggagaatgtcaattaataaatgctaaaggaataaaggaaatacaaaattgccattagacaaacacaagaataacaattatttcaggagaaatctactgatggatgctaaaaccagtagacaaaagcttaagcataacgaaggtgttcgaatagtctcacagtatctcccccaaaatatttaatagttacaaatggaaaattacagtggagaaattcagcagacaccactttaaccaagtgatcagggttaacatcaccagtaataggacacattgacatcatgtactctctcatacaatgcactgagaagggcacatcacttctgtggtatccttcccaatatgcataaccgtactctgatcatgagaaaacatcaaacaaaaccaaatcgaggggcattctacaaaataactgatgaacactcttcagaagtgtcaaggtcattaaaaacaaggaaggactgaggaactgtcatagattggaggacactaaggagacatgatgactgaatgcaatatgggatcctgaattgggtcctagaacagaaaaaaggacaactgatgaaatccaaataagttatgggctttggttaatagtatcgtaccaaagttttttttttttttttttttgaaacaaagtctcactttgtcacccaggctggagtgcagtggcaggatctcggctcactgcaacctgtgtctcccaggttcaagcgattctcccacctcagcctcttgaataactgggactacggtcacgtgccaccacgcctggctaatttttgtatttttttgtaaagacaaggtttcaccacattggccaggctggtctcgaactcctgacctcaggtgcctcccgcctcagcctcccaaagtgctggggttacaggcatgagccactacacccagccaccaaggttaattttttagttttggcagatttctatggttatataagatgtgactataacggaatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaaattcagtatcattaaagggattgaacagtcaatatgaagcactttcactggtaatggaaacattgtttaaagcttagatttgatgtttgagagacattatggatttttttaaatcatcgagctcaaactcttctggtctacttcctcttccactttattttttagccttgaatttgacttcttcccctatcagtgtactaaaattatatgttctgaaacatcatcataagctcttaaatgaccaatccaatagccttttctgaatccttattctccttgacttctctatggtacctcactttttacctagccctaaattctcttgaaattcttttcctattttaattttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctctatacataatgaaaatagtttttccccattcattaaagaatatattcctaaaagtatttgaatttcacagataaagacatattgtaaatgcaacgtacagtcagttctgctataatgatacgtatgcaatctttttttgttgtcatttttaagacagggtctctcactctgttgcccagactgtagtgcagtggcgtgatcatggctcactgcagcttcgatctcctgggctcaagcagtcctcccacctcagccccctgagtcactgggactataggcatatgccaccacattcagctatttttgtttgtttgttttttgtagagacgggcctcgctgtgttgcccaggctggtctcaaactcctgggctcaagctatccctcctgcctcagcctctcaaagtgctgggattacaggcatgagccaccacacccaggccatatgcattctttaaaaatcaccatgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaatcaccatgctatgcatatttaagaaataaaaactacagggcttatgagaaaatggggtaaggagtgcagcacataaaatgtaacacatacaaaatgataggaacctaataaaaataatagtatcatggctttatacatggtaaatagttaagaaatacataaataccacaatagttaccgtactttcaccttaaaaaagacccaaagtttgcttgtgcaagtgtgtacccaagttctcaccagctcacccacctggctctcatgcccactacataatgtgcaagaggaagagaacaaaagagggattaaaaagagtgagagaaaacagagaaaaagagcataaaacagagaggaaaatttttttaaaaggctgagaggaaagaggtagaaaactgaagagagggcaaggcatgtggttgcatatccagggtggccatcagaggattgcagcttgtaagttcagtagtggtgaaaggagtgttatctgaaattggacagaaagtagtaaaaacagatgtgaataggtacagttcatcattctcctgagatatatgcatgtgtgttttgtgtattcttacatggcccagttcagctgagtacattctcagtatgaaattgtgcataaccaaacatgaaattcatgttatactcaaatttttccctaatatatcagaagcattggaacaaatttgtttacaaagaaagtgttatagcagaactatttttttttttcatcataaattacagttttgggttttgtttttttttttacattttatatattgctaagctttagcaaatggttaagcacagaacataaacttgaccataatagaacctaatttggcaggtagaaatgcagttttaagacaatacatcctcaaatctagaagctatacttaagatatacatagtggaacaagacaggcctttggaagcagactgccatggctacaccctggactcaactgtgtacttgctctgatcttccacaaatttacaacctctttgagataatttccctgtaaaaaggccttaattacacatagctcctaggatagtttttaaagttaaatgcattaaagtatgcaaaactcctagcataatatttggcctataacaagcatttagtaaataccctttcctttctattttactgggtgaataagctcctttgcaataggaccttctttggctgcaaccttctcctgggtccccaaagggactctctgtaagtctttttttcctgcctttcttttatctgcaggttcaagaatataaagaggctcttgaagcagtcctcatcaagggcaaaaatggagtcccacttctgccagagctgtacagtgttcctcctgacagggtgagtcagacagtgccataacatgtagctgatagagaagaggagcagtaccttgatcagactacctcatttgagtcaaataatttttaatcttattttgttgttctgaaagcttgtctttaggtacaggacaacataagtatgattttatttcttcaaaaataaaattttaaagcagtctcaatgatggtactgttgcacagtcagacaaggacaagaccaaaccttaatcttgagaatgatgtagagatcactaggaaaaactaggatgatgttctgtgtggactctcaagatttggtattctctatttttaggccagtaatcccggattgttttaatagatcagtcttggaaaatgaatatgtcttgttttcagactgtcattttcccaaaatgccagtcgggtgtaacattgttcctcttctccactgcaaaagagcattagacatggaagagaatagtcttccattccggtgagaatgagtagaataagctcccagcaacatcagcagcaccacctgagagcttgttagaaatagatttcaggccctacctcatacccactcaatcagaatctgcattttaacaagatcctcaggtgatctgtatgcacatcacagttggggagcactgccctagattatagtgatagtgcttcacttttcagtgcattgcatatgtagctacatagggtataaattacaatccagtccacctttttattatccagtatcttaaaccttctattattcctcatctggcctcttcatcttttcttttaggtcgatgaagaatatcagaatcctcacactgtggaccgagtccccatggggaaattgcctcacatgtggggtcagtctctatacattttaggaagcttgatggcagaggtaagaggaatcttcaaggctgtcccacttttttctgccttaagtcaccataataatcagatttttaagtagctcattaaatctgaaggatgtcttctgccttttgcactttgccttaattatagttttcctccaggtcttcagagtagggagcatggccaaccctcacaaaaagctcttgctgcctggcaaccatgtccctcctgctgcccggggctccctactttggcactgtatttggaactgctcaggccccagatctatccctttcaaaacttccctcagtgccctgcctggtgactaacagatgcatttgtgcttagctagttaattactgataatggattaagtgctaatgcttccaagcaacatgtttcattctttaactaaattaactgatatttttaggtgccatgataagtgactaggaacatcatgactttttttttctttgcttgggtttttatgtttgtttgtattttgttaagggtctctctaaatgttccttatatcagattctgttgagattgcccttaatgaggcatttgggagtttctgactttgtgtccaccttctttgtgacattttgagcctgcacagaggcattctgtttctcagaagtttttcatatcatctggcaagtctacttccccactctatgttattttgataagatataacccaggctcctagaggatcaagagtgggacttaactatcctatctgagtcagactctttgacctgtttatgtataaccactgatttttgcagctgttttgttcattttccttgtgtggctgtggccatggctgtttgattactcttagtcgacattactaaatgagtctagcaaaagtgggcagaatggtttgtttaagtaatccttacctggtgactctctcattcaattaaaataaagtaaaggcattgataaaaagaataccacagtgattggtattctttttttttctttttttaaaatttattttattttattttactttttgagacagagtttcactcttgttgcccaggctggagtgcaatggcacgatctcggctcaccacaacctccgcctcccgggttcaaatgattctcctgccttggcctcccaagtagctaggattacaggcacgcaccaccatgcctggctaattttgtatttttagtagagatggggtttctccatgttggtcaggctggtctcgaaagcccaacctcaggtgatccgccctcctcagcctcccaaagtgctgggattacaggcgtgagccactgcgcccggccagtgatttgtattcttaaggaaaaaataggtgagttcatcccatttcataaagggcagaaactcaagtcaaaagatttctgatgtgcagaaggcatagtagatacatgaacaaatgagaatacagcaggactaatggcttaaattactgataagctgtgtgatctaatcatctaatcatatgtatatccagagaagatagaggaataaccagaaaactttgtttatttataatttatacccagctgggtgcagtggctcatgcttataatcccaccactttgggaggccaaagcgggaggattgcttgagtccaggagaccagcctgggcaacataagtgagaccttgtctccatgaataaactaattagccaggcgtggtggcacacgcctgtggtcctagctacttgggaggctgaggtgggaggatcacttgagcccaggaggttgaagctgcagtgagccatgattgcaccactgcactccagcctgggtgacagagaaagaccctgtctcaaaaaaagaaaacaaattataccctacatatttataccctacctaaaaaagcatttgtggcagccaatagcaattaactctggataaaaggaattgtggtgtgaatttgggaattcaaacattttcatacagtgaaggcatttgtttcctttctacacctgtctcttgaatgttatggtgcaaggttatgggcatagggatgttgttttccctcaagtattagtttctcttttgagacttaataatctgtctttttatggtttttctttagggatttttagcccctggagaaattgatcccctgaatcgcaggttttctactgtaccgaagcccgatgttgtggttcaaggtatgtattcttattcccagtggaagaaactttatattaaaggtctggttatgggcagagatctttaggctagtaaattatgactttattctatatgttgcactttattaggcttcaaaatgtatacaatgaactttgttcggtttggtttcaaaatgctggttatcttaataataaacaaatgaatgatgttctatgtcagatgactccaaaatattatttgacacccttaaccactccttatatctggaaattattttcttttcattgtcataacattttagcctcctggttatctctgctttttctctgaccactccttctgtgctatttctactgtacttctttctttatatatccttctaatggttctgcgcttagtatttttttttttttttgagagggagtctctttctgtcacccaggctggagtgcaatggggcaatctcggctcactgcaacctccacctcctgggttcaagcaattctcttgcttcagcctcctgagtatctgggatcacagtcgcgcaccaccacgcctagctaatttttgtatttttagtagagacggggtttcaccatgttggtcaggctggtctcgaactcctgacctcgtgatctgcctgtctcggcctcccaaagtactgggattacaggcgcgagccactgcgcccggctgcacttagtcttatactcttgtctttctgtatttacactctgtattaggtagctaagcctgcctccttcatagtaaatttgcttccatggccccaactattacctctttggagaatactccaaacttttgtttttattcctaacaatttacttaaatttggggcatctactttctgcagaactctaggctgagttctataaacatgttaagaattctagtcccaatatctataaaacttctgtgccatttacatttcaaacacaaaactgacctcttttgtctccatcccatccttttcctctcctaagaaatgcaaatcgttctaccttccttatttctctcaatgatatcaccattattctagtctcttagggtagaagacttgaggtaagtttttactctctaacatcacaatccaatgtggtgttgtgaaactcctttgagatgtctccaatcacttgactttggggttggttctatatggaaaataatctcgtgtgttttctaaattttcttatacttggcatcccatgtggtcatacaggtagttcttgcttatcaatgtatatagcaaacattatataaaagtcattactcttcccttcccatgagagatcttgttctcctttgaggtttattccacctgtctatgttgatctcctggttgctctaattcattctttgaagactttgaggcctggctacagccttcctcttcctctccaaatcctgccatagaactagattttagcattgacgtcagtgcagtctaacacttcagtctcaaagttctagatatccataactctagtgacctttccttctacctatacttttagccattcactcaaaggaccaaactttaaggctctttcacttcagatacctgaaattccaatattctactctgtgatcatagtcataacattatttcaagtttctttttcttccctttacccttgtttctattttcccctagtttacccttctctacctcatggttgttcatctaaatctcccagtcaccaatgcaccataatttctattagaaccactcgaaaaatcacagccccaggtcagtgttacagtctgcattttctgatcctttacctggcctgctaaaaagctattggggaaaaaaaaagacacaaatgagcagagtggtggcactggaaatcgtggtctccaactcagctaggtttacagtgcctcctgttcatccttgttcttgttagtcagcattttcatacttctcaaccactattccacaccttctctgttttcaatccccacctctttttttcagcctaattcttggcctgctgcttcatgcctgacaatattctgatctttgtcagtgtctcagccctccccacccctacagtcttacctatccttgcctcattttctgcaatctcaggaaaagggtttcttctcctattcaaggacaagtcttccttctgatgtttgatcattatcttcttccccagcattctctagaaacttactctttcctggaatcctcaaactctcccattctgttggttctattttgtttagtctactgacatgttcatctccctctagttacactatatagcttctttctttctcatccaaacttccacttttttatcttccctttattctgcagtattttgtagtctggcttactactatgaaaatgatcttgcttaagttaccagtgacctttgtattgccaaatttggtaggtactttttaatctgtatcttactggagtatttaatctgtatcccatgtcttctatgatgccatactctcttgaatttccttcaacctagattaagcacatttctttctcattctggtcttcctcttcttctttgccccctaactattagtatttatgagaattctgtccttagcccactgctcttgcttatataaatatttctttctgttcctcagcctcctcctattccaaccttttccttcttcccttttccctctttccaccttcttacttcttccctcactctcagaagatgatctcacctcctataccatagatgaaatacaagccatgatgtaagaactcctccacttcacccccagcttttcttcatttgcccatgtcttttatgttggcattttccaaggttatattctaagtccgcttctccttttctctatgtattctccttgacccatctcatctctttctatgctaatgactcctgaatctgtatcagcttcctttaaggtagcctcacttgggtgtctcacttgccctgtaaatttattcaacatgtctaaaattattcagctataccctcctagtactacatcacccatacctgcttttcctcctatatgcctgtgtcattaaatgacacaccatcctcccagttacacaagtaaatacctagggaatcctctctctcatctcctacattcaacagttaacaagttctggctgctttatttcctaaataattctgagatccatccagttttctccagtaccaatatcttgatcctaatggaggtagtcaacatctcttccttgcattactgtagtaactttttttttttttttgagatggagtcactctgtcgcctaggctggagtgcagtggcgcaatctcagctcactgcaacctctgcctcctgggttcaagcaattctcctgcctcagcctccggagtagctgggattacaggcacgcacctccacacctggctaattttttttatttttagtagaaatgaggtttcaccatgttggccaggctggtctcgaactcctgacttcaggtgatccacccacctctgcctcccaaagtgctgtgattacaggtgtaagccacagcgcctggccctgtagtaactttttagctggtctctctgtcttactacagtctatcagtttattctctgtcaatctgaatgtactatttttaaggtacaggtattaatatggtattcctctgattatgcctctacaagggcttcccattggcagtctccttaatatgacttacaagaccctttagatctagccccgaccccatctccagcttcattttttatcactgcccctttatgctacatgttcctgttataaagggctttttataattcctagctctgccttgttttctgttcccttgagcctttgcccatgctatttcttctgtctggaacaatttcttccttacctttaccatatcctgttgcaggttaacttctattcaggcctctaggaggactctatagccgtctcattttttccatgtagggatcatgtccttaacatatggcagtgcctagcacataagaggcactaaataagaattttctaaatattttataaaacaaaaaaatgagttgcttgggttgaaggtactcctggggccccagagtattgttcacttgactgtctttcagtcccctctactcttacaaccaattcccatgaagaatcctaaggctcagtagaaagcagtttggaaagcatggcccaaagatgaaatacaaaatccttcaagtgatgcatatgcccttcacgatgctctaactcctgtctatctttccagatccatttcttttgccactatgcaaggtatattatgctacagcaatattgaagtgtatgtggttcttcccacctccctctatacatgcagccatgctgtttttcatctctgtgcttgataagttcattctggactctcttcctagaagggctatatccttcctaatcccttgtttctcctagctaacttattcattatttcaaactcagtttaggcatcaacactttgcagaagcctttcctgatactactcctcccaaccccacactacctaggtgtcactcctggatggtctcataaagttttgtgcacttatctctatttacctagcaggtcattttacaatccatgtgtatgccacttcggttacactgtgagctccttgagggaaagactaatttatccatttctgtatccctagtgactagcatagcacctcatccattgaggtacttaataaatgtttactaatgaatgaatgaattgccaaatgttttttcctggactgtcctcagccccctatcattcttcctctgcatatttttccctgaagaatctcttttattttcatgttttcagttagaagtaatcaagatggtgttatgtccaggggactctgtgatcaacatatcctgctatcctggcccagacaacagcagcccattagcatgaggttcccaagatagaaaaatacacaaaggataatggcaaaggaaggcaaagtagcactttgttaactaagcctttgcttcaaaaactcaatgtagaaaataatggtaagccaagcagtgcattctttttcctgtgaacaatccatcacatctaccagcactagaggagcaggagtagagggcacatttgccacagttgcttagtgtcaagacagctaaagcctcaattggattactggcccccagccaggtgtctgttccatatagcgaaagtgaaaaaagaatcaggaagctggcctagcctcctctcttgtagttgggcttcctacttcagtgacaggagtataagaggaagaaaagagagctgtccaggcttgtcaggctctgaatctagagaagtttcatcccccatctctccccagcacccgctacctgctgcctaaaaaacacacagtttcaactataataccttctatatgttgatgactcaaattgttatccccaattcaccatgccttctatcattctctagctataggcaactcttgtcattagggtgttctttattacccccacatacctggctctgaccttaggtttactgatacaaaagaactcggggaatcagtttttaccaaagctataccaaatctcatgatggatttttctcccatttaaacatggaatcttagatataaaaagagtgtggtattctctaggagcacataagtatttaggcaaaaagcaaaatctaatgctctagtcttgagatcttttcattttccttttccttttagataatattatttagcatgatacttattttatcaaagttcctcaataactgttcatttcctcccatttcctttttttctctttaaaagaaattatataacttgagagattgttaagttgctattgaaataaaattttctgttgacctcatcttctttgtctcctctagtctccattctagctgaaacagaagaaatcaagaccattttgaaggacaagggaatttacgtggagaccattgctgaggtataccccatcagagtacaaccagctcgtattctcagccacatttattccagcctaggtaaggagattggctagcctgctagaatcaaagcattattcattataggctggtttccatccttttttcttcttcatgattgtgtattgctttattaagctggatctgagaaggaatttagagtctctagaatccaattttcttaccttctctattctgagcaggcctgataattttaggtgtgttttatgaaccctttgggtacataaggcatgactattatcagccaatattgtatctttattccaagtgtgtgcttaaataacatgttctctcctttcttggagcctatacctctttttcaaatacttgcttattttatatggaatgatagccaaggaacttgtttttaggtcttttatactttgtcatttaatgaactagttgataatataaaagattccttaatataatacttatttttaattagtacttatttttttaattaattcacatattaaacttagtgatagattttttgcattaaacaaattactatattgttatctaaaagaaattctaaactactcttgtggaagactgaataatgactccccaaagatatacaagtcctaattcctggaacctataaaccttaacttatatggccaaatggactcatttgagatagggagcttatcctggattacccaggtggtccctaaatgtaatcacaagtgtccttataaaaggaatcagaggaagaccagactataaaagtaggagatgtgacaacagaagcaagagattatagtgataaggctatgagccaaggaatgcccacatcatctagaagctggaagaggcaaggaatagattcttccctggagcctccagaaggaatcaaccctgctgacactttggttttgattttagtcccataatgctcattttggactcatgatgccaagaactgtagaagtataaatctgtgttgttttaagccaccaagtttgtggtaatttgttatagaaccaatagaaaagtaatacaatcttaaaccacaagggagtagatttgtaaaagattggatcttaggtagtggattgccacttacaaacccagaagttagtttgtatatgtgtgtgcgcgcgtgtgtgtgtgtgcgtgtatgtgtgtatgtgtacttttttatcacccaagaatggtatgttagtaattacagttaaggcaagtattcccagcttaaaaccagtctccttcccttttctctggcacgtaactccagtcacttaatttctttgtctaaattgagagggaatcaaccaaggaggaaaggaccaagagtcagagctgacttttgtctgtctctaggaacatatatttaatgccaacaaggcttgaactccttgcattccggagctattaacatggcttctggctttaggagtatatggatttctttcttccatcttagctatgatgtaggaatgtccctttcctaaaaattcaaatataacatgattagaattttctaaagaaactttgctttaaaaagataatgaaaaactaaaatatatacacaaagaaattaacaaatttgttgaatatgtctcagatcctaataaatttctaaaatctagccacaaattagcttgaatattataaaatactcctggttccctctatttactcaaccctaactgaggtaaataccaagtcaaggctcctgaaacttctgaggctgatttgggtggatgctttgctaggtgggttacatacctcaccccttcccagaacctgcttcctgtttttattttttttggccattccctgtcaccccagacctataatgcacttctagtctccagatactagtccactagcactaaatcccttgagataaggaaggtatttccctatttagccaacatcttacccacttgagtactagttgatcttacagtcaccttctttgtaactcttagaagtctctgcagtaatgggtttatgcaagtcctgttggtgattttgacctgattctctctggctctcactcaaaagttaataggttaattttacccattgcctcattgcatctattattctaaatcggcatatcttactgggaaacaggtaacttctaagctctgggccatcatttatggaatctgcctgcctcacatcaggtctctccaacaaatagaagcaatctccttactatttactttttcaaaacctagactccatcttgggcctcttactaagttcttattttctagccaaaggaaataaaaacttaatgatgatcaaacattccaaggactcaagtgacaagtggacatttatcttcctgatacgttctttcatttgcttcattcattcattgataagcatttattgctcacttattatgtaccaggcactgggctagatgctatggaagacatagccatgcaactaaataatcacagtacaatcttataaatgctatgaccacggtgttacatataaaacacagaagaaaggggatagatttgcctggggaagtcaggaaaagcgtgatagatgaggcaacatctgatgacttatcagtcagatgagtgactattcaaaattctattattgcaacagtttcacaataaaaaaattgccctaagggtacgtcaaatgacaaccataattccatgaaggaaaaagggctatttctttaacaggtgtatttgtttatatatgttaactaaacggagttctctttctcccctcaaatgctcagtatttcattgtcagttccaaaacattttttttatttttttaaattatgagattaatcaactttgtgaaagtaagaacttaaaatattaagttcaaatctttatgtaatgctaattcttttctaatcttagtgcatatagatacattttaatagttatctttaacatgcctatattcacttgtgttctgtttgttttcacttattctctcgtgatgcatttccacatattgaaatagctatatagtatttcatcaaatcaaagtaattgtttcctgattattagctgaatattttcaagaatttttatccttctataaatgcctttgtatagaccactgttttcttaattgtatattctcagtaaagggattctggataagcttgtgaacagctttttagctcttgttacatgttgccagatgattatttacaaagacgaactaattcatagtgacataactaagatataaaatatacctttcttttttactaccccactaacattggagttttatttatttttgttagataagtaggttttagtatgtataaattattttaattttctatctttaattcccagggacctgtacgtttttctatttttgctttacctctttttttgaaactatgtgtctacaattgcttgcttatctaatagggtctgcacatttctgtatatatttatcaattatttatattttatggtaagcttttatcagtgagacttatatatatttcctagtctgttactttcttttagataattattttcttgcctgtgtacaaatctttaaatattagatacatccattttatcagatatatttttcagtccttcaagaattatgaatttatctcctaattctatctgaataggtatgctattctggttctctccaaatttcataagttgtaagttatctgattacaaattggtatgtatgcattgactgcagggaactggaaaacagacaagcacaaaggaaaaagataacaatcgcctgtaattccaccactcagaggaagccaccttttattttggcatatttgtttccaatcattttaaataaaataagtacaaacatgtttttagaaaaatgatatcattaagaatggattttgcattctgtttttcttgaaaaataacagtatatgataaactctgttacattttggtaagtagccacctacaatccagtttgatagctgtattaacgtaatttcttcaaaagttattttcataaatagcctttttctgttaattttgcaaatcgtctccttatattcttttgccatttttctactggatacttgttgatttcttactgatttccatgaggtatttttaaatatattagggatactgacactttctcttccacatgttattgaaatattttgctattttgttatttgccctttaattttgtgctgcttttcatgtatagaagttttatattttatgtagtaaaattttctctttttttggattctttccttgctgttacacttagaaagatagtcccatccctaggtcaaatacattttcactgcattttctttgttatttatggttacaattttacatttaagtcttaggctataatattaattttagtttatccaatgaggtaaaaatctgactttttgccaagtaaccaatcgttccagcactactgattgaatagttcatatataggttgttttgaagttccacctttataatttactgtacatgcatatactcactcacatgtgtggatacttttaatcttactttttggtgctgctgatcactgtttcttctttcctagtactatattttttaagttatcatagtttcaacctcaccaatgattgtgaaaatgtaagataaaagaatagtgctatgtaattttttgcccatcaattttacaaaaaaaaggtaagattgccaatatccagtgctgatgaatatgtggagatgtggacactctcagcactcctggtagtgtaaattagaggcaggtaggcattacctataaaaaaatgtaatgcacatgtctttgaccaacaaccttacttctaggaatctacccttttctttttctttttctccccccaagatggagtcttgctcttgttgcccaggctggctggagtgcagtggcgcgatctcggctcactgcaaccaccgcctcccaggttcagctgattctcctgcctcagccttccaagtagctgggattacaggtgcctgccaccatgcctggctaatttttgtatttttagtagagacggggtttcaccatgttggccaggctggtctcgaactcctgaccttgtgatctgcccaccttggcctccttcccaaagtgctggaattacaggcgtgaaccactgcacccagcccagaatctatcctatataacattcgtacaagtacacaagggcatatattcaaggatgttcactacattataatctgtggtggcaaaacaacaattagaagtactataatgtgtataaacaagaatggtagaattatgtatattgtatcatagctaaaaaggtagactttcagcttccagctgtgatgaaatagcttgtattgggctgtcatactaacaataactggaatggctgaattttaaaaatgaaggtgagtgaaggcttcagagagtaattacaacagccagaacttgagaaactaaaaccttggacagaagggacactcaaagaataaactcactattctctgtgcagtttacctttgaggcatttgctgattcttaagttttgcttgcatgaagtaaggggccaagaaactaagcaggaagtctcactgttctacggagacaaaaattgcatttcaggaccttcctatgtggaaggggctgtgataaacaccttgggctttcagttgaaacccctaaagaatggactacaccttaggagtaaggaaaaaccataaatagacgagttcttagaaagcctcaaatacaaatcctaaaacacaatcttcttaattcctgattgggctaagaagatctgcttatactgtatctgcctactaaaataaactgaatcttctctggagggaaataatgtcatccagagcctctacaattctttatacaccgtattcagcattgaaaaaagaagacatgacttagaaaaccatgacttgttattaattggtaaattaataaaattaataaaagacaaaagaaaaaaataaaacagacacccagacttctattcaacatagcttttttttttttttttttgagagaagctctcactgtgttgcccaggctggtcacaaactcttgcgctcaagggatcctcccaccttagtctctgggacaacaggcacacaccatcacagtcggccatcattggaagttctagccagagcagttagacaagaaaaagatataaaagacatccaaattggcaaagaaaaattaaaatggtctccattcacacatgacatggttttatttaaaaaacaaaaacaaaaacaaaaaaaacctgtgagaactaataaacaaattcagcaaacttataggatacagaatcagcacacaaaagtcagttacatttttatacactaaaaatgaacaatttgacaaggaaattaagaaaacagttccatttataatagcatcaaaaagaataaaatacttaagaataggcttaaccaaagaggtgaaagacttgtacactgaaaatggaaaaacattgctaaaagaaatagagaggagacaaataaatggaaagacatgctgtctttgtgggttagaagacataatattgttaagataccagtacaacccaaagctatcaacagattctatgcaagccctatcaagagcccaaatgatgatttctgtaaaatagaaaaattgttctaaaatttatatggaatctcaagggaccctgaatagccaacatgaggatgtggagacatgaaaactcttgtgtactgtggatgggaatgtaaaatgtgtcagcccctatggaaaacagtatggcagtccctcaaacaaattaaacatagaattactatataatccagcaattacacttctgagtatatatccaaaagaagtaaaaataggaacttgaacattttctacatcaatgtgcagcattgcccacaatagccaaaaagtggaaacaacccaaatgtccatcaatgaatggataaacaatatgcaatgtatacacaaaatgtatacccaaaatggaatattattaagccttaaaaaggaaggagattctgacatatgctacacatagatgaactttgaagactatgctaaatgaaataagctagttacaaaaggaaagatattgtattattccatttatatgagataccgaattcatagagatacaaagtagaacagtggttgccagaggctgggaagcagaggacatgaaaagttacttactgttcaataaatagagtttcagtctgggaagatgaaagagttttggagatagttggtggtgatgtttgcacaatgatgtaaatgtacttaatgccactgaacttaaggttattaaaatggtaaatggtaaattttatgttgtgtatattttgcagtattaaatagaaacaaaaagtaaggagtagtgggaaaacctggttgtgacatcaatctcaggtaaaatgtgtgctttactgcatggaccctggaatatgaccaaggctttaacaattctctgatgctagccccctaagagtaaagcaacactaaaactggcatatttgataagtataacacttacgtaaagcaaatgaaaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctacatgataataacaaacctgattgtatgtgtttatggggaggagaaactattttctggaaagaaagcttaaactccccatttgtcatcttacatttgaaatagtgcagctgaggtaggtataaacaaaagagtaatggatcatagattctatttctgactttgtcatttgctagccatatgatttcactaatccacgtatcatctcttagccttatttttcatctattaaaagaagaaaagccctcactggggggttacaggattaaataaaattatatacttaaaaatacttcgtaaactgcagcataccgtaaaaatgtcagaaattattatatgtgccagttaaccccagatactttggaatgtattagacattaaatgtgggggtatcattgccctgtgacatcttggatactcttctgaatatatgagtagtttaaaatattacttgataattgtgagagtaaattaatctaatctattatttttatttgtctcagtttatagaccagcaacagttctacctggctctggacaacaagatgatagtggaaatgcttagaacagacctctcctacctctgtagccgctggcggatgacaggccagcccaccatcaccttccccatctcacacagcatgcttggtaagggctgcatgaggcaaggaacgaatgtattttggaaataagtcatagatttagcccttcaacatcttgttgtttctagagagctacttcttataatttattctttcagcagtatttattggctcctattttatgccaagcacttttctaagcactggggacacatggagtgaataaggcagatgaggtttccgttctcatggagcttatgctttagaaggtgaagacagactatatgtaatacataaatcaacatacaagagtaatttcagagctataattgaatagttttcagatagtttgagagctataattcaaaaaatgtagtggaggataatttaaaacttggttggtggttactttagataattagtttctaggtcaattttcagaaattttattcatacaattatttttaaagacagtaatactgtatctgcatatttcttactctagtggtacatcaagattttatagataatttcccaggctgcttcttccaaagcctaacggaagctgtaaaatctagtaggggaaaaagccaaaaggcttttggcttacgtttcctcttttttttttttttttgactggatttcctgacattgcttacttgaaactgggtgaaaggctttattattctctcagttcctggaggactagagccaatactgaagcgactgcttcctttctgtgtttctcctgttgcttccaaagacctgtttgtactgccaaagtatatagaattccttttcattaaagaaaaatcccttattattaatcattcaaaatccagacagactgttagggattttggtcacatctcaaaagtgcttcaatatcacaggatttgaggaagtagggtagtctttcttctctttgtctttcttcattacttaagacagttaacacaagtacccatttaaaaactactatatttgcagaattgtcttcagaaagtataaagtctaattggagacgaaaagctaatatgcaagaatgatagaaacaacttaagacaatatataaagaattactaaaccattaggtcagtattttacagtgaaggagatccagttgacaaagaaaatttctcaactgaggtaggacttaaccaggctttttggaatggatagtattcagatgacaggagagcagaaggaaaggtactataagtgaggaggaaaataccatgagtgagccctagaggcaagaatgaacttgacctgtgagaggagaatgaagttctcctgaatagagtggagtttgtgtgttggagtataattataagcaaaatgggaaaagtaaggtagggttcaataatgaagaccttgaaaataagcaaagatatttaatatagatttttctcagaagtctgaaactatcaaaaggttttgagcaaggagtaatatgataaaaatgatgtttggggactattggtgacagtacacattgtagtgaggagagactgatgtcaaagaaactaatccacatatgaggtgaagagaaagtacactggattggaggtaataaaagtagaatgaaaaagaaagatatgagtcattttaagcaacacccaactcagatattggataactagatataaggtatgaattaagatagctataacaaaataccaaaaagttggtaatttataaacaatagaattttattttgtactattctgggagctaggaagtccaagatcaaggtgctgacaggtttggtgtctgggaaggacctgaagtctctccttctaagatggtgccttgttgcttcatcctctgcagcagacacacatgtgttcttacattgtagaagggacagaaaagaagcaaacccactctcttaagcccttttataagggccccgatcccatccatgatggctgcacactcatgacttaatcacactagatggcctacttcttaatgctatcacattggtgattaagtttcaacaaacgaatttgggggcacattcagatcatagcactaggtaaatgttgctgcattgatagaatcagagacattttatatgaagaagccagttataaagggacatgaatttgtagtgacaaagagatttcagaattgaaatacctgagagttgggatgagatacatagccacagcttgggaagcagaataaaactaaagatctaggcttaaatcaagcatttttggtacttgatatgtggtcacataacaaaaacaacaataacaatagcaataataactgtaatatttactgaatactttctctgtgccaggcactgagctaagtgttttcaattaattattttgaaatctctacaacactcttattcaggcaggtactcattatccaaagtcacaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattagttaaattctcatattacagacaaagattcctgtaatacataaaagagcaaaaataatacataaatggcatccaggtggatgctatttacaatagatatccctaaaataaaatcataaaaaaagatggaagaaaagaatatgtaaagatatatcatgtaaatgctgacaagaaagcagtggtcgcagtattaatatcaaaaatagcaaataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtatatataactatgtatccaaaaaggcagaacacacaaagaatgtttatggttaaaaagtagaaatcatacaaacgatattgccagatacgtgacataaaactaattaacacagaatagttaaaaagaatctaactataaaggaattatattttttcccaaataattattagattaaagagaaagtcaaatttgaaattatatgcttcttagaaatgaaaaatgataccactacttataatttatgagatttggtcaaaatcatatttagaaaatttcatatccttaaatacttctacttttaaaaagtgacttttagttttgagacaagatggcatagactcacttctccctattcctcctgctaagtgcagctaaaaatccttgacatatataaaacaaacataagaaaactctgaaagttggaaaccaggcagatcagctagagactttaagacctgaagaacagcagagcagtaaatatcctgggccttatatgtcctggactggaagctagagaagctgacatctcagaaatacaaaaagaaaaaaaaaaaaggaaaaacaggtttttttaaagacccaaggaaaatctgctttgtctagctgaaggaacaggaaaggagcaacctagagagacagaaaacttttagaccctattttactaggccccacttatgcccctgtcagcagagactgagtggggactctagacttccacgcttgcacagctctgaagaggcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagtaaaaaaaaaaaaaaaaaaaaaaacctgaaaaaatatgaacagagcctcaaagacctgtaggactaataacaaaagatttaacattttttaacattcacgttaaaaagatctaacattcatgttataaaagtttcagaaagaggagaaaaagtatgagagaaaatcagaaaaagcattccaactaataatgactgaaaaattggtaaaagacataaacctacaaattttttaaaaaatgagaaaatcttaaacatggtaaaatccatgtcaaaacacataataataaagttcttgaacattaaagaagaaatatcttgaaagtggccagaaagaaacaataccatttctataagcaacaaacagaatgacagcaaatttatcatcagaaaccatggacaccagagggaagtgacacaacattttttaagtactgaaaaaaaaaagaattttaaaccaagaattttgccctatccagtgtacttcaagaataaaaggaaaaaagacattctcagatgtaggaaagctaagtgaatttgtcagcaggagatctgccctaaaagaatggtttgaagaaagttcttgaaacagaaaggaaataataatagatggaatcttgaaacatcaaaaagaaaaaataaaaataggagtgaaaatatgagtaaatacaatagactttctccacttcaattttccctttctttctctctctctctctctctctctctcccccacccccgctctttttctttttctttttctttttctttttctttttcagagtctctctctgtcacccagcctggagtgcaatggcacaatctcagctcactgcaatctccagcttccgggttcaagtgattctcctacctcagcctccccagtagctgggattacaggcatgcaccaccatgcccggctaagtttttgtattttttttagtagagacggggtttcgccatgttggccaggctggtcccgaactccttccacttcaattttctaaattatgcttgataagcattgcttaatatagttctcaaagtatgtagaagaaatattcaaggcaagtatattataaatggggaaaagtaaggaccttaatgggagataagattctatacatcactttaattggtataatgttgacactagtaaagagtgatatatgcatcatgtttgtatatataagacaatgcctggagtaaccactaagaaacctatagaaggagataacagtcaaacccagtataggtaaatcaaaatggcattctaaaaaatgtaaaagtaacccataagaaggcaggaagaagaaaatagacaaatgaagaacagaggtacaaatagaaaacaataaaatggcaaacttaatcctaacatatcaataattactttaaatagcctaaatacatcagttcaaatatcacaatatacgtagactgaaaagaaaaggaaggaaaaagatataccatgtaaacattaattttaaaaagcagaagtagctacattaatatctggtaaagtagaactcagagtaaagaaaaaaacaggtagtaaaagtgttaggaaagacaaaggagatatagcaacagaaatagaggagactttaaacactgtaaaagaataccaactacaattttgtacatctagataaaattgacagattttctagaaaagtaagaatacaagtataagctgaataggaacacttataaaagtgtatgagaaaaactataaaactattgaagacaataaaatattttaattagtagagaggtacaccatgttcctagacataaatagttaatattgagaaattacccactttcattatatcaattcaggcaattcccaataataataaaaacataaatttttatgaacaagctgaaccttgatttcatatgtaagagaaaatgtaaatgaataaccagatttttaaaaagaaagtgaaagatccattgtaattaaaacaatgatgaagatagaatttcaaatagagacaaaatttaatataaatacatttgggaaaataattcatttaggcttgctactttactttttttgcaaaaatacattctaaatagattaaagagctaaacataaacaataaacctgtgagagtcttagaaaaaaatatgggaggttgggcagggtggctcaaacctataatcccagcactttgggaggctgaggcgggaggatacttgaggtcaggagtttgagagcagcctggccaacatggtgaaaccccatctctactaaaaatacagccaggtgtggtggcacgcgcctgtagtcccagttacttgggaggctgaggcaggagaatcacttgaacccgggaggcggaggttgcagtgagccgagattgcaccactgcactccagcctgcatgacagaggcagactccatttgaaaaaaaaaaatatatatatatatatttatatgggaatatatatatatatatatatgggaatatttttgttatcttaggttgaagagagctgtcctttgcaagacacaaaaataaaatattgtcagattttgaaacatgaaaatgaaatcttttatatcaaaagcactgtggatgcggttgaaagaaaaataataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacgaaatcaggagattgagaccatcctggctaacacagtgaaaccccgtctctactaaaaaaaacaaaaaaaatacaaaaaattagccaggcgtggtggcgggcgcctgtagtcccagctactcgggaggctgaggccggagaatggcgtgaacccgggaggcggagcttgcagtgagccgagatcaagccattgcaccccagcctaggtaacagagcgagactctgtctcaaaaaaaaaaaaaaaaaaaaaaaagtgtaggaaaaagtctttctatactgttggtggaaatataattggcacaactcttatagtgggtaatttggcagtctctgtaaatttacttagtaagtgtttcatttgtcctaatagttctacttgtaagaatttaacctaaggatataatagaataagtgcatcaagatgtaggtacaatggtcttcattacagtgttgattataatataaaacagtctaaatttagtaagaattatttttagctattacaaaggtaaagttagaaagcagatcatgaaagagtatatgtagtatgattacttccacataaaatcaggtaattgttagctttctagatattttttatgcctatacacagacatatgtgccaaggttctttatatgagataatgtgtataaaatgtttagcacagtgcttggcacataacattcaacaagtagtggctactggtattatcagcattcagtagtcattcagtgttctgccatcagacactgtgctaagtacttctgacaaataagataatgctgacaaataagataatgcctttgaggaaatctatcagtcatcatcccttaccatttacccattcttaagtgttgttggctctcagatgaattgttaaaatcaggatggtcaatgaggagtgtctcatttgtattgtaaccaccagaatgttgatttgaaataattacaagatttctccctacttcagagttaaaaccacaaagattgttttaaaattctgttcatttcaagatgaagatggaacaagcttgaattcaagtatcctggcagcactccgaaaaatgcaagatgggtattttggtggggcaaggtaagtgacctctatacactctttagtgaaatgaaatgaaattaaggggctggatatagtagtggcatacctgtgatgcctttctgtgtatgatagtccccccttatctacaatttgactccgatatttcagttacccgtggtcaacctgtagtctgcaaataggtgagtacagtacaataagatattttgagacagagagagagactacgttcacataacttttattatagtatattgttataattgttctatttcattattattttgagctcttactatgcttaatttataaattaaactatatcataggtatgtatgtataagaaaaaacacagtatatatataaggttcagtactatctgcagtttcaggaatccacaagggggtcttggaacatatcctgcaggagtaagcgggggctaactgtatcttcgataacataatcccatcctacttagaggagtttgatagattgaatcaaggaatttaatgttgtagaggaaggttggaagtttttcctaccctgttctttgcctagatctcaaaggatcagaaaacctgttttgttttgtttttttaatgcctactggattatttgattccagctgcttttcttttctttttccacttaagtttttattttgaaaaatttccagcttacagaaatttgcaagaatactactgaacacccatataccctttctcaagattcacctgttattaacattttgtcccactgtgcattctctatttcttcccttccctcccttcctgcctttccccccttcctttctctcttcctccctacatcctcccatacacatacatatgcatatacacacacacacgtacatactacatatactatgtgttttatatatatatacatatatatacacacatgtacacacatgcttttttgctaaaataattagccatagacatcataactcttcaaccctaaatacttaagttttctttgttttgtctaggaacaagtgcattcttacatataactataatataatcatcacacttagtttgggaggccaaggggggcagatcacttgaagccaggagttcaagaccagcctggccaacatggcaaaaacctctctctacaaaaaatacaaaaattagccaggcgtgttggtgcatacctgtaatcctagctacttgggaggctgagacatgagaatctcttgaacctgggaggcggaagttgcagtgagccaggattgtgccactgcactccagcctgggagactgtggaaagcagtttggagatttctcaaacaacttaaaatagaactaccattctaccctgcaatcccattactggatatatatccaaaagaatataaatcattataccatagagacacatgcatatgttcatcacagcactagacacaatagcaaagataaagatgggcatcaacctagatgcccacctatggtggacttgttaaaggaaatgtggtatataatgcaccatggaatactacagtgccataaaaaagaacaaaatcatgtcctttgcagcaacatgaattcatatagaggccattatcctaagcaaattaacacaggaacagaaaaccaaataccacataccacatgttctctcttataagtgggaactaaacattgagtagacatggacacaaaaaaggaaacaatagacaccaggaccttcttgaggatggagggcgagaggtaggtgaggattgcaaactacctattggatactgtgcttactatgggtgatgaaatagtttgtacaccaaacccctgtgacatgcagtttacccatgtaacaaatctgcacatgtacccctgagcctaaaattaaagttggaaataaataaataaataaagtagaaggagaaataagaacagttacccaattatcccaataatgttttatcatagctgttttcccaccaatccaggatccaatcaaagatcacatgttagcagttagttgttatatctctttggtatcttttaatctagaagagttctccagccttttgtcaatctttcatgagagttttcattacatttttgaagaatgcaggtcagttattttgcagaacatctcacaatttggatttggctggttgtttctcattattagattcaggctacatgtttttggcaggaatactacctgtgtgatgttgggtccttgttttaagttaggatctttaagatggagagcaccccttcaatggttaggagaggcacaagatggaaataaagattttattacttacaggtcctgcaggtgaggtacacagaatacctggaggccacacacactgaggtcagggagcatgtggagagagaaaaagagagacccatgggccaatgcctttattgaggtccagggcattatccaaacagatattccttggggagttttaattggtgggtttaaagcaagtaggcatgacttcctggaggtcacactgtgactgagaggtggtcactgtggcatattggcatagttcatgtaggatgtgaggatcagtgaggctagtcaaatagatcatatttagctgtcccttagggaggtggttaccaggaggaagttgtataaggcagatatgtggactgaccacagtgaggaactgagggaggtgtagaactggaaactgtcaaagattcctgaactctgcttctggtatgagaaagttaagcttatattcaaaagagatgccagggaaacatacaattataagaatttactacagtctctttcagtgcatcatatcagaggcacatgagatttgtttgtgacattattgggtgatgataaccttgatcacttggttaaagtgttcaacctggtatctgccaggtttctgcatatcctttctccaacagtctttgatcaaatcgtattagcttccgttgatccttgcgtgaattcacttattactattggagttattaaatggtgtttctatcattctgtgtacatttattggttgaaattcttatgttaaaaaaaagagctttcccttccccccttttattttgtagtttagtatcagcacagattcatagattattattttattcaatatgccatgatccatttctgttattatttcaatattttaattatccaaggtgtggccattgatagccccttcaagttggcctctttagaaatttggtaatgctgactttgcttttgggttttgtaattgtcttcataagtaggagacgatatggcttacagtctactataatttacagaattgtcaagtaccatcctttatgttcaaatgacctttgggtatttttttaatgaagtgatgggtttgtgatgatttatcttcattctctccaggcttctccagtagccaatgcaaatttttaccagatgtttggcatagttagcaacgtaatatatggcagtagaagagagcaaaactggtctgctggtggattgttaatccataattgtaacctttattaatacagtcccctaaccatttaagatgtacaccatgcctaggagtgctgtaaaattttatttttataaaatttatattaatgtatgcacattagtaatcccccaacaaaacatgttaggtgtccttttatcactaagattgtgttgtttaaaaaggatcacccctgattttctgttttctatcctcctctaatttttagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatggtaaggaggcttcataaagcactggcctggctggacaaaactacaaaatattgtttagcaccatccttaataatttatgctgccagcagtctcacagtgttctatcctcactctagatctctacttttgtttggctttacttttcctccctctacttacctttggtttctggtctaatattcctgcggtaattgtggagtatggagttggacagtcccttactaagattggggaagattcctctcccaggcatttgaagtggctggtgattttgacatgggaagaagcagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaaaaaataaatttgctgccctcagtgaggtcagccagcacaatctcatacaataggacaacacattagcagtcagaaggactattttcttttttgggcccgacatttactcactaagcaccacttcattcattctgtgtttgtttttgtaagatctaaaacagttgaatttctttgttggaaaagtacattaaatacaaggctatttactgttatcagtaataacaaaagtcatgatgtcttggcataaaatactttgaaaattaaatgagaagatcatatattgagattgtttgctcttctatgggtagttgtgatttttatctgtagtactcattccattggattactaaaatatatatttctaatgatacgtgttactgaatttgacattatggcattctgagtcactttcctagttccgggtttactcatcagtgttctcaaaatgaatgtatttattgcttgccagcccttctgtgggtaaagagcttctctccatattcttcataatcctccactcaagtctctagattgtattcaaggttacaatctttgtcattaggatgtcactgaatatgagctccattcttacagctctactagttcgcattagtcacatcagagcacagaaagacatctggagagatcagtaaatatcatcaaaaaccagaagactcatgactgatacagcagactttggtatcgatctgaatagtgtgtttttctaactataaaccttgtgaatattcatgtaaagtctgaaatattaagcttccacaggatatatgtatgtttttctttccattacccatactcagagataatgttatagaaggtatatgggagaaggggagcccaagaagatagggaccatatccatcctcttcaccactgaaatgtcagcacctagtacactgcctggtacatagcagccaacaaatatttgctgagtaaacaaacgaggtgactaagaagatttttgccctttcctggcccttcctcaccaaagtcccctcacattagtgtgacctgaagctccctgttctgttcctcctccatccctgccaccattactatcacatgcacacacacaaatacacagattgctaaatgcttgctccaatgtaaaacaagctcatactgctttcaagaaccctgaccttgtctcagcaagttgaagaggaggtggatcctagtaaatggccatggtcactggatcttaaagtgatgaggttatatcatgatcacaagcttttcctccatgagctaaaaacaacctacttctggtgctgtgttgtgagcacaggagccaatcattctctttgctggggtagattgtaaagtaactaaaatattttcattcttttctcttccccctccccccactaaccttgcagctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagagtgagtaatgccgtgactcaccagagtcaggcacaggatgacgtgaagcccaggataggggcgggcattgattacaatgtaagcaggaactttagttttcttcactgctttatcccccgcatctcagacagcacctagaacatattagacactcaaatatttgtaaaatgagtgaattgtgtatagttatgctgcaggtagtgctatgtagtctggtttaactggtaacatggtaagaagaggcagaacaagagacatggagcatattcaactataacattaaagtttgaaatggtagaaagggtttttcctttgggaaaattacttctatggaattttcttgttgttccagcaatgtagagctgttttgtcaaatataatactcattctttacaactttgccattcttctccccatggccactaccctccttcagttgtattcacagtggagggtgtcttctgccacacattgccaggagtagtcatagttcctaagagtgttcaatgtctttatagtagctggatatgaaaggagagaagggctccttggccacacctagaagacctgaatgttaacattttacagatgaggagaatgactgagatgcatgctcttgctgtctaaaactttattgaccattactaaccaaatacattaaacatgaacattgggaatcatttaacatttataatagggaaaagctcagcataccctctgagtatgcttcctcgagaaagggcttatatgaagagatgaaatttattgttatacttctcaattgtgaaccagaaaacttgggcttaattcccagctctgctacttacttgcttgaacagttatttgagctctgtatctctctttctgtatctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcaaaatatacttattaattgcacattatttaaattatcttatattcatatttattttctttgatattaccaagaaaggagaaatttgtcattcttgttctatgaagaactgactcacatgtgacttaattgttgaagtcaactgtgcatttctattagtctcctaattacctaatatttcccataaatgtcatatttttgcagatgttcacatgtatcttcctacgaagttatttcaggcttcccggccttcattcaacttacttgattcacctcatccccgacaggagaaccaggtaaatttgtgcaggaggtatttctattagctttttgaaaaactgccatctttatgggaaataataggactagtcattatggttcttgttactaactagtggtacgcaaaatgctattctggtgaagatacatgttcttttcagttcacttttacattgggcaagtttgtctggtcagactttgggaaaactagattgctgtattatacatctggaaggtttcattacttttgctttgcctttcattagtatttaaagaattccttggaaaaggtttagaggtgaaaatatgactcattctaggacattatttaagttgagcacttgtgaacttaatttcttgtcatcatttctcaaactaaaggttccctctgttcgtgtagaaatacatcttcctagagaccagtctggggaggtggactttaaagcactggttttacagttgaaggagacctcaagcttacaggaacaagctgatatcctctatatgctgtatactatgaagtaagtggtggatattatcaatctagtttaatgttcataatcagaggaattatagcataataaatagagcacagcttttggagtttcgctgatctggaattgaatatagtttaacaacctatccatcatgtgacttcaaaccctcagttgtcctcatttatagaatttggattatatatacctcatagagttattgtaaagattaagatataatatccatgaagtctctaatacaatgcctggcacatggtgggtgatcaataactgataaatattactgtcattaggttatttttaagcctccattatttggtcaaatgtacagataagtttttaactcaagaaaagtaagaatatagaggtttataggagaaagaaactaacatttttgtttgctatgtgtcaggcatcctgctaggtactttgtattagtacaaactcaatatgtccaaattgaactcctctctcctaaaccccacaagcttacacaaaaataatctgttctccctccttttccatgttgtagtcaccatgaagaggcaggatggactttcttcccctaaatttggtttggatgttgagatagatggtgacatacacataccaagaaggtgtggaatatttattactcacataataaggctttctaggaagagcaaagaaggttcccagcttgctcccaaaaaggcttgagagcccagggaaaggagactaaattgggggttttataatcattacaggatgagcattctcactggcttctagttttctttttttgttgtgtccttgtttggttttggtatcagggtaatgctggcctcataaaatgagttcggaagaactctccccttttccttttttttttttattttttttattttttggaatagtttgaaaagaattagtattagttctctaaatatttggtacaattcagcagtgaaaccatctggtcctgggcttccctttgatgggagactttttattactgattcaatctcctttgttattgatctattcagattttctgtttcttcatacttcaatcttggtagattgtatgtgttcacaaatttatccgtttcttctagggtttcctacttgttggcatataattgttcataacagtttctaacaattcttttaatttctgtggtatcagttatatctcatcttctttttttgattttgaagtgaggtctcgctctgttgcccaggctggagtgcagtggcatcatcatggctcactgcagccttcactgcccagtctcaagtgatcctcccacctcagcctcctgagtagctggtaccacaggtgcgtgccaccatgtccggctaaatgtttttttaattatttatagaaatgaggtcttactatgttacccaggctatatatctccttttcatctctcattttatttatttgggtattctttctttttttctttgtctagccaaatctttgttgatttttgtttatcttttcaaaaaaaccaacttctcattttgttaatcatttgtattgcttttttagtctctgttttatttatttccactctgatgtttattgtttcttccttttactaattttgggtttagtttgttcttgtttttctagttactttaggtgtaacattatgttgtttattttagacctttatactttttgatatatgcattcattgctataaacatctctcttagaatagcattttctgtatcccatatcttttggtatgttgcatttccttttcatttgccaaaagaaatttttgtaatttccttcttaatttgttcagtgaccccttggttgtttaggagcatgtttaatttccttgtatttgtaaagtttctgtggtttctcctgttattgatttctagttttatatcattgtgatcagaaaagatacttgatatgattttgatcttcttcaattcattaatacttgtttgtagcctagtatataatctaccctgcagaatgttccatgtaaagttgagaataatgtgtattctgtagcttttggatggaatgttctgtaaatatcaattaggtccatttggtctagtgtgcagtttaaatccaatgtttgtttgttgattttctgtctatgtgatctgtccattactgaaaatgggctgttgaaggcccgtactattattgtattgtagtctatctcttcctttaggtatgttaatatttgctttatatacttaggtgctccaatgttgggtgcatatacatttacaatagttgaatcctcttgcttaactgatcccccttatcattatatggtgaccttctatatcactttttagtgttttacttaaagtctatttttttaagacagtcttgctctgtcagccaggctggagtgtagtgccatgaacatggctcactgtagtctcaaactcctgggctcaagtgaccctccaacttcagtttcctgagtagctgggaccacaggtgcatgccaccatggccagctgatttttaatttttttttgcagagctggggtctggccatgttgcccaggctggtctcaaactattgggctcaagccatccttctgcctcagcctcccagagtgctgggagttccaggtgtgagccacagcacctggccctgaaagtctgttttatccaagtagagttacgtctgttgtcttttgctttccatttgcatggaatatcttttttccatccgctcacttttagtccatgtatgtcctcacaggtggagtgaatctcttttaagcagcatatagttggctcttggctttttttattcattaagctactctgctttttaatgggataatttaatcaactcacattaaaggtaattattggtaggtaagggcttactactgccatttaattaattgttttccagttgttttgtagaatcaatccttccttccttccttccttccttccttccttccttccttccccccctccttctttccttccttccttccttcccccctccttctttccttccttccttccttttttatttctctcttactatctgtctttatggctaagtgattttccttcataatatgttttgattttttgctttttatttttagcatatctattatatgtttttgcattgtggttaccatgaggcttacaaaaaatcttaacaatttaactatgattacagtaaaagagaagaaaaatctctttaactcaacctcccaacattttgagtttttgatgtcacaatttaaaatttttatattgcatatcccctaacaaattattgtagttactatttttaatggttttgtcttttaaccttcatactaaagatgtaagtaatttacacaccatcgttagattaatagagtattcatatgactgtgtactcagtgacatatatcttcagatgttttcatattattcattaatgtctttttctttcatcttgaagaactccctttagcatttcttgtaaaacaggtctgatggttatatatttcctcagcttttgtttgtctggaaaagtctatgtcttcttcatttctgaagtattcttggctggcagttttttcccttcagcacgttgaatacctcatctcactatctcctggcctataagggttctgctgagaagtctgccgttaggcttattaagattcccttatatgttatttgcttcttttttctcactgctttcagaattctctctttgtctttgatctttgacatttttattataataggttgtgacatagtcttatttggagtagaatttattttcaaatatatatcttcctattgaacatgtctaaagtcaaattcactgtctttactacaaacctactgctgttgtctttcctgactctattctgggtatcatcattccttcaagtaacccagacttgaaattgtgtcattgtcttcaattcctccccatcccctgcctctcgctacagcatcaacactaccacagggaatcattggccaaatctaaatcctctatgatttgactttcaacttttatttaccattgctcttcccttacaatgtgaatgctgtcaccaaaacagtctatttatcatacccaaagcacagcctctacatgcctaccttcataccttgattcttattttttcttctgcctagaatattctcctttaccacactccatttctacttcttgcatttctctctgtcaaggcctaggtcatctgtcacccacatgaaacttcctccaatctgtaatagtaaaaataatcttccactgattctgagatctcatagcacttttttcatatctttaaaatttgacagtgtcagacttggagaaaagttgtgaggatagtacaataaaaattctggatagccctccttcagatccatcagatgtttccactgagcttttaatctctctctctctctctttcacgttgatgtcatcatctatactcaatcacacacgcatattatttttttctgaaccatttgagagtaagtggcagacacgatccccatctaaccctaaataattcagtgtttatttctgaaaaattatgaactctcctacataagcacagtataattgccaaagtcaaggaattgtttaacattaaaccaatactattaactatctacagatactattaagatttgtcatatagcccaatagtgtctttatagaaaagaacatctaaaatcatgaattttattgagttctcaggtgtcttgagtctccatttatctggaacagttcctgagtcttcatttttcatgttgttaacatttgtgaggaatacaaaccagttattttgcagaatatccctcaatttcagtttatgtgttgttttgtcatgattaaattcagattatacattactaaggtaatgccaagttcttttccatgtgtcatatcatagtgttgattagtcccattgctgatactgtaaactttgatcgcttggttggatcatttggttaaggtagattcttccatgtacctacactgtaaagttattatgtcatcttttgtaattaaaaaagtatcctgtagagatgtactttgagactacgtaaatatacggttactcttcaaacttttgctcactgatatttttcatccattaatgactcttcctatagcacattttatttcatgttttttaatttaatatattgaatagatatattcctatggttcaaaaatttttaagtacaaaagaatatacagtgagagggtaaaatgtctttctcccatctctgttcccccagataccctgttccccttctcatgggcagtcagtgttgtgtgtgtgtgtgtgtgtgtgtgtgtgtgtatcctcccatggacatttatggatatgtaggtaaacacagacatatatggggataattttacccctatttatccaaaaggtagcatagtatacacacagctctaccttgctttctttcactaaaactatatatcttgatgataactacatatatattccaattatctattgcttcataacaaatcactctgaaactcagtagcttaaaataacaaaaatttaaaaatttttaaattatctttcacagttctgggacttgcctgtgttcagccaggcagttctcacctgaggtctctcatttagttttggtcaacaatttctggggctggaatcttcacaatgcttgcccactcatatgtctaggggttgatactggctgttggctagaacctcagctgaggttacctacagctggtacacccacagatgacctcctcatgtgtctctccacatcttcacagcatgatgactaggttctactagtaagtgtcccagctgggagctctattactttgtatagcctagcctcagaaattaggtaagtcacttttgccttaatcacaagcatgcctgggttcaagggaagggaacacagaactcatctcttcatgggaggagtgcgagagtcacattgtaagaagagtaggttggataggaaattgttgcagctattgttgaaaatatattaccacaatctagatctacttcatattttctgaataattgtgtcattccattatttgaatatatcataatttacttagccagcctcttattgatgaacatttgaattgttgccagaattcacaatcacaaaaatgctatggcaagtaccctcatagcatacagcatttcacgtgtgtgaaatttatcatgcaagtaaaccagaactcgaattgatagatcaaaaaataggtattttttaactgtacaattaaatggctttgaatgtattcacattgttgtgcattcttcaccactactcattttagaacatttgcattaccccaaaaagaagccccacttcctttatccatcaacccccaatccctccattcccccagccctaggcagccactaatctacattctgtctgtatagatttgtttgcttgggacattttatataaattgagtcttgcaatatgtggtcctttatgacaggcttctttcatttaacatgatattttcaagattcatccgtgttgtaacatgtatcagtacttcattcttttattgccagatattatatcctgtataaatataacacatcttatttatccattcatcagatgatggacatttgggttctttctactttttggctattatgaataatgctggtataaacattcatgtacaagttaatgtggacatatgtttttatttctattgactgtataactagtagtggaaatgctggattatatggtaattctgcatttaaccatgttaggaattgccaggctgtttttaaatattttcaatactgatatatatttccaaatagctctccaaaggaattgtccaatttttattccgatcagcagcatattgatggtgcctgttttctcaaagcctcaccaaaatagtgttatcaactttagggacttttgacaatctgataggttaaaaatgttatcttggtatagtgctaagttaaagtttttctaggagtgaggttgagcaccttttcctatctttaaaagccatctatttgttttgccagcagtatttgttttgccagcagtatttgttttgccagattttcttttgtttttaattttttaaatctacatgttggagttctttatatataagggaaattatcctatgaattgcaaacattttttcctagttggtaatttgtcatatgactttccttacagtgatttttgaaataattcatttgttaaatctttgtctttaatttcaactatattgaagcccatgaatagggtaaaagaatgcattttgtcaaaagcacagctaaaactaagacttattcttgtgtaggtactggctttcagagctgactgttaatcatagttttataaggattcttagtaaattacattgatttcctagtgagagagacctatcaaaaacaggcatgttcattataacactgaaagaaaagatgattgccagaagctttacttaaaactgatgtagtcctgtcgttaaaattctagaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggtactataaattcttgaatttataccaaatctaaataagcgtgctttttaaaaattggtttctataattgttttttaaaacaaccatagcctctaaccatttgagatgtcttttccacataaaatttgatattcagttcttttagtttgtgaatgacaagtaagaattgtagatttataaaatgttataaaccataacatctttataatgatattaagaattctatatcttaagaatgaatttacactaggttcctacctcctagaaagggaaacatccatacaccattagtgggaatggaacttagtatagctacttatgtaaaacactatggaggttcatcaaaaaactaaaagtagaactaccatgggatccagcagtccaactgctgggtatatatcaaaaagaaaggaaatcagtatatgggagagatatctacaactcccatgtttattgtagcactattcccaatagcaaaggtatggaataaacctaaatgtccatcagaagatgagcagataaagaaaatgtggtatatatacacaattggatattattctgcatcaaaaatagtaaaaccctgtcatttacagtaacatgaatggaactggagggcactatgttaggtgaaataacccaggcacagaaagacaaataccacatgttctcactcatatgtgcgagcttaaaaagttgatctcatagaggtagagagtagaatgatggatactagaagctgggaagggtagtcgggagtgggggatagagaaagtttagttaatgggcatgaaaatacaactagattgaaggaataagatctagtatttggtgtcacaatagggtgactatagtttacaataatttgttgtaaatctcaaagtaactagaagagcagatttggaatcttgccaacacaaagaaatgataaatattgaggtgatggatgtctcaattacccaggtttgatcattacatgttgtatgcttgtatgaaaatatcacatgtactccataaatatgtataactcttatttatccataaaaattgaaaacttaaaaatttaaacaaattttttaaaaagaaagaaaaaaaccccataaaccaaccaaacaaaaaagttcctactttctaggagatagatgaaaagacctcattgtttcttcctagaaatccttcttttctgatcttcatggtattttctgaggaagagagttcagtgtgtcattatgttaaagaggagcaaaggtttttcagctgaaaagagaaatgtttgtggaaacctgaggtgttacagaaacgataatattatgctatctcttgttaggcctgcacagaccttctctcccaccagaaacatttgacagtaggacttcctccagaacctcgagaaaagactatctctgcgtgagtatggctgggtttggtcaggcttctctgagaaggagtggtgtggacttagaattcccttgccctaatctgtcagtggatgataatgtcctacatatgttcacctctatcagagacacctagtggaagaatgttggtaatggtagggcaagagtaaatgaaggagaaaactcacagagtagtactcaaactctttttacttgttggattttccatacctgccattcaaaaaacaaaacaaacagggtaccctgaattagcaaccacaaaatgtcagccatactctggaaagagcaagtgaaagaaagtggctagagcacagggctgaccatgaaactccatgctgctcatggggaataaaggggatggaggtcatagtcaaagaggaaaaatggttacttacagagcaatgtgaggtagcacccctccaggaaccctgtaatcagagtgccactgtctgaggtctgccacagcctccaattggaaacagtaccctaagataggcttggcctggagggagatgtaagtcaagtgatggggctgggatggaaaattcagtctttatacatgagtcttccttttgccattggccatgccagtaaaattcatctgcagtaaatgtgtttaatttcatatcacaccagtgccaaaatttaaatcttgcaaacagtctgtatctccaagaaatatttttagagagattctaacttcattcataaatgatctgaagaatctgtttttctactaggagtaatttttaaaaagggtattcccccctgcttgccagttctacttctgtagccaatgtagttaaaaaaaaacttttgtcaatatttctccctcattttttcctggttaaactctatccagagcatgttttttgtttacaaaattttttttactacattggctacagaagggatacttttgctgatgtctgcatactccttccttcctggtttatgtccatgatttctgttacccttgagttccagttcaagctcccatatgaaggcttagagaaacaaaagttccagcaagcttcaccaccgcgggcttaaagtgctctgggtactaaatagactcaaaaagcagtctaggccacaaggactgcaattcctgggcaaatccttgtgctatgctggactcgaagccaatggacttggggtgcatgcggcctagtgagacatcagctagagtgggcaaaggagtgcttgtgccacccctcttccaactccagatagtgcaactctgggagagaatccttccttccactgaggagaggagaggaaatagtaaagaggactttatcttgcaagttggataccagctcagccacagtaggatagggcaccaggcagaggcatcagactcccattccagtccgtagctcctggatgacattttgacacataccttgcaccagaagggaacctgctactttgaagagaagtacccagttttggcaggatttatcacgtgctgactaaacagcccttgggacctgaacaatcagcacagtgaccagacattctggttccaagtgtgaccaaacacatgcccagccgtggtgggtatagggagagactccttctgcttaagaaaaggagagggaagagtaaaggggactttttcttgcagcttaggtaccaggttggccacagtggggtagagcaccaagcaggtttttgaggtcccggattacaggcctggcatttggcctaggaactgctaacaaatgtacagtgcagtggtggttcaagaagttttgcaaaggagatgagagccttgaagatgaggagcatagtggcctgctattgaaagttgacaacgaccaattgagagcagttgttgaagctgatcctcttaaaactgcatgagaaattgccgaagaactcagcatcgaccattctacagtcagtcattcagcatttaaagcaaattggaaaggtgcaatgggagaaaatatttaccaactacctatctgataagggattaataaccagaatgtataaggagctcaaacaattctatagggaaaaaaatctaatagtctgttttaaaaatgggcaaatggtctgaatagacatttctcaaaagaagacatacaaatggcaaacaggcatatgaaaaggtgctcaacatcattgatcatcagagaaatgcaaatcaaaactacagtgaagtatcatctcaccccagttaaaatggcttttatccaaaagacaggcaataacaaatgctggcaaggatgtggagaaaagggaaccctcatatattgttggtaggaatgtaattagtacaactactatgaagaacaatttggaggttcctgaaaaaagctaaaaatagagctgccatatgatccagcaatcccactgctaggtatatacccaaagaaaggaaatcggtatattgatgagatatctgcactcctgtgtttatttcatcagtattcacaataaccaagatttggaagcaacctaagtgtccatcagtagatgaatagatcaagaaaatatggtacatatacacaagggagtactattcagacacaaaaaaaatgagatcctgtcatttgtaacaacatggatggaactggaggtcattatgttaagtgaaataagtcagacacagaaagacaaagttcacatgttctcactgatttgtgggaactaaaaatcaaaacaattgaactcatggagatagaaagtagaatgatggttaccaaaagactgggaagggtagcagggtttatgggcgttgggggtggagatggttaatgggtacaaaaagtagttggagagaatgaataagatcttgtatttgatagcacaatagggagactatggtcaaaataatttaattgtgcgttttaaaataactgaaagggtgtaattggattgtttgtaacacaaaagataaatgcttgatgagatggataccccatttaccctgatttgattattatatgttgaatgcctgtatcaaaaatctcatgtaccccagaaatatatacaccactatagacccacaaaaattaaaaattaaaaaaaaatttaaagaaaagaatttgaggagaggacataattcaatccataaaatcttgcttctggaaaaacaatcttttttgtatcagttttgtgacactgtaggtaatccaaagaagatggcatggttcatgccccagagtgctttgtgtcagcaggagaatcagaagtgtgtgaggatgtgtgtatacgtgtgtgtgtgtgtgtgtgtgtgtgcatgtgtgtgaattgaaactatagaaaatcaaacaactctgtcaactgtgattgtaaagtaataaaatggcttcaaaaaggcacagctagtattccattgtaggggtgggatgctgaagagatgttggttaaagaaggaatacattctaatgttcagtagcagagtagggtgactattgttaacaacaatgtattgtatatttcaaaataactagaagagaggacttgaaatgttcccagccaaaagaaatagtaaatgctcaaggtgatggataccgtaaataccctgacttgatcattacacatcctatgtatgtaacaaaacatcacatgtaccctgtaaatatgtagaaacattgtgtattacaaaaaaagcacagcttaaaattaatttagtactttgtagccataatagttacttgtcaaatgttcaaagctaactatgaaagactagtctagaagaacatcatggtgtgagttttaaataaattttgaaggaggaagagaatccagatttagagagaagagagcagagctcctctaagttgatatgggccagagtggtttcaggaggcaatgaatgagctttgaagtttgaaagaatcagaatgctattggtaatgatgaaatgttgaggcagtgacttggacttggataaagcttcttcattttttcaacatatttaagattaagtggttgtagaatattgtctttctttgctgtctttttccttagacctctgccctatgaggcgctcactcagctgatagatgaagccagtgaaggggatatgagcatttcaatccttacacaggtgagaagaattgtaaaggctaatctggtgactgatattttaaagtttgttttcaattgatctagcaatttccaaagacaacaaaataggcattgtgagacctaggccattatttttgtctatatctactctgtgtgcaggaaataatggtatatctagccatgtatatgcgaacccagcctggcctctttgctgaaatgtttcgacttcgaattggtctgatcatacaagttatggcaacagaactggcccactcccttcgatgctcaggtacttaattcagtaactattttaggtggaattcacttttgatgtaagtttatagagtttggaataaggaaagaaagaaagctaaaacatttttatccatagctcagaagctggatatggcaaccttgttcccctgttggtcactatttatgcaagtcaaggagctgatatgatgacacatttgtgtatcagttcgcagcttcagaatgccatctcctgtgggctcttcactccaaatccctcttgacttatcactcgttgctaacttcatttctctaactctggagagtatttgagtgtgacagacagagttgggttaagatttaggcagtggagcgtctgtacaccaagaatgagtcactacatcagtggatcatggtgtcagtattctgtctagtcaccatcatgactgaataaaggaagatgacattttcattaacatctatctgacaagactctctttgaaattaactataggtgtatttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaattgttttatacctaccatatgccagatactgtgctttttgctttaagtttacatatattgtgtcatttaatcctttcaagaatcctctggagaagaaggtattattgtgtcacttttaccaataaagaaactgaaactcaagaaggttaactaacttccccgaagcaacatagctagtaaatagtggaatttgagtctgagtccacctgattgcaaatgatttctagttcagtacattgttatagataaacattatatagtataatgttgtttttttttttgcgagagagtgtgattgctcaataataaacctcaataagggataagcccctgaatattcacttttccttaatttagcctgttatatttcttgttttcctgtggattcatgaaaaccatggctctttattccttataggataaagtcaagatccctgggtctgatgtttaataccctcaacagtctggcctttatcttctactcccacagtacttcccactaattttgtcagttccagtccttggagattgatgtctccattgatttcaaaggcaattattgtctatacctctcatttggcacatagaatatgcaatgttttattgtttatcttgttttcatgttccatcactcccaaagagatagtcagactcaagattaggtatcatgtcgtcatacctgcttgcacaaatgttacttaaaatgatgacctgcatgtagtctacttttaataaatgtgtgatgctgattaacatgttcaagttatcctcatatattcataatttcatggattcaaatctatctcttttaagtctctattatttccaggctgagaagttttaattattttagtttatctgcatatatacattcattgtctttctctgaatggcctccagttccattgttcttctttcattcttcccaccttcaaataaagattttactaagtaccctaatggtctggaagcagggtgaagaagaaatcaattacctcgctaatccacaaactggatagtcagtccttaaataattaagaatctatggaagtaagaatacctaagcagtagggtgctatcaatttattttgtaattctgttcttccaatcaagtgactcagaaattctaagcaagaaaagaaatagagaaaatatagagagggcatggcaggcaaattagaagtccttctgttctaacatttctgctgactagctgaggaagccacagagggcctgatgaatctcagtccttcggccatgaagaatctcctgcatcacattctcagcggcaaggagtttggagtggaacgaagcggtgagattgaataactgcattttcatttcatactgtttggtttaagtgtctcattggttttaaaatgtttttccttcatcacagaaacctttttccccaaataaataaactccaatatataaaacagaaaccaagctgtcttctggaacaagatttggaaaccactatatttttccttaaatggtatatcaactaagtggattgattactatcatgtttcatttttaactgtttaatgcattccctcacattatcttaagcctccactttaggacaactagcaacccatatcatctgaaactttcttgtattctaattggcaataattcagtagctcttacagtattgtattatgtgtatagctgcttacagtacttctaatgtaacccttcaactttaaactcacaaattaatagtccacctacatttgtggttttggttggatttggcattgcgtacctaaagcagcagagcaaatgaaaagtggtcatctctcatgctcaactttcaaggttagggtaagtagatatatatggtcagatggatggatgtcagaccttagagtggtaaaagaaagttgaaaagcagtgcgtttcaagaagggtatcttgctaaaatgcacattttgattcagtagatctggggtgggacctgagattctactaacaaacttgtaggtggtactgatgctgttggtccatggaccacatttcaaatagcaaggttatagtttttaaattaagttaaaaataaggatatatatgaaagttttttttaaatgtgatggggaagaaattgaaccttattatcctctctctttctctgtaatctctcatactacatagttcgtcccactgattcaaatgtcagtcctgctatttctatccacgagattggtgctgttggagcaaccaaaacagaacgaactgggatcatgcagttaaaaagtgagataaagcaggtaagatactacctgggagattagctgggatattgccatgtttcagaacattcttttggaatcagactttgttgggtcatttattttgtttcacattctgagtttaatttgagccatttatgtttcaggtggaatttcgtagactgtcaatctcagctgagagtcaggtgaaacaactagggatcatttaacatggtttaacttacctttagttctgtataacatgcatgagctcatggcctttttacaaataagataacaagtcatggagtagattgtttgaatcgcctttataacagtcattttgcagatagctttcctttttctggaccaaagtactttgttaattttagaaggaaagtaacttgcatctgataataagaaattgaagtttctcttattaggactgatgtaattttggaattaattttctttataaaacaagacttagacttcaagcaaagagtctttgcttggccagagtttaggtgggcttctcaaccttttcctaggcccatttgtgcacttccttgtaaaatccagctttagcaagagaaccctgctaagtcagtttagccagaaactcctatcctcgatatcttatcatccttgacatctgatcaggctcctcatcttctaccacccccaggtgatgtccaatcaccctggcctgtcttcagcaaaaatcctgttaagatggtttagccagaatcctccctacctctgatgtttccctcttagtaattttccaccacttggctataaattcccacttgattatgttgtattcagaggggagcccaatctctctcccttactgcaagacctcattgcaatggttctgtacctattaacaatggtcctgaataaagtcttccttaccgtgctttaacaagtatcattgaataattttttctttaacaagatgtagaaaaggtgctgtggacacagagggagaaacatctaaatcagtctgggagatagtgggagtcactaaataccatgttgtagcctcttaatttttcctgcaggtgagaatagagagcggttgctttatacaaggaaatagttaacaaaagcttccatagcttctttttaaaactctaggaagtcatgtggtttcaagatctccaagttgagaaattactgatttggcctctcctagaagcacattttatgaaaagcttaaaactactcctgttttcagaatagaattatgatagcttgcagtattgaaacccccagaagaggagtggtgaaatggaaatttggagttttgtttttagttttcgtttcttttttttagctttttagcactggggtctcactatgttgtccaggctggagtgcagtggctattaacaggcacaaaatcctggattcacgcaatcctcctacctcagtcaccagagtggctgggactaaggcatgccaccaccttgctatttggtttttttaaaaggaattagaaaccatttaggaagacaatgagccagtgcttgaagcttaatttgaggtaacttgagtacactcatcaaataccctatggcatttatatttatgcaagaataagtatgaaaatggagtaagaaagggccttgtattcactttacagttttctcgaataatttgaataatctgaatattttcctatttgaaacgtgaaagaactacattcagtactgaatagttagttacattggcattatctgtaaataatctttgatttggttgagagttattggataaacattttataattgttgatagtcactcagtattacttataagttcattatatatttacaacttgaagtacatgttcccagctacattaatatgatgttgagacttgatctacccagctacatcatttaagttttttctaaacattcactacctataggttttcaagggagccaaaatcactaggactataatttagaggattgagagtcctaaatttgcattactttcttatttctaaatattaacttccatcctcacctgcctgtctggtattttgtattgttctaagccattttttccctatcactcaagaatgccctcttttctgattatgaaaaaaaaaattataagggtatttttatttcttttcccttcaccatggcttctagggtaaagctatttcatcagctttttaatgattatgtgctgactacatactgaaatagtctgtatttttactccactagtgacttaaaagtacaaataattgtttcctggcctcatatcttttaaaattttattttctcaatttgttctcatagtccaatggtggtcatcccctgggtatagatttgatgtcaccgtcttttatggtaactgctgtgatcttctcgtatatgccattcacatgtgctttgaatatgctcttatataaatcatgacatatactggttgattaaaaaaaaaattaatcaagaattaaaataagtataaagcaatttcatatatgggggtgaatcttttcatttattttccaataacatagggaagggagttcaactccaacctctttgcgatttcagaaaacaaaattcaatttgctaagtattggttaagtataaattcttggtcccaccctaagtacacagagtcagaaagactgcggatgaggcccagtaatctgttttatttagatgattctgatgcatttttaagtttgaaagccactgggttagcttttcttctgattatgaattcatttagtaaatattaattgagtgccagttttgtgccaggcactgtgaacaaaatggatgtggtctttgccctcgtgaagcttacaatttaggaggactgacctctaattaaatttatttggtttaaatcaaagactcataatggcctatgatttcagatttctcaagctgaagagatttaggctagacaattaccaaacaaaaaatggaaaattattcgaaacaatattagtatttaggttaacctaaatcaaataccctgtaatgaactaataagacttggccaactctatcatatccacactaacataggacaggggtatagaagaaaatttaaaaactcaaaatgattgatatttggctttggaaaacagtctgaattgtactttatcagatctataccctttctggtttgacctcacaatcaacagcctaggatcttggtggtataaacaagacaatgaagataattaaatggcagttcatctactcaatagatcagtgcgatagtcacttgccagtagaaatgtttgggggctcttttcttttttacattgcattggttggtgatttaggcatttggcccaaattaaaacgtgagaagttattttctcagaaaatatttctattatcttctatcttatatttatttctgaatttaaactgttaaccactttgcccaatgtattttatcctttacttagtataagtttttcaaagttcattatgttttagcatgtatcaaaagtttatttttttcattgctgaataatatcctactaaattaatgtaccacattttatttatccattcatcagttgatggacacctggattgtttccactttttggctgctatgaataattctacaatgaaccttcatgcacaagtttttgtatggacatatgttttcacttctcttggatatatatctaggagtggaagtcctgggtcatatggtaactatgtgtcgcattctgaagaactgccagacatgtccaaaagggctgcaccattttacattcccaccagcagagtatgagagttccaatttctttacatcttcaccaacccttacaattgtcttttttattatagccatcctgatgggtgtgaactggtatctcgtagtggttttgatttgcattgccctaatagctaatgatactgagtgtcttttcatgtgcccaatggccatttgtttatcttctttagagaaatgtcaattcacatttgtacctattttaattttttttgtctttttattgttgagttgcaaggattctttatatattctggatacaagtcccttttaagatataaaatttgcaaatatttctcccatcctgtgggttgtcttttcactcaataccattaagtattcttcaaacaacaaaaatttttgatttccacaaagtccaatttgtctattttttcttttgttaatcatgatgtttttggtgtcatatctaagaaggctttgcctaacccaaggtcacaaagatttattcctatttgtgttctaagggttttatagagttagctgttttatttaggtctatgattatgtatggagggatccccaagatcaccctcagatttaatgattcactaggaagactcatagatctcagcatatagtcatactcactgctacggtttattacacctaaagggtacaagatgcattgggcacagtgtaactacagtcaacaataatttattgtacattttaaaataataaaaagtataattggattgtttgtaacacaaaggaaggataattgcttgagataatggataccccatttaccctgatgtggttattatgcattgtatgcctgtaacaaaatgtctcatatacctcataaatatataaacctactatgtacctacaaaagttaaaaaaaatttaaaagagtcattggtcaaagtctagggaaaacagacacaagcttccagagtactctgtcagtagagtcaccctgcaatgagttgtgacaagatgtcattgccaaccaaggaacctaataaagactcagcacccattgttcttgttgagggctggtcacgtaaacagcctctgtctggcgtgtatcaaaactctggactcccagaaagaaagcaaacgttcaacataaaccatagcgtttgtacagtttaggcatggtaagccactgttattagttctgggaatggtgagaactctcccagaatccaagtttctaagtttctaaatgccagccaagggccaaccttgtaagcaagcctttccaagaatagcagttctggcctactgtcttaactcttttctgcacaatgggcttaatttttgtgtgtggtataaggtagagttcaacttcattcttttgcatgtggatgtcactgttccagcaccatttgttgaaaaggctatttttccctcatttaattatcttggcgtccttgttgaaaattaattgaccaaaatataatggtttatttttgaactccctgttctattccatcgatctatatgtccatcctataccaatatgacacagttttgatagttttgtagttttgatagctttagagtaaattttgaaatcaggaagtgtgagctctccaacttcagtcttctttttaaatatgaatgttaggatcagcttgtcagtttctgcaaagatcccagctggtatgttgatagagattgtgttcagtctgtacatcagtttttgaaatattgccatcttaatgatgttaagtcttctgacccatgaatatggaactatatttcaatttatttaggtctttaatttttttcaacatgttttatagttttcagagtatttgttttggacttcttttgttaaatttattcctacatattttgttattcttaacgttattttttaatggaattgttttcttaattttattttaatattgttcattgctgctgtttacaaatacaactaatttttttattatagtaagacatttaacatgagatctatcctttaaaaaatttttaagtgtacaatatagtatcattaactataggcttgatgttgtacagtagatctctagaacgttttcatcttacataactgaaactttatacccattgaatagcaagttcccattttcccctctacccagcccctgacaactaccgttctactctctgcttctatgagtttggctgtttcagatacattacataactggaatcatacagaatttgttcttctgtgactggcttatttctcatagcatagtatcctgcaggttcatcgacactgtcatattttgcaaaatttccttcgtttttaaagtctgaataatattccattttatgtattaccagattttcttttgccattcagttgttaatatatatttaggttgttttcatatcttgactattgtgaataatgctgcatttgaacatgggcatgcaaatatctcttcaagattctgacttcaattcttttggataaatatccagaagtgggattgctgaatcatatggtagttctatttttaatttttgaggaacctccataatgtgttccatagcggctgcagcattttacattcccagcaacagtgtacaagggtcctaatgtcttcacattctcaccaatacctgttatctttgggtgtttttttaaccacggtcatcctaacaggtgtgaggtgatagctcattgtggtttgatccgcatttccatgatgattagtgatgttgagcatctttacatgtgtgtggtggctatttgtatatcatctttggtgaaatgtctactcaagtaaaatttaattgatttttgttattgatcttatatcatgaaacttcactgaactcatttattagttgtagttgcttgttagtgaattccttagaatttctatatacaagatcatgtcatctgcaaatagtttttacctcttcttttccaatctggatgccttttatttcttttcttacttaatctccctggttcaggccccccataaaatgttgaatacaagtgataagagtggacattcttgtcttgttctgatcttcggggggaagccttcagtcttcaaccactcattatgatgttagctgtgggttgttgtaggaaaaaaatctaaacttttattagattgaggaggttcccttctgttcctagtttgttgagtgtttttatcatgaaggtgtgtcgaattttgttatgtgtttttttctgtatctattaagatgatgcgttttttatcttttattctgttgatgtagtgtattacattaattgatgttcagatgttaaaacagccttgaatttctggaatcagtcccacttcatgttgtataatccttttagtatatcactgaatttggttttctagtatttcctggaggattttcgcatctatattcataaaggatattggactgtagttttctggtgacatctttgtctgattttggtatctgggtaatattggcctcatagaatgacttgggaagtgttcccttctcttttctggaagagattgtgaagagctagtaataattcctctttaaatgttttgtagaattaaccagttaatccatctgtgcatgggctttactactatgtgggaacgtttgtttatttgtttgtttgttcgtttgagacagagtctaacgatatcacccaaggtggtctcaaactccggggctcatgcaatccttccgcctcagcctcccgagtagctgggaatacaggcacaagccatatgcccatgcaccacgagccaagaacccatactttgaaggaagttttgtacttactaatttgatatatttgtttgtaatagttctattaagatgttatctttctttatgagttggtttgggtagtttgtgtctttctaggaatttgtctgtttcattgagattatgtaatttgtccgcatatggctgcggatggtatgcccttataatcctttttctttctgaaggtcagaattgaggtctttatttcccctttttttcttggtctttctatctaatgatttgtctattttgttgatattttcataggaaaaaattggggattcatatgctttccctattgtgtttctagtctctatttcatttctttccactctaatccttattatttccttccttctgcttgctttcaatttagcttgctcttctttctttattgtcttcaaatggaaagtttgtttattgatttgagacatttatcctttctttaatataggcatttataacataaattgttcgttaagtgctgttttagctgcatcccataagttttgctatgttgtgctttcgttttcattcatttcattattttctaattttgctagtgatttttttccttaatgcatttattatttagaagtgtgttaatttccacatttgtaaatttccttaatttatttcgattactgacttctgttgtggttagagaacatacttcgtatgatttcaattttaaatttattatggctcatcttatggcccatgagggcaacaaactaaaccatggacgagctagaagtttaacagagataatcaggtcaagagacagctaagaatgtcccaaatcatcagtatttttatgacttttctcatgtatcaccagattgctttcaaaaaggattgtaccagcgtacagcactgctagctacatataagtctactagcttcactataacctctttgtcttggctgcttcacttaatatttggtttataattctgcagagtaggtttattgttcactataaagttcaaagacttgggccgggtgtggtggctcacgcctgtaatcccagcactttgggaggcccaggcgggtggatcatgaggtcaggagatcaagaccatcctggctaacatggtgaaaccccgtctctactaaaaatacaaaaagttagccgagcatggtggcaggcgcctgtagtcctagctactcgggaggctgaggcaggagaatggcatgaacccgggaggcagagcttgcagtgagccgagattgcgccacgccactgcactccagcctgggcgacagagcgagactccatctcaaaaaaaaaaaaagttcaaagacttcatcatagaaacagagataacttttgatttatgttctttcctctcctcttccaagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaaggtgagcataatacattgttgatgtctcatttttgccccttgaaattctcagtctccttggcagagatatgacatgactaatataatcactgcaattatgtaaaagtcataactcagatagacaaaaccaagaagaaaacataaaaatgaaacagttgatttgttattgtggcattattaataatttagtctctttctattattgttgccatagtcttgtttctaaattagacttttaaaatcatcacctctctgcttctggccatagttggacattgtgatacatttgctgctaatcaaacgaatttgttactaaagagctaactttctttgtagctgtggagggttgtaaatgttatttgtagcaacgtgctatcagtagagtaaaacaaatgtatcagtagagtaaaaccaagtatcagtagagtaaaacaaatgcagtacttggggagtttgtgttaggagttattacctatattttttcttggatgaaaactactaaataaatgcaaagtcataatgatggtaatagttcggagactctttgatgtgaccaatatttatttttcttttgaaggcctatttggccaaagaaatttaagggcatgccacactattatggtggtgacagttttagagggccaagaacactattatgctcagcataggtctcattcatagtctcttaggtgccactttctgcatcactggctttaataaggacctgaagatcacttcatccaggacttaaaacccttcagttatgttttttcccctttgggcatggatattcttccaaggacagaatcaggtgatcttttggaaaggtaaaagttggttcctcagactatgggctctggcaatcttcctttaaagagtactgataacttgctttttttgcagctaacttctatagcacaatggtgacaaatattattttatctcttcagttatgcatggattatggcaatgttctatgtgctcatacagcaaagaacaaaacagataataatcttcattctccttgaacttatattctactagggaggaacaaattataaataataaacagtaaataagcaaagtatctagaatgttaaaagatgataagtactgtgtaaaaacaagaacagggtatgagtatttatgaagggatgggatgcttagctagcaaatgtagtaacagtacatgtccgataaatgcatgtcttgatttcattttcaaattaagactttatgttcaaagaaaagcacttaaaatttaaatgaaaatatattgttttaaatcattcataaaccaatatctctcatatacaacatgcagtgtacagtaattaaaattggcatttctgaaagctttgttataaagatatttagagttatacccagtaacagatagctttgttgaatactgtaatatggaacaatagccagttctataaatgactttaaaattctaaaactattggtgtgctaggaatgacaaatttgatttgtgtgaatactctttaaattctgtaaaggtttttttttctttttttttaattatactttaagttctagggtacatgagcacaatgtgcaagctcgttacataggtatacatgtgccatgctggcccactgcacccatcaacccgtcatttacattaggtatttctcccaatgctatccctcccctcgccccccaccccatgacagacctggtgtgtgatgttccccaccctgtgaccaagtgttctcattgttcagttcccacctatgactgagaacatgtggtgtttggttttctgtccttgtgatagtttgctcagaatgatggtctccagcttcgtctatgtccctgcaaaggacatgaactcatgcttttttatggctgcatagtattccatggtatatatgtgccacattttcttaatccagtctatcattgatgggcatttgcattggtcccaagtctttgctattgtgaatagtgccgcaataaacatacatgtgcatgtatctttatagtagcatgatttataatactttgggtatatacctagtaatgggattgctgggtcgaatggtatttctagttctagatccttgaggaatcaccacactgtcttccacaatggttgaactagtttacactcccaccaacagtgtaaaagcgttcctatttatccacatcctctccagcatttgttgtttcctgactttttaatgatcaccattctaactggtgtgagatggtatctcattgtggttttgatttgcatttctctgatgaccagttatgatgagcattttttcacatgtctgttgcctgcataaatgtcttcttttgagaagtgtctgttcatatcctttgcccactttttgatggggttgtttcattttttcttgtaaatttgtttaaattatttgtagattctggatattagccctttgtcagatgggtagattgcaaaaattttctcccattctgtaggttgcctgtgcactctgatggtagtttcctctgctatgcataagctctttagtttaattagatcccatttgtctatttaggcttttgttgcaattgcttttggtgttttagtgatgaagtccttgcacatgcctattgcctaggttttcttctagggcttttatggttttaggtctaacatttaagtctttaatccatcttgaattaatttttgtatgaggtgtaaagaagggatccagtttcagctttctacatatggctagccagttttcccagcaccatttattaaatagggaatcctttccccatttcttgtttttgtcaggtttgtcaaagatgagatggttgtaggtgtgtagtgttatttctgaggcctctcttctgtcccattggtctatatctctgttttggtaccagtaccatgctgttttggttactgtagccttgtagtatagtttgatgtcaggtagcgtgatgcctccagctttcttctttttcttaggattgacttggcaatgcgggctcttttttggttccatatgaactttaaagtagtttttttccaattctgtgaagaaagtcattggtagcttgatggggatggcattgaatctataaattatcttgagcagtatggccattttcatgatattggttcttcctatccatgagcatggaatgttcttccatttgtttgtgtcctctcttatttccttgagcagtggtttgtagttctccttgaagaggtccttcacatcccttgtacgttggattcttaggtattttattctctttgaagcaattgtgaatgggagttcactcatgatttggatctctgtttattattagtatataggaatgcttgtgaattttgcacattgattttgtatcctgagactttgctgaagttgcttattagcttaaggagattttgggctgagacgatggggttttctaaatatacaatcatgtcatgtgcaaacagggacaatttgacttcctcttttcctaattgaataccctttatttcttcctcttgtctgattgccctgtccagaacttccaacactatgttgaataggaatagtgagagagggcatccctgtcttgtgccagttttcaaaggcaatgcttccaatttttgcccattcagtatgatgttggctgtgggtttgtcttaaatagctcttattattttgagatatgttccatcaatacctaatttattgagagtttttagcatgaagggcttttgaattttgttgaaggccttttctgcatctattgagttaatcatgtggtttttgtcgatggttctgtttatgtgatggattacttttattgatttgcatatgttgaagcagccttgcatcccagggatgaagccgactcgatcatggttgataagctttttgatgtgctactggattcggtttgccagtattttactgaggattttcccattgatgttcatcagggatattggtctaacattctctttttttgttgtgtctctgccaggctttggtatcaggctgatgctggcctcataaactgaattagagaggattccgtctttctattgattggaatagtttcagaaggaatggtaccagctcctctctgtacctctggtagaattcggctgtgaatccctctggtcctggacttttttttggttggtaggctattaattattgcctcaatttcagaacctgttattggtctattcagagattcagtttcttcctggtttagtcttgagagggtgtgtgtgtccaggaatttatccatttcttctagattttctagtttatttgcatagaggtgtttatagtattctctgatggtattttgtatttctgtgggattggtggtgatatcccctttatcattttttattgtgtctatttgattcttctctcttttcttctttgttagtgtagctagcagtctatcaatttttttgatcttttcaaaaaaccagctcctggattcattgatcttttgaagggttttttgtgtctctgtctccttcaattctgctctgatcttagttatttcttaccttctgctagcttttgcatttgtttgctcttgtttctctagttcttttaattgtgatattagggtgtcaattttagatctttcctgctttctcttgtgggcatttagtgctataaatttccctctacacactgctttcaatgtccgagagattctggtatgttgtgtctttgttctcattggtttcaaagaacaccttcatttctgccgtcatttcgttatgtacccagtattcattcaggagcaggttgttcagtttccatgtagttgtgcagtattgagttagtttattaatcctgagttctaatttgattgcactgtggtctgagagacagtttgttgtgatttctgttttacatttgctgagaagtgctttacttccaactatatggtcaattttagaataagtgccatgtggtgctgacaagaatgtatattccgttggtttggggtggagagttctgtagatgtctattaggtgtgcttggtgcagagctgagttcaagtcctggatatccttgttaaccttctgtctcattgatctgtctaatattgacatggggtgttaaagtctgccattattattgtgtgggagtctgagtctctttctaggtctctaaggacttgctttatgaatctgagtgctcctgtattgggtgcatatatattaggatagttagctcttcttgttgaattgatccctttaccattatggaatggccttctttgtcttttttgatctttgttgctttaaagtctgttttatcagagactaggattgcaaaaccctgcttttttttgctttccatttgcttgggagatcttcttctatccctttattttgagcctatgtgtgtctctgcacaagagatgggtctcctgaatacagcacactgatgggtcttgactctttatccattttgccagtctgtgtcttttaattgcagcatttagcccattcacattaaggttaatattgttatgtgtaaatttgatcctgtcattacgatgttagctagtgattttgctcgttagttgatgcagtttcttcttagcattgatagtctttacaatttggcatgtttttgcagtggctggtaccggttgttcctttccatgtttattgcttccttcaggagctcttgtaaggcaggcctggtggtgacagaatctctcagcatttgcttgtctctaaaggattttatttctccttcacttatgaagcttagtttggctggatatgaaattctgcgttgaaatttcttttctttaagaatgttgaatatcggcccccactctcttctggcttgtagagtttctgccgagagatcagctcttagtttgatgggcttccctttgtgggtaacccatcctttctctctggctgcccttaatatttttttccttcatttcaacctgggtgaatctgacaattatgtgtcttggtgttgctctttttgagaagtatctttgtgttgttctctttatttcctgaatttgaatgttggcctgccttgctagtttggggaagttctcctggatagtatcctgcagagtgttttccaccttggttccattctccccgtcactttcaggtacaccaatcagacgtacgtttggtcttttcacatagtcccatatttcttggaggctttgttcgtttctttttacccttttttgtctacacttctcttctcgctttatttcattaattcagtcttcagtcactgatatcctttcttccgcttgattgagttggttactgaagcttgtgcgtgcgtcacgtagttcttgtgccgtggtttgcagctccatcaggtcacttaaggtcttctctccactgtttattctagttagccattcatctaatcttttttcaaggtttttaccttccttgtgatgggttcaaacatcctcctttagctcagagaagtttgttgttaccaaccttctgaagcctacttctgtcagcttgtcaaagtcattctccatccagctttgttccgttgttggtgaggagctgtgatcctttggaggagaagaggcgctctgggttttagaattttcagcttttctgctctggtttctccccatctttatggttttatctacctttggtctttgatgttggtgacctacagatggggttttggtgtggatgtcctttctgttgatgttgatgctattcctttctgtttgttagttttccttcttgcagtcaggtctctcagctgcaggtctgttggagtttgctggaggtcccctccagaccctctttgcctggttatcaccagcagaggctgcagaacagcaaatacttctgcctgatccttcctctggaagcttcgtctcagggggcccctgcctgtatgtggtgtcattcagcccctagtaggaggtgtctcccagttaagctacacgagggtcagggacccactagaggaggcagtctgtcctttctcagagctcaaacactgtgctgggagaaccactgctctcttgagagctgtcagacagggacgttcaagtctgcataagtttctgctgccttttgttcagctatgccctcccgctagaggtggaatgtacagaggcaacaggccttgctgagctgaggtgggctctacccagttcaagcttcccaggcagctttgtttacctactcacgcctcagcaatggcggacacccctccaccagccaggctgctgccttgcagttcgatctcagactgctgtgctagcagtgggcaaggctctgtgggcatgggacctggtgagccaggcatgggatataatctcctggtgtgctatttgctaagaccactggaaaagtgcagtatttgggcgggagtgtctctattttccaagtacagtctgtcacggcttcccttggctaggaaagggaaatcccccaaccccttgcgcttcccgggtgaggtgatgccccaccctgttttggcttgccctccgtgggctgcacccactgtccaaccagtcctaatgagatgaaccaggtacctcagttggaaatgcaaaaatcacctgtcttctgcattgatcacactgggagctgcagactggagctgttcctatttggccatcttgaaatggagacccaaggttttttataaacatcttttttattaatcaatcataacatggcaaaattgcacacttgccatttctgaaaagtgatccaaactctacatccacagatgaaaaattcttatagaattttgtgaaaagcatacattttgagttaaaaaaattttatagctgttggagtgccatgaaattaatacttgcattttggactgctgtagtttatactttttatatgtttcaaatcaggtgtgcaccatttgtacttagaacaccacaaaatgaagtatctaaaatcccttgattttaatatgtgttttggtttattaacaaatgatagtaatttcttacacatttttggaaattacttgtataagaatatatgcatctgcttatggatacagtgtgtaaataaaacttgtgctcaccaaactatcgcaaggacagaaaaccaaacaccgcgtgttctcactcataggtgggaattgaacaatgggaacacttggacacaggatggggaacatcacacactggggcctgtcatggggtggggggaggggggagggagagcattaggagatatacctaatgtaaatgacgagttaacgggtacagcacacccacatggcacatgtatacatatgtaacaaacctgcacgttgtgcacatgtaccctagaacttaaagtataataataaaaaaaaaacaagtgttaaaaaaaaaaggaaaacttttgctcactaaaatataagtaaataaataaatgcatgtcttgagttttttcctatggcctaaaattttttctaaggcctgtttgtgatggccgtgcgacctagtatgatatctttccagatagtctctgaatatttgggactagtctatcccaaaagatagagctttcctactcattccatttccctaagtagaggatgaaccttaggtctcctatagtccaatcctgcatcttggcacttaggcatcacaactccatggcaagggcacttggactgcagagccccttgctagtctgtgattactcagcatataccacatgaggcacacttagaaatacagcgtctcctcatagcctccccgttgtttgtctatccttggtgatatggtttttggtgatatggttttttttctgttttgcagtgtcacggactttctgttgaagggtttgtccttccttcctctaccactagagaggtaagagtctctttcttgcacatttatgtgactgataactttgctggctaaagtatcccagtgatcacttacttttcaaagtgacagatccatgcttttataaatcaactgaacatgaaatgcatttgaagaaaagacaatttttttaatggaaagagaatattatagaataagtatggattactttatatgaagacaaattcttttaatggttgattaagttaggccggcttatgtgagcgttgtgagggttagacaaggcagagggatcaaaatctatgaatgcatgacttctcatgtctcccgtccttcacattcctacctttctctagtaggatgtttgtagaccattagaacataaaccagtggttgttagctacaactatatgttggggtaacccgggttccaatttccaatttagtggattagaatctccagggatgggacgtgagcatctgtattttttttaatctatagaatgattctaatatataaccgtggttggaaaatattaccatgaaccacagacatagattatcagatgcttttatattttcctttttgtccaaactacacagaaattataaaaactagcttttacacagagtcaacaaaggagctagtgttagcatgattgaagtagtaagattcaatagtagaaagttctcaaaaatgctggggttgtttcagatagcatcttgggggacaggtacagaaagctaatgttatgcttcagggcttcactattgcctacaggccttttctctaatcaagaatgccatgtcccccatttgtcttttctctacctttacgcaagagtgaaatgttcatataattaataatacatacctgaatagtacctttaagagtcttcaaacattatttttacatttttaaatttggccttaaacaccattatgtaaaataggtaaagaaggaattatcattcctaatttatggataaggaaacaaatttagagattaattgtctaaggttgtataactagtaagtaacaaagataagacttgaacccaagtctttatactccaaatctacattgcctccctagaggatatactcaatacaagtttaccaaagtatacttctcaatccccttcaccccaaaataactttacatttcttaatgccctttttaatctaatagtatatggatgttttacataattctaatttttatgtattatacatacaattttaagttttacctcagtttttcctttatttacagtgatcagattttaataaacagtcatgtaaaaactcatgaagttgctatgccatgatatgccgttcccatgtttaggttacctctagttttacacttgtgactaaagctactataagtactcttctatatggagctttcttcctcttttgaattactatcttaggatgaactctcagaaataggattatgggttagagggcatggacactcttatagctcttgttatgcgttgccagattgccctccaaaaagattgaagcagtttactcactcagttattttgaagggggctgaatcaatgctcatggctacagtgtttttactgcctttcagagcaggtgattgatgtttcttggatgatggactcttaggaagtgattttctttttctctatcacagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacaggtaggcaaacctgttgttttctcaatagagaaatgtttttactccaacctgatgacattcagaggtctttgaggagccacggtcactttcttgtgccctcttcctcatacttcttttttgggccccctttgtagcggctctgagctctgtttgcaaaagaagtaggccgcaggaagacctctgtctttcaccatgtgtttttggtttgtgttagagggtaaagttgcctggaactcaggaggctttatgcttttccctgaaaggccctgaagcataccattagcatcatatttcaaatttctgatcacagtgctttttgtagctttaaggacttaataagaaactattggatggcatatcctttctgaactattgaggaaaagagatttggttttagttttactttgcttttgctattcacctataggaaaataagaaagtgaaacttttactcctacatttttcttattttcttaataaatcttcttccaggaaattatccacattcaaaaatacaaactattgaaagtgtcccaaatgttgcccgtattaacagtaggagcacataagtgaaggacaggcactgttggcagtaaaaaaattttcaaaacatataatagctgttttcattctgttagccactgggaggagatgcaaaagaaaaatatccagggctttctaagaagattctaattttaaaaattatggattgctgtcagtccatgtatctaaaaatgtgttcccttttaggcatagacctctagcctcagaaaacttagtctatttgaattaagtcgccttagaaagaaatcatgatcaaatgcaggataaaagaatacaagctgaaattagtagtactagaaggagtcagaccaaagctctactacggtgatttgtgttaacatttgtctattaataggtatgactcaatagatgaatgattatatttaacttttagaaattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 4732 - DNA, 133629 bp, human
gacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccacatttcagactcgaaaggcttcagccaccgcttaccccttattcaagatagtatttgcaaagggcacaaagtttcagttataagatgagtaagttctggggatctgatgtacagcagcatggtgactgtagttaatcatactgtactgtatacttgaaatttactaagagagtagatcttaagtattctcaccacaccaaaaaaaaaggtagctgtgaggtaatagatgtgttaataaacgtcattttggtaattttccaatgaatacataaatcatcatgttgtactccctaaatatacacaatttttaatgtgttgaatatagctcagtaaagcttgggaaggtgggaagatagcatttgcctgcaataggtcagaagaagaggaggttataaaactcaagagtggagaagtagaagaaagaccaaagtccctaaaaaacccatttggaagattctgtttcctgatgttaacacctatggttaccttcctgccctctttttcttgaccttgcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcaggtactcaaaataaaaatacaaagagatctggagctatgtgtgattgggggttgggggcagagtggggactgaaggaagtgaaacccaccaaaagctaagagaactgtattttgcctttccctctttcatcatctttctgaaattatattccagaaagctttcctgtattgtactgaagtggtattcttgcagtggaaacttgaaacttgctgatttgagggagagggaacagtctgttctgttacagtggaaaatcctatcctgggatctttcctaaaatgcatgactctctaagttaatctatcttgtagtcaccactgtatttattctcattgagaaaatgtttgggagcaggtatctactattttatttcatttttaaaaattgtggtgtttgtatgagggtaaatgacatgaatcagcaaaccttctggactagacacagtaaagactttatctgttgatttttatagctgtggccactgtttcagagcctgttgcttcctccctcccccaactcctgggcaaaatgaggtcagagtcagcagatgcctttaagccaacttttaaggcacttcccctcagtaaaccagcatcctttatagaactgttgagacgcaaaggtagctgcatcctcttcaacgaccaagaaaataatattaagaaaacaatattctgggctatggtgggagttgaagtactctgttgtcagttataagatgcatgtgcattcatttccattagtgggaaaaattctctctataccagccattttctccagtggtctctccaagacttaggcaatctgagctccagtcttcatctataaatcagaatattgatatttggttattttacgagtatcaatataatgtggggttgcactgtgttgtccttagcaacagcaggcatttgttgttctttcaagccattattgagagatacataggtccaccaaaaaaaaaaaaattattcaagtttttgctccacaccaggtagtacagatcattatttttatgactttttttgttgttgttgagacggagtctcactctgtccccaggctggagtgcagtggcacgatctcagctcactgcaacctccacctcctgtgttcaagcgattctcctgcctcagcctcccgagtagctgggactacatgcgcgtgccaccacgcctggctaattttttgtatttttagtagagacggggtttcaccatgttagccaggatggtctcaatctcctgaccttgtgatctgcccgcctcggcctcccaaagcgctaggattacaggcgtgagccaccgcgcccagccttttatgacttttataaaaataccattgtagaaatttggaaaatatagaagagtgtttaaaaaaattcacctgtaatcctgcccactcccctcccccaaatcctacatcctactcaacgttttctagtttgagctcagtgttttgtttgttgctatttttactagaaattaatatcagtagaattggaatttcatatctggtacaatttgaccaattttttcaattctattagaagaaatctgttatctccctgtaatgttaacactttttcttatttggcccagttataaagaatttaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaataaaaaataaaaataaaaataaaaaaaaaaataaaaaaataaaaaataaagaatttaacagaggaagggggaatagtagggaaacattgaattgcccattctaaaattttaatattccattaaataatttttcacatagccaaaaaatacctttcataccaccttaatagtaattaggaatgtttcaaaacattatagcaatgggaaacatctttcaaaaagaaaagattttgtgggaatttttaaatttatatgaactttccttattaattgcaacaggtttttattattaggtctcaatttttttctcaaacctgattcagtgttaatcaaggaccagaaaatcatatctttttttgtcattagggttgtaggtcacatgtggtctctatctaactactcagctctgtgattgtggtgcaaatgcagccagagacaatgcagtcatccctcagtatatgtgcaggatggattccagtacaggctgcttataaccaaatctctgcatactcaaattctgcagtcagctctgtggaacccatctataagaaaagtcagccttccatatacatgggtttctcacccctgaatcctgtatttttgatccgtgtttggttggaaaaaagccacatataagtggacctgcacagttcaaacttatgttgttcaggggtcccctgtatataaagaatgagtatagttatgtttgaataaaacttaattcataaaaatagcaatgggctagatttgtccctgatctagatgagtggttccaaactctgactgtactttgagaagctttttttttttttttttttttttgaagactaagtcttgctctattgcccaggttggagtgcggcggtgcgatctcggctcactgcgatctccatctcccaggttcaagcgattctcctgcctcagcctcacagtagctgggatcacaggcgtgcaccaccacacccggctaatttttttgtatttttagtagagatggggtttcaccatgttgaccaggttggtctggaactcctgatctcaaatgattcacccacctcagcctcccaaagtgctgggattacaggtgtgagccaccatacccggccaggaatcttttaagaaatacccttagtacaccacagcttagaacaatttaaatatgaatctctggaagtggagctcagtagcatcaatatttttaaaaaactacccgggtgattttaatgtatagccagtgtgaagaatgactagttatggcaaaatatgaacatagattaaatccaataaattcatagattaaattcccacctactgcaactttctattactgtgtggattttcccaaaacattgattgttaattatttctacccttccttccaattcttaccttggtttctttctgagaaataatgtcagagaattgaagagaattctggaagaaaagaggacaagggtttaggcaactactgcatcctagattgagagtagaattatgcacatgtatgtttttacaaatgtctttctctaaggtatatagatacagtctcatacccatagaaatataggcacacaaatagggatatctctttgcattcatggtaccatcaaatttcagcttcatctctgggcctcactccagttctttgtgctaagttttgttctttttgtgtggtcattcattttttctcatgactttaactattacctttatgagaatgacttctgagtcttcatctctgacctcacttcaattttaaacctaggttttcatttgtcacctcatcagtttcatctgcatatactgtggctcctcaaactcaatgtgtctgaaaccccacctttccaactaaaaacaaactacaaaacaatggaaactcatcaacaatctctttttctgttattactgtctccattctaccaaccacccaggcaatattacttggagtatttcccatagtatgttctgtggaatactaggccaactaagtttgggactatgttaaagagcatgtgtctttactccataatttctcagagcctttgatgtactaatgtgcatattttgtctaagatgggagtgaattttatagcctttccagaatctcttagactagcactctataaaacagtgcttgaagtgtgctacttaaccttagaatgatttttgacttctccctcttaccttttgatgcatgcacaccagtctgttgattcatataatttctcttgaatctatcccctcttttctcttcccttctgcctcaaccttagtctaagcccttatttcctaacacttctgtgaaaaccacatttaaattatgttatttccatcctcgacaatctttctgtggccctcatttctccacaagtaaagtcgaaacattttggattgatagacaaggccctctatgggttggtcccagcttatttttttcaatattatatcacgctggtgccctccattatacccccagttccagccaggctgatgtctttattactcctctaatcccttaataaaaatacctaacatttgtataaatactttccattgtacaacacacttccccataattaccagtattttattctcacaataccctgtgaatcaagtattatcctcaatttccaagtgaagggactgaggcccagagatgaagctggaatttgatggtaccatgaatgcaacctgggtcttatgacttcggaatcagtattgtttgaatttttgcctccgtgggagccatagacattgccacctgcaaaaatttttatgggcttcttcttctacctgcctattccctttcaatctaaactaatatcctttgaaagcctagcaccaatcccactttttctgtggtccctgtccttcctcacagaccactcacttgtacagtgatcacttctttctcaggactcctttcttggaacttctagatcacttaccatctgtgccattcaacatcttcatttttttaaatttaaaagactgtgtaatcatcatgtgccaggccctataatagatgttaaaaagaaaatggtacaaaatgtttatatgtaaccctcaacttttttttatggaaaatttcaaacttacaggaaagttgcaagaatagtaaaataaacatatttgcatatactctatctaaattcgctagttgttaacactttgtcatatttgcgtacccacccctccacacacacacacacacacacacacacacacacacacgattttttgataagccttttgagagttacttgcagacatgagtttgttttttaattcaacttccttcgtccattgacttgaaggtctttttctgaacctggcctctgcccctttttctcagggagttcattgtctgatgggggagacagatatataagcaagtagttacagtacattaagataggtactataggtactgatttatatatttgagataactactaagctctgtgggaacacacagaggtgggaatgtctaaacttctttgggacgaggcaaggaagacttcagagaggagttgggttttaaaggataattaggaaatgctgggtagactatgctgtagttagtttttaaaacatatctgtcccatttcccttttctttatgttctacaaaacctgatagaggttcaataaatatctgattgcacatatacctgggggtagagagaaagaggtacacagatatggttgtgtagttatatattcttataaagtcagttcacagatatatattgatttatgtcgtcaaaaagaataggcaagagggagagtcacttggtatggggtagaagccctgatgtatgaatgtacatgtataattaatgccatctagcacacctggatcagaaaacagttagtttggggaacacagagtacagatacctcccatcattcctacctcccgatacttcctactaattttatcttgccttggaaattagaacttgaggatagaaatggctgacaatggccactaattgagatcctccactgagtccttgattccccagatttgctgtttaaagaaaatttagatgggagtagtggggctagagggtaaagggagttgatgggtttgcaagagaaaagatgactaaggcagtaaaatagtgaagaagccaatgacatgagcccaggattcttacagaatagtataaatgctgagttctatattggtcgactagaggcccttaatatgtttttttaaaatgagttcctttaggccattgatataaagacaagactattcaagcccctccctctgcttcccattctaattcattgacttttagaaaagacagaatatggtagaaacctttgagtatgtggtgacatgtatcagaattgaataaagtttccccacagaagaggttgtgttaaatactttccataacaggtatattaaagagatggactctttcattagcatcaaagtcatatagatgtcttcttgtaggggttacagtaagtttccttgctttataataaatgtttcaggctttaaaatgtgacaagatcatgcactgcctattctttctctctttttaaaatttcttcttttgatctgtaaggggaggggaccatttatagacagaaatgacttaagaaaggggactctcccacagaaaccatttttattcttatttttccctcaataaaaggcttcataaagagttggaacttaataggtacttatccttatcatgactattgcttgtagtcccatttgaatatgttttgaagaaataacagaatcatgtggcttccaagtagattagttttcagaggtgtcctgaagttacctctgagccagcataccctggagtaacctggttggatttcttttggactgtgaaacagaaagctttttggagaaatagagaaactgttcagtgctatgttcttccaaaacacatttctacccatgccacgattgatgggccctttagtgtcatgtagtatatagttggtgatcagaattttgagatgttatgattggaaaacaaactactttaaattatcaagccccagtaagagaaatagtgatgacttgaaacttaagaatttgtgactttctttcaaggaaaacgggttgagtcaaatgaacagatcccctttatacttattctttattaaaattcactttattctttagaggacatgtccagataaatatttctgtggactcttgaagataagtcttggctagcttagaaaaaatgaaagcaatgttgtagtgaagtctttctaggccataggatgtattttagaatatcctcagagccttaggatttttgagctgacttgcccctttctccaggtggaatgtcctctaataggatggttggcttatttttacataaaccagttgaagcttggatgatttttttgacttgaaggaatcataaagtgtagcttttgattccacttttagctgtaatctgctcttctgtgtaccaataaagtaaatgtcatgtaaataggaacacaggatagggttacttgttctcaaaaggtcatgtaccatctgcagttgctgagtaagtgttcctgtatctagggatgtttataactgtcttgtttccatttatttctgcagagtgtagtgaagctgatgagaggactactgcactgcatgatcagacaggtatggtattgataacaccttcctctctaataaaagcacattgtaatagtatctctaccctttagggaatgtttatagcttatattttctttcagtttcacaaatagtacacactaattttagaaaattttgaaaattggagagggataatgtcacccataatctcacaatgtaattaccactggaatgtttctttccagtcttttttgaccctctacaaatgattttcaatgtgtttcatcattactgtacatgcaattgtgtatgtagggtgaaaagatgatacaggtttaaaaaccctcatttgaccaggcactggtggctcatgcctgtaatcccggcattctgggaggccaaggcggatggattgcttgagtccataagttcgagaccagcctgggcaacatggcgaagcgttgtctctacaaaaaatataaaaattagccgcgcatggttgtgtgttcctgtagtcccagctacttggggttagcgggggtgaagtgggaggatcacttgagcctgggaggtcaaggctgcagtgagccaagatggtgccactgcactccagcctgaaacccagtctcaaaaacaagtaaacaaaatgcacacacacacacacacatgcacatacacaaaaccctcatttgaaacccttggggccatcaactttagaatttaaagtttttcagattttaaaaaggcagtacagtgcatactcctgccaacctttaattatatggtgtatggtatatatacaccatatattaccttatgccttctgcgggtctagaacagcactctataatcagaaacattaatatctctgtagggaaacatgcaatttcatactaagtagaataaataaagacttaatttgaatctggtgttgccaacaaatgaattttaatgcaaaatttaggggaaaagccttttcaaagtgtttcagattttaagattggagataagaaaccttgaatttgcatctccttgcagtaatttgcattttcctgacctccagtgaagttgagcatccttttatgtgtagattgaaaatttgcatttcctcatggatgaattgtctgctaagtcctttgcctatcatctaggttctctttcctgcctgttgaaaagttattgtacattatagacattagtcctttgtcatatgcattgcgaattttttagcagtctatcatttatttttgaggcttgtttgtgatatttttgcatacaagagtgtttttactttaaaaaattgttttatcctaggagatcttaaagcattttgcccacactcaatcttacctgtcttttctgaagatcaagattgtgttttattagaagaagaaattgaggcccggattgctaaagtgactgcctacaggcacagaagtctatagtagaaggaaatatatagtagatagaaagtagtacatagaaatatatgatagatagaaagtctttgctactttattttgtattttagatatttgcactttcgtttttttctttttagataggggtctcactttgtcgctcaggctggagtgcagtgatatgatcatagctcactcactgcagccttggcctctgggctcaagtgatccccccacctcagcctcccgcatcactgggactacaggtgtgcaccaccatgccttgctaattaaaaatttttttttgtagggatggaatctcactatgttgcccaggctggtctcaaactcctgggctcaagcgatcctcccaccttggcctcctaaaatgccaggattataggcatgagccaccttgcctggccaatatttgaactttttaccttaccaaataggtttaaggtcactaatttcaggaaccaaatttaaggtataacggttactgtcatacatcagaggcattaattatcaaatttaaatttcaggaactaagtctttcagttgtcctttgcacaatatttccttctgacttctagttttagctttctgttttgaacccaggaaatctgagacagatctcagttaatttagaaagtttattttgccaaggttgaggacccacccatgacacagcctcaggaggtcttgaagacatgtgcccagggtgattggggcacaacttagttttatacattttagggagacatgagacatcaatcaatatatgtaagaagtatagtatattagttccatccagaaagggtgagacaactgaaagcaaggcctccctccactatgggcttccaggtcacaggtaggtaagagacagatggttgcattctcttgagtttctgataagtctttccaaaggaggcaatcagaatatgcatctatctctgtgatcagagggatgactttgaatagaatgggaggcggattttccctgaccagttcccagcttgtaggggcccaagttattttcctttcacatccccccacctttgttttttcaaatcttttggagaaagcattttacaagaaaatgaatctctgatctcaggtttcgcctgatctctcatgagtaggacagtttatttctagatgggtaggtcccaaaagctcatttttagcaggttgtgaagtctcatatcctgtgaagagaaaatggggggaggtaagggagaaaaaacaataacaaacaaaagaacaatcctggaaaaatcagtataggccctattactctgaagtccatacattattaggcaggtatgaaagtggcttatgaatgtaaataggttactgttgttttttgagatgaagcctctttctgtcacccaggctggagtgcagtggtgtgatctcggctcactgcaacctccgcctcccgggttcaagtgatcctcctgccttagcctcctgagtagctgggattacagatgtgcgccaccacactcggctaatttttgtatgtttttagtagatatggggtttcaccatgttggccaggctggtctcaaactcctgacctcaagtgatccaccagcctcggcctcccaaagtgctgggattacaggcataacccaccgtgctggccaattactgttatttttttctgaagtttgagttgtctggcttcagttcccagggttttaagaaagcacagctgagttttcagggactccaaattaggaaaaatgggggaaaaaaaggaaggaaaaagttgaaaacattattttgaagacttgtagccaaaaaaaattagaattccatccaaactgtagaaactaataaaaattgaaacaaaaattaggcaagactagaatctaacaatgggtgtcctatcgttttgaaatataattttttctctctccggtttccccttttactaaagacaaatcatggtaggactggtttgcttattatacttggcctaattatttgtatacagtgcagcaagaataattattttttacataggcttttaaatgggctttgatggaattttgttccataggaggaatctcagataagatttttttcttgagatggagtcttgctctgtcacccaggctagagtgcagtggcacgatctcagctcactgcaacctccacctcctgggttcaagtgattctcctgcctcagcctcccgaggagctggggttacaggcgcccaccactgtgcccggctaatttttgtatttttagtagggacggtgtttcaccatgttggccaggctggtctcgaactcctgacctcatgatccacctgcctcagcctcccaaaatgctgtgattataggcgtgagccaccacacccagccattagttaagacttcttgaaagccgagcccagccatgaatttatgccatcaaatatctatgagttgtttgaatttctcctcctcttggggttccaagataaacctgaggcttctgtgcctgtcggaaagtgacattctttacttaccaagggtcagaaaccctatatgtggtctgtgtacatgaaatatgaggccagtttttccaagggctttattggcttcacaagtcaagtttgattctttaaaggaaagcacaccattccagtcaaagccttggtaaaattaccagtttctccaactgtgtcccgttacaaatgaaaacagattcttattgcacttacgcaaataactgtattgccataagttaagaatactcacaaatagtttccaaattctagagaaaatcaggtagagagaaataaatatgctccaaatcttttttatggcagtatactaaattgttaaaagctgtcagtagctcaaaagaaaagttttaagtatctgaaaaacaaaacaaaggatcagcaaacattttaagcaaaaagtccaaaaaattagttcagtccatgcagttatttcttgttctgcttgatattcatgaacattttagttctccatgagtcctggaaatttttcctctattctgatgtcacaatcttcaaaagttatcagaaacctgcatttaagagcacctattggaattttatagctgattataaaaccgtcttctaaaaaggaccaaaacaagacaacaattgtccatggatgaaaaaaaagttttaaggcagccataatcaaaagacacaattgacaaagaaatttgttacctctgtggcacacaataattttaacataacaattaggaatattactgataatgtacactaagttatatcagaatttcaggagtttctcataattttggaacacataccaataacatatttatacaaatacagcccaaagaaaaccaaacaacatttcatatttgacagtgcttcctgtataatttttataccaaataagccaaattatgacatttttggacttcagggaacctaatgtcttaaaggattaattaggttagaaaaagacataatttataatttgattttggaaaatttgtcaaatataaaagtttgaaatgcttgatattacaaaagaatattacaggtcattgtttaaccaaagtgataattcaaggacttcaaaaaaagtgaaaaccttaattctttgagagaagagacttaattttctaaacaagaagccctaataaaaacagcatgaagccaattacatttgtttttcaaaattttgtaaacaatctataaagtttaaccttgattataaaatataacttccataaggcttttataacctttattaaggagttggaggagttggttaatgctttaagaaaaacctgttaatctgacacaggggtccatatactggttttgcatcagtgtgcctttcatactaatgattaatttatagagaaactgaacttattttatctttaaaaattggcctttacaatctgtgcactgtcttcttccacgatagtccctggctcatgaggaatcaaatagctttaattgttttttgccctgtatttcaggaatgcagcttattttgattggcatcttccatggggcctgaagatgaggctttaattgctgttagtgtttaagatttagcaggacttgatgtcctttttagacccaggagttaaagccctctaactcaatgtcacaaggactttaaaagcccatataggaagatacatggatgtaataaccttagtttaaaaaaatttttttttgttaatctcagtttttttcctaagcaaaaccaaaacttaataataatatttggactttctggtttgtcctgaacatccctctttttttttttttttttttttttttgagatggagtcttgctctgtggccaggctagagtgcagtggcgcgatctcggctcactgcaacctccacctcctgggttcaagcaattctcctgcctcagcctcctgagtagctgggactacaggcaagcacgccaccacacccagctaatttttttttgtatttttagtagagacagggtttcaccatgttggccaggatggtctcaatctcttgaccccctccacctgcctcggcctcccagagtgctggtattacaggcatgagccactgcgcctggcctctttattcttataactttctttacatctccttttgtttcctggttgtttttaccttgttttatacataacctttaaataagctttgaattagacaaaacttgttcaccttttattttttagcaagaatgttttcctacaatatatatttattggaaaatacccaaataattaaatatctattatttaatataactttatatcctaaattatgaccagtttttctgcaagtacttatcctattacatttacgtaattattttaattgttttaccctgattatttatgaaaactgtgatagtcgtgatttaaagttatgaaactgccattgaaaattatgactgagacagtgaaaaaagatttgacctaactgactccatcttgctcttagccccaagccgtccttgttcactcctgggcataggccaaactaactttgggaggaatttagcttatagattagctttgaaacaaagagaataacagtcctttcccaaaacaaacctccttattgtctgtgcatactgcctaaagccacaagattcgaagttacggtaatattactaaattcaagatgcagctattttcattaagcccatatcaatgtcttatttattaaaaattacacaagcaaagaatcgttctgttttgggctgggcttatagtttgtaacccctatgccaaattttgacacctgatagtatttggcagggataagtatgaaattgcttgattcataaatgtaaaacaaaagaatgtatactggcaaatcttaagacatttctaatgttactttaccaaataattttaaaactagcttatttattacagattttacttaagttacataaacttcaaaaagcatttgacaattcttttttagtatctgatttaaatgcttttatttttctttaagccaattaattagatctcttatatatgtttagtagtgaaacagtgtgtacacaacacataattacatataaggacacattaggcatgccaatggatttataaagaccccctcttttttttttcttagattttcatattcttgataacctgtttcacaaccctacacagttgtcagctaaacagctttaaatttgcacattgaaggaaacagttcaggtgaaatcaaatagcaaaatttacatcataatgtacagagagaaaggtctggtggtgcagaactacagggagatgcttttacagtgcacttaaaaaaaatttttttttttttgagacagagtctcgctctgtcacccaggctggagtgcagtggcgcagtctcggctcattgtaacctccacctcccaggttcacgccattctcctgcctcagcctcccgagtagctgggactacaggcacccgccaccatgcccggctaagtttttgtatttttagtagagacagggtttcaccgtgttagccaggatggtctcgatctcctgacctcgtgatccacccgcctccgtctcccaaagtgctggtattacaggcgtgagccaccgcacccggccaaaatttttttaaacaaagacatttctgagtgtcttccttaaaaacccaagtgtagcctctgttgcgataactattttagtcaaaaaatcaggtgaaaacagaattcagtcaactgagaagaaaaaaaaaaaaacttttgctcaaaaaaaagacaaggtcttaggagaccttgtttttttttctcaaagaaaatcaacctcaaaacatgaaggccttttaaatacaaacatgcccacatgcacacatatacacacacatcttggatgttaaccttttaattaagccgacttttaaccattgagctcttttaaaaaaaatcttttaaaatcttattactgtatttcagctaggacaaaatgctgctaaactaacaatcatcacacaaattctatgatttctgagcactctaagtgtaagcagaatttaacaccagctggttgttaatgctaacttcagtcatttaaaaagaattttcaagacagaatcccaaaccagtttcttacataatgatgggtctcaggctgtagactgctctctacggtcctagaaacaggaaaaacaaaaacaaaactcatcttccccgttagaagcgtgttcaaactccataaaggagttacctgccttccatcgacatggaggcaggaaaacttgctttccttgtgttggaagcaagtaaaactccaaaaaaagaggagttgtaacagcaaaataagctttagatctcaaccaaattttgagagatcagggattctgttgagggggtgctctcaggcctcagcaaattgtcctgttggtttgagccatcaagttagctcatgctggtaccaagcaccaacaggagatttgtcaaaggtcaggggcatctccactcagaatccaccccaccttgaggttaccaaaatgtgaaccctgaaaatctgagacaggtctcagttaatttagcaagtttattttgccaaagttgaagatgcgcccatgacacagcttcaggaggtcctgaggacctgtgcccaaaatagttggggcacagcttggttttatacatttttgagagacatgagacatcaatcaatatatgtaagaagtacattagttcagaaaagctgagacaactcaaagcaacgccccacaactgggggcttccaggtcacaggttggtgagagacagatggttgcattctcttgagtttttggtaagtctttccaaaggaggcaatcagaatatgcatctgtctctgtgagcagagggatgactttgaatagaatgggaggcagattttccctgagcaattcttagcttgaaggggcccaagatattttcctttcagactgtcatacctttactccctcactctatgtgtctctcagcagctcttttcattactccttcaaaatatatcctcttattctaatttacttcgaaatttctacctcagtttcaggaacaaatgtatcttttcacattcagttacctcttactaagctgttctcactcaagcactctgaatctcagtttatctacaatgtgcagtgtggcaaagcaaccatatgaagagtaaacaagaggcaatgaataggaaagagctgtttttgactatttggtattattttctgattaaatcacctaaattgaaaaacaacaataacagactttccagttatattagtgcagggaaaaacaggtaacgagtattttaaatattcacaattgcctgaagatagtgtatcttcacattgcaataatgtatgttagagtattacagaagtgtggcatatgggttgatttttcagtatatccttcttttaatgtttttgttcttttcaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggtcagtacaaggagagaagtgctgggagcccctgagcatggagtctggggtactaattaatattcttttaaattgagaaccgggaaggctggggtagatcttcatgaaacaggtattttttattatttattaattctcagatatcatgagatggcaaagaagggctaggtttcattgcttgttctcattacagtacattgacaagcctgccagttagtataaatacaaactcaatcacctactttatgctactctttatgaatatattataaacaaggcatctgtctataggcatctaaattatattaagaaaattaacttaggaatcagaatccaaattttttaattattgaatactatatccttttcagatggttctcaatttattaattttggatgctttacctgagaaagggaaatgtaagaaacaacttaatttccttttatttttcctaaattgggggagggcaatgtatccgattatacctagtttataaaagtaatgggacctttgccagagcttcctaaactaatgtacttctcaaaataccatatttttgacattttaatttcttcatcttccaacccggttattgagatccttggtactaagggcatccagggtgggaattccctcaaaatactcttcttctccttttttaatagaaataaatatttgatgataaacctttcctttatttcctctaaaacacacagctcagaagctgaatagccttttcttaaaagtatgaactggctacccagatatgtcctcctgttgtaggggaggtttcttcctgaataaatgtatttttaggtttaatttatttaaatagaatgacaactataactctatttctaataatactttaataccaattctggagttatgtctacaaagcaacaatgtctgaatatctcttgtagtttttcattttgagtccagaatgcaagcagaaatgtatcaaagaggcttataggagacatagccattcattcaacaaatgtttattgattcctgacttaacatttgattttcagctcaatcagcagagtttgataggtacttggaataaggtagatattatttgatcaggcctttgaggaataagtagaaatttacaaatcagagaagggaagggaatagcatgaatataacatggaaatttgaaaggtactgcccatcaaggtaaggctggatatcttctatggttagagtataacatgcatctggaaaaatgacaaactgtgaaactagaaggttgggactagctattcgagggcctgtgtaccatgccatatagtttgcagtttaggccatcatcagtagcgagtcattcaaggtaaataatcaaggaagtttcagatgattcacttcagtagcaggaagatagattggataggaaagaaggttaagatggcagactagttaggaagttagtgaaatactttaaggcaagattgattcagaatttatgtaaggcagttaccttgagaatgaaagggcatatgtgagatttaagtggtagtatgcaagatcttcacagagtatttagcaatgctctacacatttttgaatacacaaatctccaccttggttaaaagagaggcttagacagaacttgactgcaacttacagaatgggggcaggaggggctccatggaacctcccccagcaaaacaaccataaatgttgaaaattattttttaaaaaccagccactacattattggaaattgtctgaaggacatacagcaggtagagaaacatttactccaggaaatctaccaagtattggtaaaagcagtgagggagtgtggcatttgagtctaaatctactcccccctccaccccacctcagcatggcagaagcaatattcaaggcgggtacaaccaagagcacaatctccccagctagttcccagtttagggacactgtatctctctgagggaggtaaggagatacatcctctccagctccatgttgcaaaagctagttcaggcaagaatagctgacaggcctggagttcccctcctccccaggaaaaggcagggtgagaatgctaggccctgattaaccttggcccacttcactattagggtggaggttccccactgggaggggcaaactaagaagatcaaaggctaccatcccttcccagcactcaatttgtaaagcaggggtgtcactccaaaagaagtgggccactgttctcaccactagctctggagcactggcacggaaattttgctggggagagaggcaggctgtaaggacacaaagctctgtagcttttcccaaaggaattgactttatttaacagagtgtggaaaagttaaagcctaaaggcaatctcaaaaaacaatggagatttgggttctaagcaattaagaggaggctagtagctcaataagagcaagaagctaaaccatatactagctcaatggcacatggaacatttttcaggatagattatatggtataccataaaactagcctcaataaatttgaaagatttcaaaatcacacaaagtatgttctatgaccaaaatggaatgaaattaggaacagaaagaaacctaggaatctcacaaatatatggaaattaagcaatacacacctaaatgaccaatgagtcaaattgagaaaatactttgagctaaatgaaaaagaaaatacaacataccaaaacttataggaagcagagaaaacagtgcttagagggaagtttatacctgtaaacaccaatgtaaaaaaaaaaaaaagaaagaaaaatcagtaacctaacctcccaccttaaggcactggaaaaagacaagcaaactaaacccaaagcaaagagaaaggatgaagtaataaacattacagcagaaattaatgaaacagaaaatggaaaaaacaatagagaaaatcaacaaaaccaaaagttcattctttaaaaagatcaacaaaattgataaatctttagctacattgaccaagagaaaaagagaggatactcaaattactaaaactaggaataaaagaggggacatcactacaaccttacaaaaatataaagaactaaaggggaatactatggacaactggttaccaaaaattagataattttgatgaaatgggaaaatttcttgaaagataaactactgaatctgactcaagaagcaaaggaaatctgagtagacttactacaatcgaagagaattagtaatataaaatctttccacagagaagtaagcccgggtgcagatagctttactgataaatctaccaaataaagaagagtgaacaccaattatttacaaacacttccaaaaatagaagaggtgacacttgcaacctcattctgtgaagccattactctgatgctaaaaccagacaaagatatcacaacaaagtacaattatagatcaatatctcttattaatatagacataaaaataaacaaaatactaggtaactgaatccagcaatatattaacaagtttatataccttgaccaaaccatatatattccaggaatgcaaggttgttttattatctgaaaattaatgcaatacatcatgtcagtggaataaaggacaaagatatattattgtctcagtagacacagaaaaacatttgacaaattcaacaccttatcatgataaatacttaccaaataaggaatagaggagaattttttcaacctgataaatggcatctttgaaaatccacagctaacatgacatttgatggtgaaagaatgaatgcttttccccatagatcagaataagacaaggacatcaactcttgccaccagtatctaaaattgtactggcagtttagcaagggcaaatagccaataaaaagaaataaaaggcatcaaataaatgaaggagtataattatctccatttgcagatgatacgttcttacatagagaaatcctaaggaattcattaaaactctagaataaacaaagttcagcaaggtaacaacgtacaagataaaaatgcaaaaatgagttatgtttctaaacagtagcagtgaataaccaaaatgaaatttaaaaataatttctattacaataggatcaaaaatgaaataatgaggaataaatttaacagaagaaatataaaatttgtactttgaaagatatgaaacattgttgaaagaaagtaaatatctaaataaatggaaagacatctatattcaaggatcagaagatttattgttaatgtggcaacatttcccaaattaatctacagatttaacatcaactgactttgcagaaattgacaggctgtttctaaaatttatatggaaatttaaaggacccagaagagctaaaacaatcttaaaaaagaagaaagttgaaggactcaaatttcctaatttcaaaacttactacaaagctatattaattaaaacagtacaggtactggcataactatagacatgtagctctttggaatagaattgagaggttagaaataagccatcactttatgctcagttgatttttgacaaaggtgccaagataattcaatggggaaagaatagtctcttcaacaaatggtgctgggacaactgtatgtccacatgcaaaagaatgaaattggacttcttcctcacaccatatataaaaattaactcaaggctgggcgcggtggcccatgcctgtaatcccagcactttgggaggctgaggtggcaggatcacttaaagtcaggagtttgagaccagcctggccaacatggcaaaaccccgtctctactaagaatacaaaaattagccaggcgtggtggtgtgttcctgtaatcccaactactcaggaggctgaggcaggagaatcgcttgaacccgggaggcggaggttgcagtgagccaagatcacgccattgcactccagcctgggcaacagaatgagactccatctcaaacaaacaaacaaaaaaagaaattaaatttaaaaaattaactcaaaataaattgtaggcctaaatgtaagaaggaaaactaaaacactatattagtctgccacaacagaataccacagaataggtggcttaaacaacagaaatttattttctcacagttctggaggctggaagtccaagagcaaggctggtagggttggtttctggtgaggcctcatcttgcctttcagatggctaccctttctgtgtttttacatggccttttctctatgtgtgtgcactcctggtgtgtcttcctcttcttataaggacggcagccctattgggttagggccaccctcatgacctcatttatcttcttaattatctccttgaagtccctatctccaaatatagtcatattaggggttagggcttcaatatacaaatttttggggggaggacacaattcaatacataacaaacacttagagaaaaatacaggagtaaatgtttctggccttgggttaagaaaaagcctcttagatatggcacgaaaagcataagctactgaagaaaaaatagataaactggaatgtatcaaaattaagaacttttgtgcttcaaaggaccccatcaagaaactaaaaaagcaaccaatagtatagaagaaaatattcacaagtcatatatctgataaggtacctgtatctaaaagaactcgcagaacttaatataaaagataaataacctaattaaaaatggtcaaagaatcagaattgacattcctccaaaaagatgttcagataaccaataagtacatgaaaggatagtgaacatcattaattttgaaagaaatataggtccaaaccacaatgagataccacttcacacccatcaggatgactgtaatcaaaaagacagataataagtgttgctgaggatgtggagaaattggaaccctcatacactgctggtggaaatgtaaaatggtgcggctgccttggaaaagagtctggtagttccttaaaaggcttaaaaaagagataccatatgatctagcagtttcactcctaagtatatatatacccaagagaaatgaaaacatatgttcactcaaaagcttatacattaatgtttatagcagcattacttatgatagccataaatgaaaataacccaaatgtttatcaactgataattggataaataaaatatgatacatctgcacaatggaatttttaaattttttttcatgttactgctacctctcaagatggaatattttgggcaataaaaaatgaattacaggtacatgccacaacactgacaaaccttgaaaatattatgctaagtgaaagaacccagacataaaaggccacatattgtatgattccatttatatgaatgtcaactaaggcaaatcatagagacaagaagtagattagtgattacttaggctggggggcaactgtagaagggaagtggggagtgactgctaaggggcacaaggtttcttttggagtgatgacagtgttctaaaattgattgtggtgatggtcgcataactgtgcatacactaaaaaccgttgaatatatacttcttatgcatgctttttacatatctcaataaggttgtttctaaaaatgagagaaagaggcttaatgttatacagatgagtgcagaatataagtgcaatagaccactgatttagctccatttctggagccctgtatgccttagtattctttatatagtcacctttggtctaatccagccctatctcattttatgtgtactcacctctgcattctttgttcgacaagcagtgtctgggctctacaggaggcacaggatccagaggtcctccatttatgacctttcctcaagaggctgatccctttcctgtggttaacagaggtgtttaaaatcacttaataaattttcaaacatctactgttcaatgctatttaataccgttcagaatactacgtgagatacttttagtggctatgtgagataattttagaagatgcagatataaataagatgtagttctttccttaaaattcaagtacacatttgtctataatacagagtaaaaaaataagttcataaaagtaagaaaaacaaaattctgtgaatcacaaaataggagaatcaatgatagcatcacagaggacatagcatttgagctgagccttgaaagaacagtaggatttcaagatctggagagaagaaggccatttaaatggagaatataacaagcaaaaggacataaatggtagaaatgtctggcatttgtatgatatagctgtgatgcaagtctaacagatgaataataccagtttcatacttttgccttctctgtctctgctcaatcgcattgtcacacaaagatgacaagataaagctatgaagctgatgtcccatgtcactatcatctcttctctttaccggcgtctttccaagaagttagtgtcattacgattgcaagaaaaaacacactttgccactttgcttctgcagcttccctgtgctatggatgctattttgacagagccatggatcaggaggagtttgcaatctgataataccaatcatatagttctttttaattataaagttacacagttccatgatttaaaatatatgttaatagatcaaagatttagatgtggccaggcgcagtggctcaaacctgtaatcccagcactttgggaggcttaggcgggcggatcacaaggtcaggagttcaagaccagcctggccaacatggtgaaaccccttctttactaaacatacaaaaaaattagccgggcatggtggtgggtgcctgtaatcccagctactcaggaggctgagacaggagaatcacatgaacctaggaggcagaggttgcagtaagccaggatcatgccacagcactccagcctgggcaacagagcgagactctgtctcaaaaaaaaaaaaaaagtttctgataataaaaaaatactataaacaagtccaaattccaacaaactagcaaaaatacttgcaacacatatgatgtgcaacggactaatttccttaatatttgttaaaatatcaataatagagaaagaagttttttttaaagtttaatgctgagcaaatacacacacacaaacacacacacacagtatgtttgtgtgaaccacagaaaaggggaagcaatgacagcatcacagaggagatagcatttgagctggaacttgaaagaacagtgagatttcaagatatgggaaggaagggaaggccatatgaatggagattatgagcaaaaggacataagtggtagaaatatgtggcatttgtatggtatggctgtgatacaaatctaagagatgaataaggccagtttcatacttctgccttctctcagcctctgatttctattgaattgccagtctttctggcaatatatacttacaatgcatactttttatgtatctcaataaagtttttaaaaatgacagagaatgaggcttaatattatacagatggtgcatgtatatatatgtatataccaagaccatacatatgccattttatatatatatactaagaccatacatatgcaaagactggtatatgtatgtaccaggaagaccagcaattcagtaaaaatctgaaggacatgaccaaacagttcataggaaaagaaatatgaaacacagatagcttataaatatatcaaaagatttacaaccttactcataataaaaaactggaaattaaactacaaggggcttctatttcttatccactaaagtgagacaaagattaaaaattttttttaaagcctgtgtttgcaaagatgtagggaaacaggcagtcagtgttggtatataaactgtagaatttctttgaagaataacttggagatgattatcaaaatttaatatacatgatgaagtatttagagggaagtgtacggatatctgcagcttactctgaaatgtatcaaaaaggaagatggatagatatatgatgaacaaagtatactaaaatgttaatggtggagttcagatggtgagtatacaggggtcctctgtaaaattgttccatatttttctgtttgtttgaaagtgttcataataaaacattggaaaataatatgcatacatctttgggtcagcaattccaagaatctgccctgatatactggcacatgtgcataaagatatatttccacaaatactcattgcaacattgtagtgaggaaagatttgatacaaccgaaatgtccttccgtagggaactggttacatgagtaaccgttcagtgaaatgttctgtagctattaaaaaaatgagacagatgtatttgaaattatctccaagttacttatatatgaaaaagcaaaatgcagtataatatacagtactaccctttgtgtaatgtttgtacatgcataatatatctctgaaaggatacagaagaaactggtaaaacaggtttctccagagagatttggcagtggtgaaggtgatgtggttctgggtaggaggaagactcactggttatccttcggcacagtttgatttttttcatgaaagagtattactaagtgctgacttacgaagggcgtgttaggtcttagaattctttctgaactggaatgggtgttcaggatattcacagtggagttcatttgaaagctgacattaagaaacatttgacaatcattttacatcatgcttctaagaatgtgagaggactttttccattctcaagtccttttaaggaagtttttttcatctagatctaattgctctagatatgcccactgttcagcaaactagaatttcttggctttttctggctaacacaactacatagctggcacatgtactcatttccattaaaccaacacatctgtttttgtgacaaatgcgaacaaaaaatgttttgtttaaatagaatagcctccaccaagtaaatatgagaagcttaaaagtttagtctctatagctaacctgatgttcactttttcctcctgtttgttatagaccagaaaggaaaaattagcttcctgatttttaaattctgaaatgatttcttagtttagaatcaaatagtccaaaccaagtctttcatatgtaaacagtaatatttattgttataaaagaggtatattaaaagttaactgcttagtaaattttaggtgtataaaaacttttagtgctcaggattaagtaattttgtataaaattttatgaaatatatcctgcagttttctgatttattatgattttgctttttaatataactttaaattacaaaaaattacaaaagtagcacctgtttcttgtagaatactgtaaaattgcaaaaatgtccagaaaagataaaataaaactaccttgaatctcaccaccaaagataactgctattaactaacatcctcctggttatatatttgtgtagttctgtatgtttgaggggggagatataaagagaggagtttttaagcaaaaatggatcatattatacatattaggaggcagtatagcatcttacctcctaatgaaactgcattcagcattctctgaaatgaaactgaaatcaacagtcaattgagtcccggttccactatttgttagttacatgaccttaggaaaatttttaactcctttaagcctcatggagaaaatagaggtgcttacctcttagggtggttgttgaaaaattaaatggataattcatgtaaaacattctgtgtgtaagttataatatctttgtatggcttacatttagaataattatcatttttacttaaaaatgcaatttaagtcctttttaaaatcataattttatctatttcttgcttagtatttagaccccttccagctcagttttgaaatatttgtcttttattccccaagtgcttaggtttgtacatttaagcatattataaattagttacctatagaatcagattttactttttggtaaaatctgtaaataacagttaaaattcttccatgttgaaatatgcttatatctcgcttagttggagactagcctaggacttgtttgtggtcttgtttttatagtttaagatcaaagtgccttccattgttcctaggcaggagtaggattgcttgggattagtgagatcagttagtcactatggctgcctataaagcttatagtgataattgaccagttctgtatctttattccctctttcctcaggactccatatcatccacagcctagatgaagtcaatttcatacagaaccttgtgttttacattgaagctgcatataaaactgctgtaagtactgattttagaatggattttagacatatgatgtttttgttttctaaatactgggcaactcagttgttttcttaatgctactgctcatagtgaaccaacctaaaaggcttctggcagaaattgtctttagcctctttctttattaagacctgtcatcctgtgtcttctcttcaagggggttacagagacaagagggtcaggatgctatactttcattcctttcaaactctgtgatatctcatggtatgtatttggcaatctgggctaaattgtggtcttattttaatgatttaagttcttaagagcaagatagctaggttgtattgtgggtcagttagctacttagaaataaaatttagtcatgtttgtaatattatctgtaggtgttgattcagtgcttacaatgcaaataagttatttttccttacaactaccatatgaggtaggtttctgttaaatcataatatatttaacatcttctctgtataaaatgttaagttagacactatacaggaatgcgatttttttcttcttcagtctaacatagacaacttttctttgttgttcattgaagctttattcataatctccaaaactggaaataacccaaatatctatcaacaagtaaatggataaacaaactgtggtatatccataaaatagaatactactcatcaataaaaaggaatgaactgttgattcatgcatcagtgggtgaatctcaaaggcattatgcttagtgaaagaagttagacaaaaaatgtacagactgtatgattctactcacataaaattctagaaatctatagtgacagaaagcagatccatgattgcctcaggagaggagcagagggagagataaattacagaagagtatgaggagacttttggaaattttacaaatattcattattatgatgatagtttcacgcatgaaaacatatcaaaattaatcaagttgtacactttaaatatgtgcagttctttgtatatcatttatacctccataaaaatacaaaagttgttattatttgttgaatctgtgtttccatttctgtttctgtttttgtctgttgcccaggctgaagtgcagtggcatgatcgaggctcactgcagcctcaaactcccaggctcaggtgatcctcccacctcagcctcctgagtagttgtgactaaaggtatacgccaccacatccagctaatttttgtattttttatagagacgaggtttcgctatgttgcccaggcaggtctcaaactccttgactcaagcaattcaccctcctaggcctctcaaagtgctaggattacaggcatgagccaccacacctggcctgttttccacttcttactaaccaccctcctcctttgtgaccaacacattattttttatttctgttaattggacagttatcttttaagtatatttaaataaaaattagaaattcatttaccatttctggtgtacttcttttcttcatgtagattcagatttccaactggcattatttccttctgcctgaaaaactttcttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggcgcccctcacctcccggacggggcggctggccgggcagggggctgacccccccacctccctcccggacggggcggctggctgggcaggggggctgaccccccccacctccctcccggacggggcggctggccgggcggggggctgaccccccaacctccctcccggacggggcggctgacccccccacctccctcccggacggggcggctggccgggcagaggggctcctcacttcccagtaggggcggccgggcagaggcgcccctcacctcccggacggggcggctggccgggcggggggccgaccccccccacctccctcccggacggggcggctggccgggcggggggccgacccccccacctccctcccggacggggcggctggccgggcagaggggctcctcacttcccagtaggggcggccgggcagaggcgcccctcacctcccggacggggtggctggccgggcaggggggccgacccccccctcaacctccctcccggacagggcagctggccgggcggggggctgacccccccacctccctcccggacggggcggctggccgggcagaggggctcctcacttcccagtaggggcggctgggcagaggcgcccctcacctcccagatggggcggctggccgggcggagggctgacccccccacctccctcccggacggggcggctggccaggtggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggatggcacggctggccaggcggggggctgacccccccacctccctcccggatggcacggctggccgggcgggggggctgacccccccacctccctcccggatggggcggctggccgggcggggggctgacccccccccacctccctcccagatggggtggctgccgggcggagaggctcctcacttctcagacggggcagctgccgggcggaggggctcctcacttctcagacggggtggttgccaggcagagggtctcctcacttctcagacggggcggccaggcagagacgctcctcacctcccagacggggtcttggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagcgcgccaaccaccagccgcggccaccatggccagacgggctccctcgaaaaactttctttaacatttcttcattcttctagtgatgaactatttcagcttttgtatgcctgaagaaatctttatttcatcttcatatttgaaaaatattttcactaggtttagaattttatgatggcagatgtttttgtctttcagtactataaaaatgttgttccactttcttcttgcctgtattgtttctgatgacaaatttgttgtcaaccttatgtttgttccgctacatgaatgtgcctttttctgctgtctgcttttaaaagtttcttttatggctgggcatggtggctcatgcctgtaatcccagcactttgggaggccgaggtgggtggatcacctgaggttgggagtttgagaccagcctgaccaacatggagaaaccttgtctctactaaaaatacaaaattagctgggcgtggtggcgtgtgcctgtaatcccaggtacttgggaggctgaggcaggagaatcgcttgaaccccggaggtagaggttgcggtgagccaagatgatcacaccattgcactccagcctgggcaacaagagtgagactctgtctcaaaaaaaaaaaaaaagtttcttttattactgactttaaacacttcgattatgatatcccttggtgtcattttcttcacgtttcttctatttagggtccatttagctccatagatctgtgcatatatcgctttcatcaaaagttttcagcaattatttcttcatattgtttttatgttcccccccttccttcgagtattcaataacatgtgtattaggctgtgtgatgttgtcccacagctcacagatgtactgtttagttttttaattcttttttccctctgtgtttcattttggatagcttctattactatgccttcgacttcactaatctttttatttacaatgtctaatttgtcactaatcccacccaatgtatttttcaggtcagatacagttttatcgctaaaagttgaatttgagtctatttttctatattccatgtatctactaagctttctgaatgtatggaatatagttataatacatgctttaatgtccttgtctgagtattctaacatctgtgtcagttccaggttggtttcagttgattgatttgtctcattatgggctatattttcctgcttcttggcatgcctagtaattttttactggatgaaagacatcatgaatcttatcatgttgcatcctagatattgttgtattcctgtaaatattcccgagctttgttcagggacctagttaatttagttgaaaacagtttaatccattattacttttaaaatgtgttttgtgggaccagagtcatgtctagtctggggctagttattctccactacataggtaagacacttctgaatactctaccccatgccccctgaattatgaagttttctagtctggctagttgaaacaggcactatttcttgtcctgtgtgagcactaggtattttttccctttaattctttgggtggttctttccctagcctcaagtagttttctcacttacatgcattcttcattattctgctgaatatttgagggggaccctctgcagatttctgtggttttctgtgtagctttctcttctccgttagtctgtcctgcaaattatggttaccttggtgtatctgtacttagcgccatttcctcaactcagggagtctgccaggctctgtttagttttctccttcctgtatagtggcctgcaaactcttacaacagtaagctgggacagtcataggactcatcctatttgctgccctttctcagaaatcactgtccttcattgtgtagtgttcattgtattgaaaaccattatgttataaatagttttttagttgttgcaggtgggaaggtaaatctggaacctgtgacttcatattcaccagaagcacaaacctaacatagataattttatgcaagcagacattatttgttgactgatggctttgcttctgacaccacaggcctgctgtggttcagtgcggaagttagggttctttggcctctccattatatccaatgattataacagtagaattattgatatttctgtattctcatactctaacctttgctgcacaaactagaatggagctggattgggggacagataaggccagtcatgggttaaacatggcttaccttcctgaaacttcactttaactcagagatttggcatgaaaagtaattaaaggtagatacagagatacagatgtgtgtgggagggtgtgtgtttgtgtgtatgcacatacacatttgcacatgtctgtttccaagttccatttaatgagagggcctagaagcaatgacacctcagtgacaatgagtgtacccagtgcccaggtcttggattctgactctcattttctgatcaagtaaaccaggacttcttatgaaagtggttgattccagggctatggcggggaaaatatgagataagattggagcatcttacagtgccaaaaagtgaagaaacgttcaaaaagggagtgttttattttgttatgttttgttttgagacagggcctctctttgtcacccacactaggattcagtggcgcaatcatggcttacttcagcttcaacctcctggactcaagctatcttgccacttcatcctccctagtagttggaactatagaagcaccatcatgcctgactaattaaaaaaaattgtagaaaccgggtctcactgtgttgcccaggctggtctcgaactcctgggctcaagtgatcctcccacctcagcctcctaaattgctgggattgcaggcaggacctaccatgttcagccatgctcaaaaaggaataggcatgtcaaaaggtcacaggagccaacctgaaagaatacccaatggccaaagctggaacagtttgaacaacaaaataaatggtgatagtgttttattataagccagagaaaaacctaaatatctgtaagttcatagtaatataaataactgaataaataaataaataaatgggagagaaaggacagctcttccttagagaagagttgcaactagtggctgtaggagtaatgaagagaactggaaaatcaccattaaagcaccactgtaataattgtttctggcaagatccatcagtggttgctgaattagtgggttaatgtttgagagaaacaaggtatttgcatattcctaaagtatctctctcaagatatttattaattacaaacaaaaaaatagtaacagtggaattgagaaacccagcagacatcacgttaaccaagtgatgagggttaatatcaccagtaataagacgtatcagcattgtatatccctgctatgatgcactgagaaggacacagcataatgtctgtaatacatattcttgcctaaaatgcataatctcagtctagtctaatgagaaaacattaagcaaacccaaattgaggaaaatctactaaatacctgatcactaatcttcaaagagtgtcaaggtcacaaaagacaagacttgaggaactgtcactgattagaagagacttaaagaaacatgacaaatgcagcatgaaattctggattggatcctggaatgtaaaaaggccattggtggaaaaagtggtaaaatccaaataaagtccatagtttggttaatagtattgtgccaattttaatttcttagctttaactattacactgtggttatgttagacgttaacatcaggggaagctaagtgaaaggcatatgggaactccttgtagtgtttttgcaacttttgtataagtctaaagttattccaaaataaaaagtttttaaaagtaattttaaaggctatatgattcaggggatttatagagctctggctaagagggtaggctttggagtgagattccttggattctaatcctggctctgtcacttattaactgtgtgactttgagtgagtcacttaacttctctttgcatcatcagtttcatcatctataaaatgtaaggattaagaaagataatgtaaaatgcgtaaattagtgcatggtacgttgtcagtaccaatagagagtaaaattagaatgaatgtttacaataaaatattgggctgctatttaggctccatcttgcagatctactgggtatttgctttaatgaaaaattttgagaaacacctctccagatagacagagttatagttcttagccctcctgattaactgttgaggagtcttccaatggcttggaggccccagtagaatttaaagctattggcaaagtagctgcaggggccaccccacacattagcatctccttaataagcattgtgggtatatatatatatatatggcaaattagttactcctagtgtcttttattcaagggtaaacacttcctgcatctaggaagtatttagtagttatgacttgctaattgtatattggttattttatgccaggacttcgggatatgggaacgtggagacaagaccaaccaagggatctcagagttgaatgccagttcagttggaatggcaaaggtaattttcctttcctgtttgtactaagtatgggatgaggaagtctggtatccctttgtcacagataaaacttaatgtgactgtggaccataatcaaattaattattattttaaaccacaggcaacattcagattctcctgtagaaccatggatatgtagatgaaaactttcataagctgcagatttgatatccaactgcttttgtggcatgtctctacttatattatatgccataaggacttgaaaggacttaaactaaacttatcatctctaccattacaaaaacaagcaaaagaaggcttttattcctttcgtttaccagttgaccaagctttatatcaaggaatcatctttcaatcctctatcctctttattttcctccatcccccaaatcatcatcatcatcatcatcattagcagcagcagcattactattcaacttggctctactttttcatcctacccactattgtcttctctggaaacagcaagaagacatacaataagatagcaggaataagatcaaacatatccattatgagaaatatgcatgatttagtctgtcctactaatatgcaaagatatagattgattttaaaaaataaaaggaaatccaatatatgctgtctataagagctctaatataacaaaatgatacagaaaggttaaaaacagaaggatgagcaaaatacagtctgacaagcataaaatgagctagggtgactgtgaatgtcaagtgaagtagaattcaaagtaaaaaatattgcatggaacagagaggacaaagggagtcacaatagaattttattccatttttttattttatttatttttattttatttatttatttatttatttattattattattattattttttgagacggagtctcaccctgctgcccaggctggagtgcagtggcacgatcttggctcactgcaacctccacctcctgggttcaagagattctcctgcttcagcctcccgagtagctgggactacaggcatctgccaccatgcccagctaatttttttttttttttttagtagagacagggttttgccatgttgacgaggctggtctcgaactcctgacctcaggtgatccatctgccttggcctcccaaagtgctgggattacaggcatgagccactgcacccagcctaacaatctcatagtgcactgaacaacataaccaaacatccttctatgtcatttcacacagacaaatttagttcattcttttcagctgctatacagtatttaataattgctccattgacagaattgtctttattttttaacattctagataatgctttagtgaagatccttgtacatacatccaggtaaatttacacaaatatttttataggaaaaattcctcaaagtggaacccttaggttaagggatgtatacttttaaattgcccttcagatatgaacagacacttctcaaaagaagacatttatgcatccaaaagacacatgaaaaaatgctcatcatcactggccatcagagaaatgcaaatcaaaaccatagtgagataccatctcacaccagttagaatggcgatcattaaaaagtcaggaaacaacaggtgctggagaggatgtggacaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccacatgtccaacaatgatagactggcttaagaaaatgtggcacatatacaccatggaatactatgcagccataaaaaatgatgagttcatgtcctttgtggggacatggatgaagctggaaaccatcattctcagcaaactatcccaaggacaaaaatccaaacaccacatgctctcactcataggtgggaattgaacaatgagaacacatggacacaggaagggggaacatcacacaccggggcctgttgtggggtggggggaggggggagggatagcattaggagatatacctaatgttaaatgacgagttaatgtgtgcagcacaccaatatggcacatgtatacatatgtaacaaacctgcacgttgtgtacatgtaccctaaaacttaaagtataataaaaaaaaatttcaaatgaaaaaaaaaataaattgcccttcaaaaatatttccactagtttacatttcccatcctcatatgatagatatacgtcattatgtaccatagatgtcatttttcttttcttttttttttaatcatatgctgtttctttcagtgaatgaaagtgtttgacagagaaatacctttggaaacaaatattgagaacatgttattacaacttgtttctttttgcactggtacttattattacaaatttacatatagagcttttttgccacttttctcaaactctcactacctggatattatcaatatttttgtatatttgatttaaagttttttaccatttaaacttttttactttttattttgtaatcatttgtgacttagaggaaagttataataattgtacaaagaattcctatatagtacccttcactcaagttccctacttgttaatatttgctttatctttttctctgattaaacaaaacaaacacacaaacacacaattgtttttttctgaaccagtagagagtacattgcagacatgatgccccattactcctaaatatttcagtgtgaatttcctcaaggactcttttataaccatgatacaagcatcaaaatcaggaaatgaacactggcattatactgccacctaattgatatagcccattcaaatttatttagttgtcccaataatgtgatttatagcaaaaaaaaaaaatccttttgatccaggatccagtctaagataacatattacatttaattgtaatgtctctttaggcttcttccgtctgaaacagtgcctcagtccttacttgtctttcatgaccttagcatttttgaagagcataggccagttattttacagaatgttcctcgatttgattttgtgtgatatttcctcacgatataggttcaggttatgtgtttttggcaagaataccacagaggtgatgctgtgtccttagtttatcatcaggaagcacatgatgtgaatttgtcccattactgttgatgttatcttttatgacttcattaaggtggtatctgccaggtttctccactgtaaattttctattttccctttgtaattgctatgacttgaatgtttgtggtcccccctcaccaaaattcgtattgaaacttaattaccaatgtagcagtattgagaggtggagcctttaagccgtgactggatcataagggttcttccatcatgaatgcattaatcaattcatggattaatggattagtgagttatcatgggaatgggactggtggctttataagaaaaggaagagacacttgagctagcacactcaggccccctcatcatctgataccccattccaccttgggactctgcagagtttctacccgccagaagccctcaccagatggggccccttgacattggactttatcagcatgatgaacgggagccaggtgctattcctcaagacaatggaggaaagaccccaaggcatttcagagatcttagatgctgccttttccatcacaggtccaaaggcctaggagggcagaatagtttcaggggacaggcctggggtgttctttatgggctgtgcccaggactgccttggaactgtactcccggcacccctgcttcagtgttcactcagctcatgccactactccaaaaggtccaagtgataaaccttgaaggtatccatgtggtgttaattctgcaggcccacagaatgcaagagctgcagaagcatgacagtttccacctggatctcaaaggatatataaaacagcttctgttctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcattatttctgagggctctgttctgttccatcggtctatatctctgttttggtaccagtaccatgctgttttggttactgtagccttgtagtatagtttgaagtcaggtagcgtgatgcctccagctttgttcttttggcttaggattgacttggcgacgcgggctcttttttggttccgtatgaactttaaagtagttttttccaattctgtgaagaaagtcattggtagcttgatggggatggcattgaatctataaattactttgggcagtatggccattttcacgatattgattcttcctacccatgagcatggaatgttcttccatttgtttgtgtcctcttttatttcattgagtagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttctatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtcagagagggcatccctgtcttgttccagttttcaaagggaatgcttcctgtttttgcccattcagtatgatactggctgtgggtttgtcatagatagctcttattattttgagatacgtcccatcgatacctaatttattgagagtttttagcatgaagcgttgttgaattttgtcaaaggccctttctgcatctattgagataatcatgcggtttttgtctttggttctgtttatatgctggattgcgtttattgatttgcgtatattgaaccagccttgcatcccagggatgaagcccacttgatcatggtggataagctttttgatgtgctgctggatttggtttaccagtattttattgaggatttttgcatcgatgttcatcagggatattggtctaaaattctcttttttggttgtgtctctgccaggctttggtatcaggatgattctggcctcataaaatgagttagggaggattccctctttttctattggttggaatagtttcagaaggaatggtaccagctcctctttgtacctctggtagaattctgctgtggatccatctggtcctggactttttttggttggtaagctatccttcacgtctaaaacaccaaaagcaatggcaacaaaagccaaaattgacaaatgggatctaattaaactaaagagcttctgtacagcaaaagaaactaccatcagagtgaacaggcaacctatagaatgggagaaaatttttgcaacctactcatctgacaaagggctaatatccagaatctacaatgaactcaaagaaatttacaagaaaaaaacaaccccatcaaaaagtgggcaaaggatatgaacagacacttctcaaaagaagacatttatgccaccaaaaaacatgaaaaaatgctcatcatcactggccatcagagaaatgcaaatcaaaaccacaacgagataccatctcacgccagttagaacggtgatcattaaaaagttaggaaacaacaggagctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacgtgcacccgtatgtttatagccgcactattcacaatagcaaagacttggaaccaacccacatgtccaacaatgatagtctggattaagaaaatgtggcacatatacaccatggaatactatgcagccataaaaaatgatgagttcatgtcctttgtagggacatggatgaaactggaaaccatcattctcagcaaactatcacagagacaaaaaaccaaacaccgcatattctcactcataggtgggaattgaacaatgagaacacatggacacaggaaggggaacatcatacaccggggcctgttgtggggtggggggaggggggagggatagcattaggagatatacctaatgctaaatgacaagttactgggtgcagcacaccaacatggcacatgtatacatatgtaactaacctgcatgttgtgcacatgtaccctaaaacttaaagtataatagtaataaaattaaaaacaacaacaacaacaacaacaaaaaaaaagaaaaacagcttctgggcccaggcagagacttgtcacaggggtggaaccacaacagagagcccccgctagagcaacactgaagcagaaacatggggttgcagcttccacagagagttcccactagggcaggaccaccactgggatgccagaactgtggagtcactggcagcatgcaaggtctgcctgagaaagcttcagataccagactgcaacccatagaagcagccacctgtgctgtacccatcaaagccacaggggcagggctgcctgaggccttagagacccaatcccaacctgcgcgcagagtcaaaagggattattcttcagctttcacatttaatgtctgctatgctgggtttaagacttgctttaagcctgttactgctttctttttgcctgtttctctcttttagaatgggaatatctctgtctgtcttatgcctgtaccaccattgtatcttgaaagttgataacttgttttgatttcagactcacggatgagattttggacttttgagtcttatccttggtgctggaatgaattaagactttgaggctatggggttagaatgaatgtatttatatgtgagaaggacatgagtttggtgagggtaaggagtagaatagtaaggcagtaattaatgagtattttgtgcctggccaacttctacttaccctataggtctcagtttaggtgtcatttcttcagggaagactttcaaaactggcttctacccccaagactaggtcaagtctgccctttaattgaggaattacagataactaataaatactagaaataatattcaatcttgttaacaatttaatgcatatgaatgcaacagatataccattttttaatcacattaggaaaaaatgtttaagataatacattgtttgcattaaggaaggtattgtcatatactgctagtgatagctatgttggtacaacttgcaagaaaagcaatttagcattatgtcttaaaaattattcatactcttttacccaatgattctacttcagggaattgatgcttacaaaataactcaaaatgaatacaaagagttattttattagcttgacagtcattattgagagcctaccgtatgccatggtttgtgctagatattagtgaagacataatccccgacctcaaggaatttataatttagcaagagatgtttatcaaagttctatttctaatagcacaaaattaaaggcgacctaaatttccaagaattggtaaatggctaaatatactttattatagccatatgagataatagtatgtcaaaatagtgtttgtaatgtggaaaaatacttacactatattattaattgtaaaaagtaggataccagatgtgatctcaactgtacacaaatagacatagaaaaaactaataaaaaacatgtcaaaaatgttaaaagtggttgttttgggtgattttcttgccctctctgtactttactgtgttttcaaagtattctataaggagtgtgttttacttttatgatcaaaaatatatttagaaaagtaagaaataaataaataaattctattttaaaaaacataatatctcatttatatgtggaatctaaagaagttgaactcatagaaggagagagtacaatgatggttaagtatgatacttgatagtgctacagactcctttttaactttctctgagacaatatgggagacaaagaaaaactcagaatgccctgggaataaataatgtttttgtattatatattctgtcagacatattcaaaagtgacatcatgtgtgttgataagatactgggatatagggagaagaaatatatatctttctaatgctaaacttgtccatttctttcttgttcctcacaggcagccctggaagcattagatgaactggatctgtttggtgtgaaaggtgggcctcaatcagttatccatgtcctggctgatgaagtacagcactgccaggtaaaatattatggaaaatggaaatagcaaattttattcttgcccagactcagatttaagcatgagctttagattaaggatagctgaatgagagacagtgcatcatctgattaattaccatgtaccaaaaatatatttaacaagcatactatactgagataagccaaatatagcatgggctataaaatagatcatagtcctgttctctagccaaaggttataaagggatcccaccatactatgtggaattatccaccactatcatatcaaagggatatggtctctctttctgagtatctccttttctaaatatataaagaaaaccagagatgatggatttgtagtattcttgttagtgtttctgaaacattctcttgttcctggttggctctaggcttagatatttggagattagactttaagtggcaaatatgtattttcagttttgtttaggattactctccatattgaaagattaaggtttttctcattggcatgaggaattttctcctttccttcaaaccctgattagataccatagggtcctattgaatataaactcatctccaattttaaaaacacaaaatttcccagaggaaaaaagtgggtcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggatttttgcatctatgttcatcagggatattggcccatgggttttttgttgttcttgtgtcctcgtcagttttggtttcagggtactgctggccttgtagtgagtttggaagaattccctccccttcaatttactggagtagtttggttttagctctttaaaagtttggtagaactcagcaataaagccatccattcctggacttttcttcatcggagtacattttattactgattcagtcccattactcgttatttgtcttttcaggttttctatttcttcttggttcaatcttggtaggttgtatgtgtccagaaatgtatctgttttctctagagtttccaatttcttggcatatactttttgataatagtctctaataatcctttgtatttctgtggtatcggttataatgtctcttttttatttcttattttatttacttgggtcttttattcttagtctggctaatggtttgccaattttgtttatttaaaaaacttttcattttgttgatcttttgtattttttggccttaatttcacttatttcttgtttggtctttgttatttctttccttctattaattttgggttctgtttgttcttttctaattccttgaggttcatcattaggttgtttatttcaaatctttctactattttgatgtaggcatttattgccataaacttccttcttagtactgcttttgctgtatcccacaggttttgggatgttatgtttccattttcgtttattttaagaaattttaaaatttctttcttaatttcttcattgactcgttggtcattgaggagcatgttgtttaatttctgtgtatttgtacagtttcaaaagtttctcttgttattgatttctagttttcattgcagtcagaaaagataattgataatgatttcaattttttaaagtttgttgagacatgttttatcacctaacatatgatcaatcctggagaatgttccatgtgctaatgtattttctgtacctgttggatgaaatgccctgtaaatgtctgttaggtccatttggtctataatgtagtttaaatctggtatttctttgttgattttctgtataaatgatctatctaatgctaagagtagaatgttgaagtctcccactattattgtactggagtctaactctccttttagatctaataatatttggtttatatatctgaatgctgcaatgttaggtgcatatatatttacaattattataacctcttgctgaattgatgcttttattattatataatgaccttctttgtctctttttactttcaacttaaagcctattttatctgatataagtatagctactcctgcttgcttttggtttgtatttgcatggaacatctttttccattccttccagtttagtctatgtgtgtctttacaggtgaagtgactttcttgtaggtatcatgtgagtcttgttatccattcagccaatctacatctaaattgagaaatttaatctatttacattcaaggttattattgataaatgaggactttctcctgttattttgttaattgttttctggttgttttgtatatcctttgttcctttcttcctctcttattgtttatctttacagtttggtggttttctgtagtgataaggcttgattcctttctctttctctttctctttctctttctcctttctgtatgtgccctttctgtatgtgctcctttctgtatgtactagtgagttttatacttttgcatgttttcatgatgatagttatcatatgttcacttccagttgtagaactcccttaggcatttcttgtaaggctggtctaattctgggtatagtgttcttgcctgacaggtttttttttttttttttcagctcttagaatatatcatctcattctcttccagcctgtgagattactattgagaaatctgttgctagtctaatgaagattcccttatatgtaactttatgcttttctcttgctgtttttaaaattttctctttgtctttgacttttgacattttgactataatgcacctttgagagaacattttttggtttgaatctatttgggaactttgagtttcctggatctggatatccatatttttcccaagaattgggaatttttcagctattatttcatcagataggttttctgcacattttcccatctcttgtctttctaaaacttccataatgtgattatttgtttgctttatggtgttctgcaagtcctataggcttgtttcattcttttttattcgttttttttttgtatgcctggtttatttcaaaagatctgcctccaagttcagaaattcttctgcttgatctcatctgttgaagctcttgattgtgttttttatttcattaattgaattcttctgcgttaaagtttgttttttaaataatatctgttgaatttctcatcagatcatgaattgttttcctgattttattatctatctttattcttttatatcttgctgggtttccttaagatcataattttgagtttcttttataacatttcataaatttccttttctttgaggtctgttactagataattattacgtccctttggatgtgtcatgtttccttgccttttcatgtttcttgtgtccctgaattgatatatgcacatctggtggagcaggtacctcttccaatttatggagcagctttgatagggaaagactttcctggagatgggtcctaaggtgttggtttaggtaggatacactggctttggttctaggtggacacagttattatagtctctgtgcagtttcttgagctgtaatccacataatagatgtttgtgagtacctcaatggcctaggctgcaggagttgtgagtgtggtgggtagctttgctaggggtgggctcctgaacagactgatttccgggcctggggtgtagacatgcatgaggagaagggctgccagactgtttttctagccaaggtcataggcacatggcaggtcagctggttcagagactggtttgccaaccaggggcagggctgctgggctatttctgtgcctgggggcgtgggacttgggaactggcttgccaggggtggagccactgggctgtttctctgcccagggacatgggtccatcaggctgtttctccgtcaggctggtccagggttggctttctactatgcaggaccagagtcatggccattcctggggccaggcttcgagcagctgaggtcatggcactgcagccacctgtgtggggttggtgaaatgatggcaaagagtcaaggttggagaggtacaatggctactggcccccagagtaggggggccaactactgcactcctgcagtagctccagtttcaagatggcactgtactgcagcagctttggtcatgagaaataggaagtgcacaacatgtacttgtactctggagtaatatagttgtgtgaattctaggcagctccccaaactgggctcagcacttgggaggactgtaggattctcctatagtaaggactgcaggtgtctgggctggcaatgagggacggtgggagccttttgcttaccttttccctgcaaggggaagtccctcctgtctctgagccaatcccaataggggagatggggcagcagagccagggtgcctcgctctcctctctatgctgccatcctgggcttttctacttcacagggttcttgctgccagtcacttgctacaccacagtgctctccctcagacactccacttgaattttagttgtttattagttgttttggtccttttttgtggggaagacaagcaccaggcacctctagtcagccatcgtgctctatgttgattctttttttttttttttttttgtcagtacattccaaacatgtgtaaccaatgaacatggcctagggttttttttttgtttttttttaattggtattcacttcagtaacttcaatccacagatacaagcagtatataaccagaaagttacaagtaaacacagattatacatgcacatttctgttcacaaaggtcacatgtgcaggtacatgaattagaagcgtgcatctaggattatggccaaactgtttttaagatgcagaaatataaaattacatcttgaaaatatgaagaggtggtctacacacttcaaaaatcaaatgttgcttacaccagagatgtatgacgattacaggattcaagtgacaagcaataagatctcaaaaattagtactggtcaaagagaatgggaatatttttacgtttcactgaaaatattgactactagaatataaaatctagcaggaactcagggaaaaaaatacaaaacctaaagccaattacttaatatttcttattacctaaacaacagcatgacatttacagaaaactgcacctgcatttgaattgccaatctcattttaatgaagttctccaaaaatgaaatgcaaccaaaaaagggtcaaactccaaatgaaaagtttgcaaggctcagattaaaacatggaatgtttcagatgaaagtaataaaaatactattggttttgttctttattaaatggaatcaaatactgacatttctttgaagcttggaactgctaaatttcattttcccaaatggttctgcatttttttcttagtggtgcaagttgtcttaagtagcttacgaagtcaatctctacaaattacttctataaaacaactattcattaatcgtatgtatttttttgctataacacttaacacatgaacagacattatttctccaccaaaacaaaagagtacaatagttttcttctgtcagtattgtatttaaaaaagtttaacattaaacacaaagaaccattattttctttgaaacccttaaatcttcttgcacatcttaagttgccttcttctgtctgcattcttctgccaatttattcagaaatttatttaatttctcataatgaggaaggctgctgcaatgagtattctttgcaacttcttttgtataaaagagtgaacatagcttaccataaagccctgttttaggtattacatagtctataccaacaggaacattgggctgttatggtccaattctatactcatctgggattgtatagtcctccttgttctcatcactttggccatctgcattttcacttatgttgattcttagatgcattttactaagtgaaaaaaagccaaacctcaaagactacatactacatgattccatttacatgacactctggaaaaggcaaaactatagggaggaaaacagatcagtagttgccagaagttgggaggacagattgtctataaagatacagcactagagaattttgagggtgatggaatggttctctatggacttatgctggtggacacatgactatatgtttgtcaaaagctaaggaattgtatgccacaagaagtaaatttaaagaatcaaccagggtgtgtcaagaaagatggaattcagactgaaaaatgagtctaattacattacaaatgaatcaagtaaccacactaaaaggtatggaaaagaaaggagctgacctaagtcttggaaaacagtgttttgactagatactgcaagcctaacctaaagacaaaaataactgtatacacacactgtactctagttcaggggttagcaaattacagcctgtgggctggccatctgttgttataaatagagttttattggaacacaaccatggtgtatttacatattgtccatggctgctttcaaggtacaacagcagatctgagtaattgcaacagatgctgtatggtctgcacaatctaaaatattcactacctggtcctctatgaaaaagtttgccaacccctgctctagttgataaatttgtttctcaaaggggtactggttggcaattctgaaactactttatctgtacagtaaggttgaccaaataagtaaatatgtagtagatatagtgggtaatgagacctaggtttctcactgttacacatagggaatgggaaaagcctagaatgaaccttgtgatgttggattggagaaggtagtatcagtatgaagtgtgtatgtgtgtgtgtctgtgtgtctgtgtgtgtttaatatagggatgtgtgtcttcctatatgtgtttcctaactttgtccactgagagggcccagaggcaatgagtacacctagtgtccaaatgttggtttctaaatgtcattctcaatgaaaggacttagggctccttggagaagtggttgatttgactggggcagggaggatacaaggggagcctggagtttcatatggttctagaaaataaagaggtactcagaaaagtatggaacatgtcaaaggaacacaggaaccatctgaaaagtgcttctaatggccaaagcagaaaaaatttgaacaataaaataactatcatagtattggattataacccagagaataaatgaaatgtccataagtccatactgatataaataaataactgaaaaatgaataaataggaaagaagacagatctccctaataggagaatgtcaattaataaatgctaaaggaataaaggaaatacaaaattgccattagacaaacacaagaataacaattatttcaggagaaatctactgatggatgctaaaaccagtagacaaaagcttaagcataacgaaggtgttcgaatagtctcacagtatctcccccaaaatatttaatagttacaaatggaaaattacagtggagaaattcagcagacaccactttaaccaagtgatcagggttaacatcaccagtaataggacacattgacatcatgtactctctcatacaatgcactgagaagggcacatcacttctgtggtatccttcccaatatgcataaccgtactctgatcatgagaaaacatcaaacaaaaccaaatcgaggggcattctacaaaataactgatgaacactcttcagaagtgtcaaggtcattaaaaacaaggaaggactgaggaactgtcatagattggaggacactaaggagacatgatgactgaatgcaatatgggatcctgaattgggtcctagaacagaaaaaaggacaactgatgaaatccaaataagttatgggctttggttaatagtatcgtaccaaagttttttttttttttttttttgaaacaaagtctcactttgtcacccaggctggagtgcagtggcaggatctcggctcactgcaacctgtgtctcccaggttcaagcgattctcccacctcagcctcttgaataactgggactacggtcacgtgccaccacgcctggctaatttttgtatttttttgtaaagacaaggtttcaccacattggccaggctggtctcgaactcctgacctcaggtgcctcccgcctcagcctcccaaagtgctggggttacaggcatgagccactacacccagccaccaaggttaattttttagttttggcagatttctatggttatataagatgtgactataacggaatggtggttgacaggaatactgggattctctgtactgtttttgcaactcttctgtaaatctaaaattatctcaaaatgtaaaaaatatgtgtttttttaaaaagcttatggagtcttatgacttatgagctgtatgtgtcttatgaacaggaccacatagattagtaattatgctgtcagacttaccctaggtggatagccatggagaggatactgttaggaacactgctttagtgaagagcctgtcactttgccttcacttgaaatcacattgctgaaatctgtttctgctgctggattgattttttggttttaagcattattatattattataggttttttggttttaagcattatgcctttatcggtgataggttggtggtacatatagatgttgcaaggatgtatttctgattaattacatggccgtaccagtgtacaagctgctgaccttttttctttgtattcccagggtcgttatggttgctgtcgctttctacgagatggatataaaactcctaaagaggtaggtttcttttctccaaaatgaatccaaggtagaatggccacttctacctgcagcctcattcagagaaaatatttacctcactgatggtacttatagagatcactaagtaggataatgataactgatgtttgctatatttgttgaacttggcttagctgccaagttctcagtttgtaggcctttctggattaagtaaaatagaggaaggtgtagtccttccacctcttgcattggttagtttcgggaaagaactacagatacatggtaaaatcagtggatgaaagcttatacagaaatagtatttgcattgtctcaaagtatctctcccaaaatatttaacaattacaaagggaaaaatctttccatcagtagatctttctggccccacattccacctcttgtagttggttagttctaaacagtacttgattttgaaaagtttacgttccctttattcaactagtcaaaagttcaccttggaaatatcaatgagaaaaattcagtatcattaaagggattgaacagtcaatatgaagcactttcactggtaatggaaacattgtttaaagcttagatttgatgtttgagagacattatggatttttttaaatcatcgagctcaaactcttctggtctacttcctcttccactttattttttagccttgaatttgacttcttcccctatcagtgtactaaaattatatgttctgaaacatcatcataagctcttaaatgaccaatccaatagccttttctgaatccttattctccttgacttctctatggtacctcactttttacctagccctaaattctcttgaaattcttttcctattttaattttcccactagattatcctgattcttctctttctgttattcccttgccccactctgagggtttaccaagattccattcttgagcagtttgctcatttcatttagtgctatttcacaaagctcatctgtaacttgtacttcatatgtcacctctaggaaaatgattcccaaaccctcatctctagttgcccttctaaacatttctacttgtatgtcctattattacaaaaaacttaacaaatataaaaccaaactgaactttattgcaaaccaatcttatttcttcatacaccctcttgtgatatcattgctatcccaattccgctagttagaagtcgcatcatagagtacttgctaagggaagggagtatgtacatgctctgcttcctgaacaccttctctaaaacaatcagtaatgaaaacccgtattataatacctctgagctaaagatatacatctaacctctgagtgatgacagactttattgtgtttttactaggatcccaatcgtctgtactatgaaccagctgagctgaagctatttgaaaacattgagtgtgaatggccattgttctggacatactttattcttgatggggtcttcagtggcaatgcagaacaggtaataagctggggaaagagttttcagcagaatgtttttgttatatcttcttacagctaatagtataccaaccctgtgtccagttggaagtcttcctaataggggagagacagttgttccctacaggctactagttgagggcactaagagtaaaaagacctggattatttttttcttctttttaaaaaaattttggtttcggccgcgtgtggtggctcacgcctgtaatcccagcactttgggaggccgaggcgggcggatcacgaggtcaggagatcaagaccatcctggctaacagtgaaaccccgtctctactaaaaatacaaaaaattagctgggcgtggtggcaggcgcctgtagtcccagctactcgggaggctgaggcaggagaatggcgtgaacctgggaggcggagcctgcagtgagccaagatcgcgccactgcactccagcctgggcgacagagcgagactccgtctcaaaaaaaaaaaaaatttttggtttcactcctgaccattgagtgcccaactattatcattgacttcttcagtttctctatacataatgaaaatagtttttccccattcattaaagaatatattcctaaaagtatttgaatttcacagataaagacatattgtaaatgcaacgtacagtcagttctgctataatgatacgtatgcaatctttttttgttgtcatttttaagacagggtctctcactctgttgcccagactgtagtgcagtggcgtgatcatggctcactgcagcttcgatctcctgggctcaagcagtcctcccacctcagccccctgagtcactgggactataggcatatgccaccacattcagctatttttgtttgtttgttttttgtagagacgggcctcgctgtgttgcccaggctggtctcaaactcctgggctcaagctatccctcctgcctcagcctctcaaagtgctgggattacaggcatgagccaccacacccaggccatatgcattctttaaaaatcaccatgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaatcaccatgctatgcatatttaagaaataaaaactacagggcttatgagaaaatggggtaaggagtgcagcacataaaatgtaacacatacaaaatgataggaacctaataaaaataatagtatcatggctttatacatggtaaatagttaagaaatacataaataccacaatagttaccgtactttcaccttaaaaaagacccaaagtttgcttgtgcaagtgtgtacccaagttctcaccagctcacccacctggctctcatgcccactacataatgtgcaagaggaagagaacaaaagagggattaaaaagagtgagagaaaacagagaaaaagagcataaaacagagaggaaaatttttttaaaaggctgagaggaaagaggtagaaaactgaagagagggcaaggcatgtggttgcatatccagggtggccatcagaggattgcagcttgtaagttcagtagtggtgaaaggagtgttatctgaaattggacagaaagtagtaaaaacagatgtgaataggtacagttcatcattctcctgagatatatgcatgtgtgttttgtgtattcttacatggcccagttcagctgagtacattctcagtatgaaattgtgcataaccaaacatgaaattcatgttatactcaaatttttccctaatatatcagaagcattggaacaaatttgtttacaaagaaagtgttatagcagaactatttttttttttcatcataaattacagttttgggttttgtttttttttttacattttatatattgctaagctttagcaaatggttaagcacagaacataaacttgaccataatagaacctaatttggcaggtagaaatgcagttttaagacaatacatcctcaaatctagaagctatacttaagatatacatagtggaacaagacaggcctttggaagcagactgccatggctacaccctggactcaactgtgtacttgctctgatcttccacaaatttacaacctctttgagataatttccctgtaaaaaggccttaattacacatagctcctaggatagtttttaaagttaaatgcattaaagtatgcaaaactcctagcataatatttggcctataacaagcatttagtaaataccctttcctttctattttactgggtgaataagctcctttgcaataggaccttctttggctgcaaccttctcctgggtccccaaagggactctctgtaagtctttttttcctgcctttcttttatctgcaggttcaagaatataaagaggctcttgaagcagtcctcatcaagggcaaaaatggagtcccacttctgccagagctgtacagtgttcctcctgacagggtgagtcagacagtgccataacatgtagctgatagagaagaggagcagtaccttgatcagactacctcatttgagtcaaataatttttaatcttattttgttgttctgaaagcttgtctttaggtacaggacaacataagtatgattttatttcttcaaaaataaaattttaaagcagtctcaatgatggtactgttgcacagtcagacaaggacaagaccaaaccttaatcttgagaatgatgtagagatcactaggaaaaactaggatgatgttctgtgtggactctcaagatttggtattctctatttttaggccagtaatcccggattgttttaatagatcagtcttggaaaatgaatatgtcttgttttcagactgtcattttcccaaaatgccagtcgggtgtaacattgttcctcttctccactgcaaaagagcattagacatggaagagaatagtcttccattccggtgagaatgagtagaataagctcccagcaacatcagcagcaccacctgagagcttgttagaaatagatttcaggccctacctcatacccactcaatcagaatctgcattttaacaagatcctcaggtgatctgtatgcacatcacagttggggagcactgccctagattatagtgatagtgcttcacttttcagtgcattgcatatgtagctacatagggtataaattacaatccagtccacctttttattatccagtatcttaaaccttctattattcctcatctggcctcttcatcttttcttttaggtcgatgaagaatatcagaatcctcacactgtggaccgagtccccatggggaaattgcctcacatgtggggtcagtctctatacattttaggaagcttgatggcagaggtaagaggaatcttcaaggctgtcccacttttttctgccttaagtcaccataataatcagatttttaagtagctcattaaatctgaaggatgtcttctgccttttgcactttgccttaattatagttttcctccaggtcttcagagtagggagcatggccaaccctcacaaaaagctcttgctgcctggcaaccatgtccctcctgctgcccggggctccctactttggcactgtatttggaactgctcaggccccagatctatccctttcaaaacttccctcagtgccctgcctggtgactaacagatgcatttgtgcttagctagttaattactgataatggattaagtgctaatgcttccaagcaacatgtttcattctttaactaaattaactgatatttttaggtgccatgataagtgactaggaacatcatgactttttttttctttgcttgggtttttatgtttgtttgtattttgttaagggtctctctaaatgttccttatatcagattctgttgagattgcccttaatgaggcatttgggagtttctgactttgtgtccaccttctttgtgacattttgagcctgcacagaggcattctgtttctcagaagtttttcatatcatctggcaagtctacttccccactctatgttattttgataagatataacccaggctcctagaggatcaagagtgggacttaactatcctatctgagtcagactctttgacctgtttatgtataaccactgatttttgcagctgttttgttcattttccttgtgtggctgtggccatggctgtttgattactcttagtcgacattactaaatgagtctagcaaaagtgggcagaatggtttgtttaagtaatccttacctggtgactctctcattcaattaaaataaagtaaaggcattgataaaaagaataccacagtgattggtattctttttttttctttttttaaaatttattttattttattttactttttgagacagagtttcactcttgttgcccaggctggagtgcaatggcacgatctcggctcaccacaacctccgcctcccgggttcaaatgattctcctgccttggcctcccaagtagctaggattacaggcacgcaccaccatgcctggctaattttgtatttttagtagagatggggtttctccatgttggtcaggctggtctcgaaagcccaacctcaggtgatccgccctcctcagcctcccaaagtgctgggattacaggcgtgagccactgcgcccggccagtgatttgtattcttaaggaaaaaataggtgagttcatcccatttcataaagggcagaaactcaagtcaaaagatttctgatgtgcagaaggcatagtagatacatgaacaaatgagaatacagcaggactaatggcttaaattactgataagctgtgtgatctaatcatctaatcatatgtatatccagagaagatagaggaataaccagaaaactttgtttatttataatttatacccagctgggtgcagtggctcatgcttataatcccaccactttgggaggccaaagcgggaggattgcttgagtccaggagaccagcctgggcaacataagtgagaccttgtctccatgaataaactaattagccaggcgtggtggcacacgcctgtggtcctagctacttgggaggctgaggtgggaggatcacttgagcccaggaggttgaagctgcagtgagccatgattgcaccactgcactccagcctgggtgacagagaaagaccctgtctcaaaaaaagaaaacaaattataccctacatatttataccctacctaaaaaagcatttgtggcagccaatagcaattaactctggataaaaggaattgtggtgtgaatttgggaattcaaacattttcatacagtgaaggcatttgtttcctttctacacctgtctcttgaatgttatggtgcaaggttatgggcatagggatgttgttttccctcaagtattagtttctcttttgagacttaataatctgtctttttatggtttttctttagggatttttagcccctggagaaattgatcccctgaatcgcaggttttctactgtaccgaagcccgatgttgtggttcaaggtatgtattcttattcccagtggaagaaactttatattaaaggtctggttatgggcagagatctttaggctagtaaattatgactttattctatatgttgcactttattaggcttcaaaatgtatacaatgaactttgttcggtttggtttcaaaatgctggttatcttaataataaacaaatgaatgatgttctatgtcagatgactccaaaatattatttgacacccttaaccactccttatatctggaaattattttcttttcattgtcataacattttagcctcctggttatctctgctttttctctgaccactccttctgtgctatttctactgtacttctttctttatatatccttctaatggttctgcgcttagtatttttttttttttttgagagggagtctctttctgtcacccaggctggagtgcaatggggcaatctcggctcactgcaacctccacctcctgggttcaagcaattctcttgcttcagcctcctgagtatctgggatcacagtcgcgcaccaccacgcctagctaatttttgtatttttagtagagacggggtttcaccatgttggtcaggctggtctcgaactcctgacctcgtgatctgcctgtctcggcctcccaaagtactgggattacaggcgcgagccactgcgcccggctgcacttagtcttatactcttgtctttctgtatttacactctgtattaggtagctaagcctgcctccttcatagtaaatttgcttccatggccccaactattacctctttggagaatactccaaacttttgtttttattcctaacaatttacttaaatttggggcatctactttctgcagaactctaggctgagttctataaacatgttaagaattctagtcccaatatctataaaacttctgtgccatttacatttcaaacacaaaactgacctcttttgtctccatcccatccttttcctctcctaagaaatgcaaatcgttctaccttccttatttctctcaatgatatcaccattattctagtctcttagggtagaagacttgaggtaagtttttactctctaacatcacaatccaatgtggtgttgtgaaactcctttgagatgtctccaatcacttgactttggggttggttctatatggaaaataatctcgtgtgttttctaaattttcttatacttggcatcccatgtggtcatacaggtagttcttgcttatcaatgtatatagcaaacattatataaaagtcattactcttcccttcccatgagagatcttgttctcctttgaggtttattccacctgtctatgttgatctcctggttgctctaattcattctttgaagactttgaggcctggctacagccttcctcttcctctccaaatcctgccatagaactagattttagcattgacgtcagtgcagtctaacacttcagtctcaaagttctagatatccataactctagtgacctttccttctacctatacttttagccattcactcaaaggaccaaactttaaggctctttcacttcagatacctgaaattccaatattctactctgtgatcatagtcataacattatttcaagtttctttttcttccctttacccttgtttctattttcccctagtttacccttctctacctcatggttgttcatctaaatctcccagtcaccaatgcaccataatttctattagaaccactcgaaaaatcacagccccaggtcagtgttacagtctgcattttctgatcctttacctggcctgctaaaaagctattggggaaaaaaaaagacacaaatgagcagagtggtggcactggaaatcgtggtctccaactcagctaggtttacagtgcctcctgttcatccttgttcttgttagtcagcattttcatacttctcaaccactattccacaccttctctgttttcaatccccacctctttttttcagcctaattcttggcctgctgcttcatgcctgacaatattctgatctttgtcagtgtctcagccctccccacccctacagtcttacctatccttgcctcattttctgcaatctcaggaaaagggtttcttctcctattcaaggacaagtcttccttctgatgtttgatcattatcttcttccccagcattctctagaaacttactctttcctggaatcctcaaactctcccattctgttggttctattttgtttagtctactgacatgttcatctccctctagttacactatatagcttctttctttctcatccaaacttccacttttttatcttccctttattctgcagtattttgtagtctggcttactactatgaaaatgatcttgcttaagttaccagtgacctttgtattgccaaatttggtaggtactttttaatctgtatcttactggagtatttaatctgtatcccatgtcttctatgatgccatactctcttgaatttccttcaacctagattaagcacatttctttctcattctggtcttcctcttcttctttgccccctaactattagtatttatgagaattctgtccttagcccactgctcttgcttatataaatatttctttctgttcctcagcctcctcctattccaaccttttccttcttcccttttccctctttccaccttcttacttcttccctcactctcagaagatgatctcacctcctataccatagatgaaatacaagccatgatgtaagaactcctccacttcacccccagcttttcttcatttgcccatgtcttttatgttggcattttccaaggttatattctaagtccgcttctccttttctctatgtattctccttgacccatctcatctctttctatgctaatgactcctgaatctgtatcagcttcctttaaggtagcctcacttgggtgtctcacttgccctgtaaatttattcaacatgtctaaaattattcagctataccctcctagtactacatcacccatacctgcttttcctcctatatgcctgtgtcattaaatgacacaccatcctcccagttacacaagtaaatacctagggaatcctctctctcatctcctacattcaacagttaacaagttctggctgctttatttcctaaataattctgagatccatccagttttctccagtaccaatatcttgatcctaatggaggtagtcaacatctcttccttgcattactgtagtaactttttttttttttttgagatggagtcactctgtcgcctaggctggagtgcagtggcgcaatctcagctcactgcaacctctgcctcctgggttcaagcaattctcctgcctcagcctccggagtagctgggattacaggcacgcacctccacacctggctaattttttttatttttagtagaaatgaggtttcaccatgttggccaggctggtctcgaactcctgacttcaggtgatccacccacctctgcctcccaaagtgctgtgattacaggtgtaagccacagcgcctggccctgtagtaactttttagctggtctctctgtcttactacagtctatcagtttattctctgtcaatctgaatgtactatttttaaggtacaggtattaatatggtattcctctgattatgcctctacaagggcttcccattggcagtctccttaatatgacttacaagaccctttagatctagccccgaccccatctccagcttcattttttatcactgcccctttatgctacatgttcctgttataaagggctttttataattcctagctctgccttgttttctgttcccttgagcctttgcccatgctatttcttctgtctggaacaatttcttccttacctttaccatatcctgttgcaggttaacttctattcaggcctctaggaggactctatagccgtctcattttttccatgtagggatcatgtccttaacatatggcagtgcctagcacataagaggcactaaataagaattttctaaatattttataaaacaaaaaaatgagttgcttgggttgaaggtactcctggggccccagagtattgttcacttgactgtctttcagtcccctctactcttacaaccaattcccatgaagaatcctaaggctcagtagaaagcagtttggaaagcatggcccaaagatgaaatacaaaatccttcaagtgatgcatatgcccttcacgatgctctaactcctgtctatctttccagatccatttcttttgccactatgcaaggtatattatgctacagcaatattgaagtgtatgtggttcttcccacctccctctatacatgcagccatgctgtttttcatctctgtgcttgataagttcattctggactctcttcctagaagggctatatccttcctaatcccttgtttctcctagctaacttattcattatttcaaactcagtttaggcatcaacactttgcagaagcctttcctgatactactcctcccaaccccacactacctaggtgtcactcctggatggtctcataaagttttgtgcacttatctctatttacctagcaggtcattttacaatccatgtgtatgccacttcggttacactgtgagctccttgagggaaagactaatttatccatttctgtatccctagtgactagcatagcacctcatccattgaggtacttaataaatgtttactaatgaatgaatgaattgccaaatgttttttcctggactgtcctcagccccctatcattcttcctctgcatatttttccctgaagaatctcttttattttcatgttttcagttagaagtaatcaagatggtgttatgtccaggggactctgtgatcaacatatcctgctatcctggcccagacaacagcagcccattagcatgaggttcccaagatagaaaaatacacaaaggataatggcaaaggaaggcaaagtagcactttgttaactaagcctttgcttcaaaaactcaatgtagaaaataatggtaagccaagcagtgcattctttttcctgtgaacaatccatcacatctaccagcactagaggagcaggagtagagggcacatttgccacagttgcttagtgtcaagacagctaaagcctcaattggattactggcccccagccaggtgtctgttccatatagcgaaagtgaaaaaagaatcaggaagctggcctagcctcctctcttgtagttgggcttcctacttcagtgacaggagtataagaggaagaaaagagagctgtccaggcttgtcaggctctgaatctagagaagtttcatcccccatctctccccagcacccgctacctgctgcctaaaaaacacacagtttcaactataataccttctatatgttgatgactcaaattgttatccccaattcaccatgccttctatcattctctagctataggcaactcttgtcattagggtgttctttattacccccacatacctggctctgaccttaggtttactgatacaaaagaactcggggaatcagtttttaccaaagctataccaaatctcatgatggatttttctcccatttaaacatggaatcttagatataaaaagagtgtggtattctctaggagcacataagtatttaggcaaaaagcaaaatctaatgctctagtcttgagatcttttcattttccttttccttttagataatattatttagcatgatacttattttatcaaagttcctcaataactgttcatttcctcccatttcctttttttctctttaaaagaaattatataacttgagagattgttaagttgctattgaaataaaattttctgttgacctcatcttctttgtctcctctagtctccattctagctgaaacagaagaaatcaagaccattttgaaggacaagggaatttacgtggagaccattgctgaggtataccccatcagagtacaaccagctcgtattctcagccacatttattccagcctaggtaaggagattggctagcctgctagaatcaaagcattattcattataggctggtttccatccttttttcttcttcatgattgtgtattgctttattaagctggatctgagaaggaatttagagtctctagaatccaattttcttaccttctctattctgagcaggcctgataattttaggtgtgttttatgaaccctttgggtacataaggcatgactattatcagccaatattgtatctttattccaagtgtgtgcttaaataacatgttctctcctttcttggagcctatacctctttttcaaatacttgcttattttatatggaatgatagccaaggaacttgtttttaggtcttttatactttgtcatttaatgaactagttgataatataaaagattccttaatataatacttatttttaattagtacttatttttttaattaattcacatattaaacttagtgatagattttttgcattaaacaaattactatattgttatctaaaagaaattctaaactactcttgtggaagactgaataatgactccccaaagatatacaagtcctaattcctggaacctataaaccttaacttatatggccaaatggactcatttgagatagggagcttatcctggattacccaggtggtccctaaatgtaatcacaagtgtccttataaaaggaatcagaggaagaccagactataaaagtaggagatgtgacaacagaagcaagagattatagtgataaggctatgagccaaggaatgcccacatcatctagaagctggaagaggcaaggaatagattcttccctggagcctccagaaggaatcaaccctgctgacactttggttttgattttagtcccataatgctcattttggactcatgatgccaagaactgtagaagtataaatctgtgttgttttaagccaccaagtttgtggtaatttgttatagaaccaatagaaaagtaatacaatcttaaaccacaagggagtagatttgtaaaagattggatcttaggtagtggattgccacttacaaacccagaagttagtttgtatatgtgtgtgcgcgcgtgtgtgtgtgtgcgtgtatgtgtgtatgtgtacttttttatcacccaagaatggtatgttagtaattacagttaaggcaagtattcccagcttaaaaccagtctccttcccttttctctggcacgtaactccagtcacttaatttctttgtctaaattgagagggaatcaaccaaggaggaaaggaccaagagtcagagctgacttttgtctgtctctaggaacatatatttaatgccaacaaggcttgaactccttgcattccggagctattaacatggcttctggctttaggagtatatggatttctttcttccatcttagctatgatgtaggaatgtccctttcctaaaaattcaaatataacatgattagaattttctaaagaaactttgctttaaaaagataatgaaaaactaaaatatatacacaaagaaattaacaaatttgttgaatatgtctcagatcctaataaatttctaaaatctagccacaaattagcttgaatattataaaatactcctggttccctctatttactcaaccctaactgaggtaaataccaagtcaaggctcctgaaacttctgaggctgatttgggtggatgctttgctaggtgggttacatacctcaccccttcccagaacctgcttcctgtttttattttttttggccattccctgtcaccccagacctataatgcacttctagtctccagatactagtccactagcactaaatcccttgagataaggaaggtatttccctatttagccaacatcttacccacttgagtactagttgatcttacagtcaccttctttgtaactcttagaagtctctgcagtaatgggtttatgcaagtcctgttggtgattttgacctgattctctctggctctcactcaaaagttaataggttaattttacccattgcctcattgcatctattattctaaatcggcatatcttactgggaaacaggtaacttctaagctctgggccatcatttatggaatctgcctgcctcacatcaggtctctccaacaaatagaagcaatctccttactatttactttttcaaaacctagactccatcttgggcctcttactaagttcttattttctagccaaaggaaataaaaacttaatgatgatcaaacattccaaggactcaagtgacaagtggacatttatcttcctgatacgttctttcatttgcttcattcattcattgataagcatttattgctcacttattatgtaccaggcactgggctagatgctatggaagacatagccatgcaactaaataatcacagtacaatcttataaatgctatgaccacggtgttacatataaaacacagaagaaaggggatagatttgcctggggaagtcaggaaaagcgtgatagatgaggcaacatctgatgacttatcagtcagatgagtgactattcaaaattctattattgcaacagtttcacaataaaaaaattgccctaagggtacgtcaaatgacaaccataattccatgaaggaaaaagggctatttctttaacaggtgtatttgtttatatatgttaactaaacggagttctctttctcccctcaaatgctcagtatttcattgtcagttccaaaacattttttttatttttttaaattatgagattaatcaactttgtgaaagtaagaacttaaaatattaagttcaaatctttatgtaatgctaattcttttctaatcttagtgcatatagatacattttaatagttatctttaacatgcctatattcacttgtgttctgtttgttttcacttattctctcgtgatgcatttccacatattgaaatagctatatagtatttcatcaaatcaaagtaattgtttcctgattattagctgaatattttcaagaatttttatccttctataaatgcctttgtatagaccactgttttcttaattgtatattctcagtaaagggattctggataagcttgtgaacagctttttagctcttgttacatgttgccagatgattatttacaaagacgaactaattcatagtgacataactaagatataaaatatacctttcttttttactaccccactaacattggagttttatttatttttgttagataagtaggttttagtatgtataaattattttaattttctatctttaattcccagggacctgtacgtttttctatttttgctttacctctttttttgaaactatgtgtctacaattgcttgcttatctaatagggtctgcacatttctgtatatatttatcaattatttatattttatggtaagcttttatcagtgagacttatatatatttcctagtctgttactttcttttagataattattttcttgcctgtgtacaaatctttaaatattagatacatccattttatcagatatatttttcagtccttcaagaattatgaatttatctcctaattctatctgaataggtatgctattctggttctctccaaatttcataagttgtaagttatctgattacaaattggtatgtatgcattgactgcagggaactggaaaacagacaagcacaaaggaaaaagataacaatcgcctgtaattccaccactcagaggaagccaccttttattttggcatatttgtttccaatcattttaaataaaataagtacaaacatgtttttagaaaaatgatatcattaagaatggattttgcattctgtttttcttgaaaaataacagtatatgataaactctgttacattttggtaagtagccacctacaatccagtttgatagctgtattaacgtaatttcttcaaaagttattttcataaatagcctttttctgttaattttgcaaatcgtctccttatattcttttgccatttttctactggatacttgttgatttcttactgatttccatgaggtatttttaaatatattagggatactgacactttctcttccacatgttattgaaatattttgctattttgttatttgccctttaattttgtgctgcttttcatgtatagaagttttatattttatgtagtaaaattttctctttttttggattctttccttgctgttacacttagaaagatagtcccatccctaggtcaaatacattttcactgcattttctttgttatttatggttacaattttacatttaagtcttaggctataatattaattttagtttatccaatgaggtaaaaatctgactttttgccaagtaaccaatcgttccagcactactgattgaatagttcatatataggttgttttgaagttccacctttataatttactgtacatgcatatactcactcacatgtgtggatacttttaatcttactttttggtgctgctgatcactgtttcttctttcctagtactatattttttaagttatcatagtttcaacctcaccaatgattgtgaaaatgtaagataaaagaatagtgctatgtaattttttgcccatcaattttacaaaaaaaaggtaagattgccaatatccagtgctgatgaatatgtggagatgtggacactctcagcactcctggtagtgtaaattagaggcaggtaggcattacctataaaaaaatgtaatgcacatgtctttgaccaacaaccttacttctaggaatctacccttttctttttctttttctccccccaagatggagtcttgctcttgttgcccaggctggctggagtgcagtggcgcgatctcggctcactgcaaccaccgcctcccaggttcagctgattctcctgcctcagccttccaagtagctgggattacaggtgcctgccaccatgcctggctaatttttgtatttttagtagagacggggtttcaccatgttggccaggctggtctcgaactcctgaccttgtgatctgcccaccttggcctccttcccaaagtgctggaattacaggcgtgaaccactgcacccagcccagaatctatcctatataacattcgtacaagtacacaagggcatatattcaaggatgttcactacattataatctgtggtggcaaaacaacaattagaagtactataatgtgtataaacaagaatggtagaattatgtatattgtatcatagctaaaaaggtagactttcagcttccagctgtgatgaaatagcttgtattgggctgtcatactaacaataactggaatggctgaattttaaaaatgaaggtgagtgaaggcttcagagagtaattacaacagccagaacttgagaaactaaaaccttggacagaagggacactcaaagaataaactcactattctctgtgcagtttacctttgaggcatttgctgattcttaagttttgcttgcatgaagtaaggggccaagaaactaagcaggaagtctcactgttctacggagacaaaaattgcatttcaggaccttcctatgtggaaggggctgtgataaacaccttgggctttcagttgaaacccctaaagaatggactacaccttaggagtaaggaaaaaccataaatagacgagttcttagaaagcctcaaatacaaatcctaaaacacaatcttcttaattcctgattgggctaagaagatctgcttatactgtatctgcctactaaaataaactgaatcttctctggagggaaataatgtcatccagagcctctacaattctttatacaccgtattcagcattgaaaaaagaagacatgacttagaaaaccatgacttgttattaattggtaaattaataaaattaataaaagacaaaagaaaaaaataaaacagacacccagacttctattcaacatagcttttttttttttttttttgagagaagctctcactgtgttgcccaggctggtcacaaactcttgcgctcaagggatcctcccaccttagtctctgggacaacaggcacacaccatcacagtcggccatcattggaagttctagccagagcagttagacaagaaaaagatataaaagacatccaaattggcaaagaaaaattaaaatggtctccattcacacatgacatggttttatttaaaaaacaaaaacaaaaacaaaaaaaacctgtgagaactaataaacaaattcagcaaacttataggatacagaatcagcacacaaaagtcagttacatttttatacactaaaaatgaacaatttgacaaggaaattaagaaaacagttccatttataatagcatcaaaaagaataaaatacttaagaataggcttaaccaaagaggtgaaagacttgtacactgaaaatggaaaaacattgctaaaagaaatagagaggagacaaataaatggaaagacatgctgtctttgtgggttagaagacataatattgttaagataccagtacaacccaaagctatcaacagattctatgcaagccctatcaagagcccaaatgatgatttctgtaaaatagaaaaattgttctaaaatttatatggaatctcaagggaccctgaatagccaacatgaggatgtggagacatgaaaactcttgtgtactgtggatgggaatgtaaaatgtgtcagcccctatggaaaacagtatggcagtccctcaaacaaattaaacatagaattactatataatccagcaattacacttctgagtatatatccaaaagaagtaaaaataggaacttgaacattttctacatcaatgtgcagcattgcccacaatagccaaaaagtggaaacaacccaaatgtccatcaatgaatggataaacaatatgcaatgtatacacaaaatgtatacccaaaatggaatattattaagccttaaaaaggaaggagattctgacatatgctacacatagatgaactttgaagactatgctaaatgaaataagctagttacaaaaggaaagatattgtattattccatttatatgagataccgaattcatagagatacaaagtagaacagtggttgccagaggctgggaagcagaggacatgaaaagttacttactgttcaataaatagagtttcagtctgggaagatgaaagagttttggagatagttggtggtgatgtttgcacaatgatgtaaatgtacttaatgccactgaacttaaggttattaaaatggtaaatggtaaattttatgttgtgtatattttgcagtattaaatagaaacaaaaagtaaggagtagtgggaaaacctggttgtgacatcaatctcaggtaaaatgtgtgctttactgcatggaccctggaatatgaccaaggctttaacaattctctgatgctagccccctaagagtaaagcaacactaaaactggcatatttgataagtataacacttacgtaaagcaaatgaaaaaaattaaattcccaagaaaaatgtgttctagtcaaaaaaataaaaaagtagtagtcctgtcagtactgacatgaaagcatatttaatacgtgttttgggtaaaacagtttcagaacaatataaacagtgttatcctatgatataaaagaaaaatgtgtgtgtgaataaactattttctcatcgtaagaggtattgattttataactcccttttggaagacgaaaagaaattcaactacatttaacatagatctcaattataggttggattccaatttcagaatgctaaactgtaaaaagaagacaatttaaattcaaggaaatacagtggatgtgtgtgtgtgtctatatgtatatacatacattgtgtatgtgtgtgtatatatatatatgtaaaaatgtttgctgatttgatttgtgctctagaaatatttttaccatttctcaattctgtatcaggatgcaacaatagaatgaaactcagtggacgaccctacagacacatgggagtgcttggaacttcaaaactctatgacattcggaaaactatctttactttcactccacaggtgggtgaaataaactggaatgtgcattgagatgaatggaaataaaagaaaatcattggagaaataaagcatttactggagttgggataagtgtcaaagagttccaccaggccttgcacataacttactcagttaatatttatagagttgaactgaattgaacttccagcacagagtttcactaagtgattgtaactgccaaaagtaaccctgggtattgcagaaactaaggattttacaaatgctagagtacttataaaagtaatccttacttttaaaagttaaaaataaaactgtatgtgtcctttataaacaaaatacaaccttttttattcagctactaaattatgttttctttgtttggaggaagggccctttttacattcatagaaatcttcagtatcctcttctaaacaaaaatgtcggtactgttttagctgttattaaacacgttgttagcctgatgtttattagctacatgataataacaaacctgattgtatgtgtttatggggaggagaaactattttctggaaagaaagcttaaactccccatttgtcatcttacatttgaaatagtgcagctgaggtaggtataaacaaaagagtaatggatcatagattctatttctgactttgtcatttgctagccatatgatttcactaatccacgtatcatctcttagccttatttttcatctattaaaagaagaaaagccctcactggggggttacaggattaaataaaattatatacttaaaaatacttcgtaaactgcagcataccgtaaaaatgtcagaaattattatatgtgccagttaaccccagatactttggaatgtattagacattaaatgtgggggtatcattgccctgtgacatcttggatactcttctgaatatatgagtagtttaaaatattacttgataattgtgagagtaaattaatctaatctattatttttatttgtctcagtttatagaccagcaacagttctacctggctctggacaacaagatgatagtggaaatgcttagaacagacctctcctacctctgtagccgctggcggatgacaggccagcccaccatcaccttccccatctcacacagcatgcttggtaagggctgcatgaggcaaggaacgaatgtattttggaaataagtcatagatttagcccttcaacatcttgttgtttctagagagctacttcttataatttattctttcagcagtatttattggctcctattttatgccaagcacttttctaagcactggggacacatggagtgaataaggcagatgaggtttccgttctcatggagcttatgctttagaaggtgaagacagactatatgtaatacataaatcaacatacaagagtaatttcagagctataattgaatagttttcagatagtttgagagctataattcaaaaaatgtagtggaggataatttaaaacttggttggtggttactttagataattagtttctaggtcaattttcagaaattttattcatacaattatttttaaagacagtaatactgtatctgcatatttcttactctagtggtacatcaagattttatagataatttcccaggctgcttcttccaaagcctaacggaagctgtaaaatctagtaggggaaaaagccaaaaggcttttggcttacgtttcctcttttttttttttttttgactggatttcctgacattgcttacttgaaactgggtgaaaggctttattattctctcagttcctggaggactagagccaatactgaagcgactgcttcctttctgtgtttctcctgttgcttccaaagacctgtttgtactgccaaagtatatagaattccttttcattaaagaaaaatcccttattattaatcattcaaaatccagacagactgttagggattttggtcacatctcaaaagtgcttcaatatcacaggatttgaggaagtagggtagtctttcttctctttgtctttcttcattacttaagacagttaacacaagtacccatttaaaaactactatatttgcagaattgtcttcagaaagtataaagtctaattggagacgaaaagctaatatgcaagaatgatagaaacaacttaagacaatatataaagaattactaaaccattaggtcagtattttacagtgaaggagatccagttgacaaagaaaatttctcaactgaggtaggacttaaccaggctttttggaatggatagtattcagatgacaggagagcagaaggaaaggtactataagtgaggaggaaaataccatgagtgagccctagaggcaagaatgaacttgacctgtgagaggagaatgaagttctcctgaatagagtggagtttgtgtgttggagtataattataagcaaaatgggaaaagtaaggtagggttcaataatgaagaccttgaaaataagcaaagatatttaatatagatttttctcagaagtctgaaactatcaaaaggttttgagcaaggagtaatatgataaaaatgatgtttggggactattggtgacagtacacattgtagtgaggagagactgatgtcaaagaaactaatccacatatgaggtgaagagaaagtacactggattggaggtaataaaagtagaatgaaaaagaaagatatgagtcattttaagcaacacccaactcagatattggataactagatataaggtatgaattaagatagctataacaaaataccaaaaagttggtaatttataaacaatagaattttattttgtactattctgggagctaggaagtccaagatcaaggtgctgacaggtttggtgtctgggaaggacctgaagtctctccttctaagatggtgccttgttgcttcatcctctgcagcagacacacatgtgttcttacattgtagaagggacagaaaagaagcaaacccactctcttaagcccttttataagggccccgatcccatccatgatggctgcacactcatgacttaatcacactagatggcctacttcttaatgctatcacattggtgattaagtttcaacaaacgaatttgggggcacattcagatcatagcactaggtaaatgttgctgcattgatagaatcagagacattttatatgaagaagccagttataaagggacatgaatttgtagtgacaaagagatttcagaattgaaatacctgagagttgggatgagatacatagccacagcttgggaagcagaataaaactaaagatctaggcttaaatcaagcatttttggtacttgatatgtggtcacataacaaaaacaacaataacaatagcaataataactgtaatatttactgaatactttctctgtgccaggcactgagctaagtgttttcaattaattattttgaaatctctacaacactcttattcaggcaggtactcattatccaaagtcacaaagctagtaagtgacagagccaggcctcaaacaagatctttcagtccctgcaacattaccaacaacagtgtgtttttgccagtgaaaattttgtgctgctgaaaagagaataaacattagtgatcacattgaaatgtggattagttaaattctcatattacagacaaagattcctgtaatacataaaagagcaaaaataatacataaatggcatccaggtggatgctatttacaatagatatccctaaaataaaatcataaaaaaagatggaagaaaagaatatgtaaagatatatcatgtaaatgctgacaagaaagcagtggtcgcagtattaatatcaaaaatagcaaataaaattcaaggcaaaaatcagtaaatgggataagaaggatattttatattgataaatagtacaccaacatgatataacatatataaaattttatgtactcaataatgtgaattaaatgtataaagcaagtatttaagaaaacttagggacaatatcacaaaactattatatattcatgatgggaaacaacaacatacttctatcagaatgtcacagatcaattatacaaaataattaaagacatagaggagtaacaaacttgatttttgtatttatgggtgtatatataactatgtatccaaaaaggcagaacacacaaagaatgtttatggttaaaaagtagaaatcatacaaacgatattgccagatacgtgacataaaactaattaacacagaatagttaaaaagaatctaactataaaggaattatattttttcccaaataattattagattaaagagaaagtcaaatttgaaattatatgcttcttagaaatgaaaaatgataccactacttataatttatgagatttggtcaaaatcatatttagaaaatttcatatccttaaatacttctacttttaaaaagtgacttttagttttgagacaagatggcatagactcacttctccctattcctcctgctaagtgcagctaaaaatccttgacatatataaaacaaacataagaaaactctgaaagttggaaaccaggcagatcagctagagactttaagacctgaagaacagcagagcagtaaatatcctgggccttatatgtcctggactggaagctagagaagctgacatctcagaaatacaaaaagaaaaaaaaaaaaggaaaaacaggtttttttaaagacccaaggaaaatctgctttgtctagctgaaggaacaggaaaggagcaacctagagagacagaaaacttttagaccctattttactaggccccacttatgcccctgtcagcagagactgagtggggactctagacttccacgcttgcacagctctgaagaggcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagtaaaaaaaaaaaaaaaaaaaaaaacctgaaaaaatatgaacagagcctcaaagacctgtaggactaataacaaaagatttaacattttttaacattcacgttaaaaagatctaacattcatgttataaaagtttcagaaagaggagaaaaagtatgagagaaaatcagaaaaagcattccaactaataatgactgaaaaattggtaaaagacataaacctacaaattttttaaaaaatgagaaaatcttaaacatggtaaaatccatgtcaaaacacataataataaagttcttgaacattaaagaagaaatatcttgaaagtggccagaaagaaacaataccatttctataagcaacaaacagaatgacagcaaatttatcatcagaaaccatggacaccagagggaagtgacacaacattttttaagtactgaaaaaaaaaagaattttaaaccaagaattttgccctatccagtgtacttcaagaataaaaggaaaaaagacattctcagatgtaggaaagctaagtgaatttgtcagcaggagatctgccctaaaagaatggtttgaagaaagttcttgaaacagaaaggaaataataatagatggaatcttgaaacatcaaaaagaaaaaataaaaataggagtgaaaatatgagtaaatacaatagactttctccacttcaattttccctttctttctctctctctctctctctctctctcccccacccccgctctttttctttttctttttctttttctttttctttttcagagtctctctctgtcacccagcctggagtgcaatggcacaatctcagctcactgcaatctccagcttccgggttcaagtgattctcctacctcagcctccccagtagctgggattacaggcatgcaccaccatgcccggctaagtttttgtattttttttagtagagacggggtttcgccatgttggccaggctggtcccgaactccttccacttcaattttctaaattatgcttgataagcattgcttaatatagttctcaaagtatgtagaagaaatattcaaggcaagtatattataaatggggaaaagtaaggaccttaatgggagataagattctatacatcactttaattggtataatgttgacactagtaaagagtgatatatgcatcatgtttgtatatataagacaatgcctggagtaaccactaagaaacctatagaaggagataacagtcaaacccagtataggtaaatcaaaatggcattctaaaaaatgtaaaagtaacccataagaaggcaggaagaagaaaatagacaaatgaagaacagaggtacaaatagaaaacaataaaatggcaaacttaatcctaacatatcaataattactttaaatagcctaaatacatcagttcaaatatcacaatatacgtagactgaaaagaaaaggaaggaaaaagatataccatgtaaacattaattttaaaaagcagaagtagctacattaatatctggtaaagtagaactcagagtaaagaaaaaaacaggtagtaaaagtgttaggaaagacaaaggagatatagcaacagaaatagaggagactttaaacactgtaaaagaataccaactacaattttgtacatctagataaaattgacagattttctagaaaagtaagaatacaagtataagctgaataggaacacttataaaagtgtatgagaaaaactataaaactattgaagacaataaaatattttaattagtagagaggtacaccatgttcctagacataaatagttaatattgagaaattacccactttcattatatcaattcaggcaattcccaataataataaaaacataaatttttatgaacaagctgaaccttgatttcatatgtaagagaaaatgtaaatgaataaccagatttttaaaaagaaagtgaaagatccattgtaattaaaacaatgatgaagatagaatttcaaatagagacaaaatttaatataaatacatttgggaaaataattcatttaggcttgctactttactttttttgcaaaaatacattctaaatagattaaagagctaaacataaacaataaacctgtgagagtcttagaaaaaaatatgggaggttgggcagggtggctcaaacctataatcccagcactttgggaggctgaggcgggaggatacttgaggtcaggagtttgagagcagcctggccaacatggtgaaaccccatctctactaaaaatacagccaggtgtggtggcacgcgcctgtagtcccagttacttgggaggctgaggcaggagaatcacttgaacccgggaggcggaggttgcagtgagccgagattgcaccactgcactccagcctgcatgacagaggcagactccatttgaaaaaaaaaaatatatatatatatatttatatgggaatatatatatatatatatatgggaatatttttgttatcttaggttgaagagagctgtcctttgcaagacacaaaaataaaatattgtcagattttgaaacatgaaaatgaaatcttttatatcaaaagcactgtggatgcggttgaaagaaaaataataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacgaaatcaggagattgagaccatcctggctaacacagtgaaaccccgtctctactaaaaaaaacaaaaaaaatacaaaaaattagccaggcgtggtggcgggcgcctgtagtcccagctactcgggaggctgaggccggagaatggcgtgaacccgggaggcggagcttgcagtgagccgagatcaagccattgcaccccagcctaggtaacagagcgagactctgtctcaaaaaaaaaaaaaaaaaaaaaaaagtgtaggaaaaagtctttctatactgttggtggaaatataattggcacaactcttatagtgggtaatttggcagtctctgtaaatttacttagtaagtgtttcatttgtcctaatagttctacttgtaagaatttaacctaaggatataatagaataagtgcatcaagatgtaggtacaatggtcttcattacagtgttgattataatataaaacagtctaaatttagtaagaattatttttagctattacaaaggtaaagttagaaagcagatcatgaaagagtatatgtagtatgattacttccacataaaatcaggtaattgttagctttctagatattttttatgcctatacacagacatatgtgccaaggttctttatatgagataatgtgtataaaatgtttagcacagtgcttggcacataacattcaacaagtagtggctactggtattatcagcattcagtagtcattcagtgttctgccatcagacactgtgctaagtacttctgacaaataagataatgctgacaaataagataatgcctttgaggaaatctatcagtcatcatcccttaccatttacccattcttaagtgttgttggctctcagatgaattgttaaaatcaggatggtcaatgaggagtgtctcatttgtattgtaaccaccagaatgttgatttgaaataattacaagatttctccctacttcagagttaaaaccacaaagattgttttaaaattctgttcatttcaagatgaagatggaacaagcttgaattcaagtatcctggcagcactccgaaaaatgcaagatgggtattttggtggggcaaggtaagtgacctctatacactctttagtgaaatgaaatgaaattaaggggctggatatagtagtggcatacctgtgatgcctttctgtgtatgatagtccccccttatctacaatttgactccgatatttcagttacccgtggtcaacctgtagtctgcaaataggtgagtacagtacaataagatattttgagacagagagagagactacgttcacataacttttattatagtatattgttataattgttctatttcattattattttgagctcttactatgcttaatttataaattaaactatatcataggtatgtatgtataagaaaaaacacagtatatatataaggttcagtactatctgcagtttcaggaatccacaagggggtcttggaacatatcctgcaggagtaagcgggggctaactgtatcttcgataacataatcccatcctacttagaggagtttgatagattgaatcaaggaatttaatgttgtagaggaaggttggaagtttttcctaccctgttctttgcctagatctcaaaggatcagaaaacctgttttgttttgtttttttaatgcctactggattatttgattccagctgcttttcttttctttttccacttaagtttttattttgaaaaatttccagcttacagaaatttgcaagaatactactgaacacccatataccctttctcaagattcacctgttattaacattttgtcccactgtgcattctctatttcttcccttccctcccttcctgcctttccccccttcctttctctcttcctccctacatcctcccatacacatacatatgcatatacacacacacacgtacatactacatatactatgtgttttatatatatatacatatatatacacacatgtacacacatgcttttttgctaaaataattagccatagacatcataactcttcaaccctaaatacttaagttttctttgttttgtctaggaacaagtgcattcttacatataactataatataatcatcacacttagtttgggaggccaaggggggcagatcacttgaagccaggagttcaagaccagcctggccaacatggcaaaaacctctctctacaaaaaatacaaaaattagccaggcgtgttggtgcatacctgtaatcctagctacttgggaggctgagacatgagaatctcttgaacctgggaggcggaagttgcagtgagccaggattgtgccactgcactccagcctgggagactgtggaaagcagtttggagatttctcaaacaacttaaaatagaactaccattctaccctgcaatcccattactggatatatatccaaaagaatataaatcattataccatagagacacatgcatatgttcatcacagcactagacacaatagcaaagataaagatgggcatcaacctagatgcccacctatggtggacttgttaaaggaaatgtggtatataatgcaccatggaatactacagtgccataaaaaagaacaaaatcatgtcctttgcagcaacatgaattcatatagaggccattatcctaagcaaattaacacaggaacagaaaaccaaataccacataccacatgttctctcttataagtgggaactaaacattgagtagacatggacacaaaaaaggaaacaatagacaccaggaccttcttgaggatggagggcgagaggtaggtgaggattgcaaactacctattggatactgtgcttactatgggtgatgaaatagtttgtacaccaaacccctgtgacatgcagtttacccatgtaacaaatctgcacatgtacccctgagcctaaaattaaagttggaaataaataaataaataaagtagaaggagaaataagaacagttacccaattatcccaataatgttttatcatagctgttttcccaccaatccaggatccaatcaaagatcacatgttagcagttagttgttatatctctttggtatcttttaatctagaagagttctccagccttttgtcaatctttcatgagagttttcattacatttttgaagaatgcaggtcagttattttgcagaacatctcacaatttggatttggctggttgtttctcattattagattcaggctacatgtttttggcaggaatactacctgtgtgatgttgggtccttgttttaagttaggatctttaagatggagagcaccccttcaatggttaggagaggcacaagatggaaataaagattttattacttacaggtcctgcaggtgaggtacacagaatacctggaggccacacacactgaggtcagggagcatgtggagagagaaaaagagagacccatgggccaatgcctttattgaggtccagggcattatccaaacagatattccttggggagttttaattggtgggtttaaagcaagtaggcatgacttcctggaggtcacactgtgactgagaggtggtcactgtggcatattggcatagttcatgtaggatgtgaggatcagtgaggctagtcaaatagatcatatttagctgtcccttagggaggtggttaccaggaggaagttgtataaggcagatatgtggactgaccacagtgaggaactgagggaggtgtagaactggaaactgtcaaagattcctgaactctgcttctggtatgagaaagttaagcttatattcaaaagagatgccagggaaacatacaattataagaatttactacagtctctttcagtgcatcatatcagaggcacatgagatttgtttgtgacattattgggtgatgataaccttgatcacttggttaaagtgttcaacctggtatctgccaggtttctgcatatcctttctccaacagtctttgatcaaatcgtattagcttccgttgatccttgcgtgaattcacttattactattggagttattaaatggtgtttctatcattctgtgtacatttattggttgaaattcttatgttaaaaaaaagagctttcccttccccccttttattttgtagtttagtatcagcacagattcatagattattattttattcaatatgccatgatccatttctgttattatttcaatattttaattatccaaggtgtggccattgatagccccttcaagttggcctctttagaaatttggtaatgctgactttgcttttgggttttgtaattgtcttcataagtaggagacgatatggcttacagtctactataatttacagaattgtcaagtaccatcctttatgttcaaatgacctttgggtatttttttaatgaagtgatgggtttgtgatgatttatcttcattctctccaggcttctccagtagccaatgcaaatttttaccagatgtttggcatagttagcaacgtaatatatggcagtagaagagagcaaaactggtctgctggtggattgttaatccataattgtaacctttattaatacagtcccctaaccatttaagatgtacaccatgcctaggagtgctgtaaaattttatttttataaaatttatattaatgtatgcacattagtaatcccccaacaaaacatgttaggtgtccttttatcactaagattgtgttgtttaaaaaggatcacccctgattttctgttttctatcctcctctaatttttagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatggtaaggaggcttcataaagcactggcctggctggacaaaactacaaaatattgtttagcaccatccttaataatttatgctgccagcagtctcacagtgttctatcctcactctagatctctacttttgtttggctttacttttcctccctctacttacctttggtttctggtctaatattcctgcggtaattgtggagtatggagttggacagtcccttactaagattggggaagattcctctcccaggcatttgaagtggctggtgattttgacatgggaagaagcagtggtgagtgagagatgattaatcaagtatgaagtaggaaaataatacatatacagtactgctttttgacattaaaaagcataaaaatatgaaatttaattagagtccttttcatataatattagaggagcatatcggaatctctggggaggtctgtgtagtttgaaaaagcctattcagtatgtctgttattttcatagtacaaactaggcaaatacaactaagtcaaactctaattggcttctagcaatacaaaggtgatatagtgagaaagcattgcaggggcatgcattgaaagtgactgagcaacactaccctacagtgttaaaatactgacttaggcagagcaggcattatgttgcttgaatttcatacagagaagggccaataagaaagaattatttgtctagccctctaaaatatgatttgcctgctttcattgtctgggtatttgactgttagcctgtatcttaaggcagccaatttctttatcttaagagtggtatgttggagaaaagaaaaaaataaatttgctgccctcagtgaggtcagccagcacaatctcatacaataggacaacacattagcagtcagaaggactattttcttttttgggcccgacatttactcactaagcaccacttcattcattctgtgtttgtttttgtaagatctaaaacagttgaatttctttgttggaaaagtacattaaatacaaggctatttactgttatcagtaataacaaaagtcatgatgtcttggcataaaatactttgaaaattaaatgagaagatcatatattgagattgtttgctcttctatgggtagttgtgatttttatctgtagtactcattccattggattactaaaatatatatttctaatgatacgtgttactgaatttgacattatggcattctgagtcactttcctagttccgggtttactcatcagtgttctcaaaatgaatgtatttattgcttgccagcccttctgtgggtaaagagcttctctccatattcttcataatcctccactcaagtctctagattgtattcaaggttacaatctttgtcattaggatgtcactgaatatgagctccattcttacagctctactagttcgcattagtcacatcagagcacagaaagacatctggagagatcagtaaatatcatcaaaaaccagaagactcatgactgatacagcagactttggtatcgatctgaatagtgtgtttttctaactataaaccttgtgaatattcatgtaaagtctgaaatattaagcttccacaggatatatgtatgtttttctttccattacccatactcagagataatgttatagaaggtatatgggagaaggggagcccaagaagatagggaccatatccatcctcttcaccactgaaatgtcagcacctagtacactgcctggtacatagcagccaacaaatatttgctgagtaaacaaacgaggtgactaagaagatttttgccctttcctggcccttcctcaccaaagtcccctcacattagtgtgacctgaagctccctgttctgttcctcctccatccctgccaccattactatcacatgcacacacacaaatacacagattgctaaatgcttgctccaatgtaaaacaagctcatactgctttcaagaaccctgaccttgtctcagcaagttgaagaggaggtggatcctagtaaatggccatggtcactggatcttaaagtgatgaggttatatcatgatcacaagcttttcctccatgagctaaaaacaacctacttctggtgctgtgttgtgagcacaggagccaatcattctctttgctggggtagattgtaaagtaactaaaatattttcattcttttctcttccccctccccccactaaccttgcagctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagagtgagtaatgccgtgactcaccagagtcaggcacaggatgacgtgaagcccaggataggggcgggcattgattacaatgtaagcaggaactttagttttcttcactgctttatcccccgcatctcagacagcacctagaacatattagacactcaaatatttgtaaaatgagtgaattgtgtatagttatgctgcaggtagtgctatgtagtctggtttaactggtaacatggtaagaagaggcagaacaagagacatggagcatattcaactataacattaaagtttgaaatggtagaaagggtttttcctttgggaaaattacttctatggaattttcttgttgttccagcaatgtagagctgttttgtcaaatataatactcattctttacaactttgccattcttctccccatggccactaccctccttcagttgtattcacagtggagggtgtcttctgccacacattgccaggagtagtcatagttcctaagagtgttcaatgtctttatagtagctggatatgaaaggagagaagggctccttggccacacctagaagacctgaatgttaacattttacagatgaggagaatgactgagatgcatgctcttgctgtctaaaactttattgaccattactaaccaaatacattaaacatgaacattgggaatcatttaacatttataatagggaaaagctcagcataccctctgagtatgcttcctcgagaaagggcttatatgaagagatgaaatttattgttatacttctcaattgtgaaccagaaaacttgggcttaattcccagctctgctacttacttgcttgaacagttatttgagctctgtatctctctttctgtatctgtaaagtggtgaaaattacaaatctttccttagaagtgatggtaagtatttcaacaatgaactgtaagtaaaaaatcttaggaatatctcaaagttggtcagcaactacatttttcttattccctagataggatcatccattcacttattcttagggaaatttaaccactagcagccagatattcacctagaaaagttcggaaaatagaaaatgcaactgagttctttctattatatgtcgtattccatcaaagtatcagtgaacgcaccatcgtggattaatcacattagtaaatttaatatcttacatgtccagctagtgctataattctagaaattcaattcaaaatatacttattaattgcacattatttaaattatcttatattcatatttattttctttgatattaccaagaaaggagaaatttgtcattcttgttctatgaagaactgactcacatgtgacttaattgttgaagtcaactgtgcatttctattagtctcctaattacctaatatttcccataaatgtcatatttttgcagatgttcacatgtatcttcctacgaagttatttcaggcttcccggccttcattcaacttacttgattcacctcatccccgacaggagaaccaggtaaatttgtgcaggaggtatttctattagctttttgaaaaactgccatctttatgggaaataataggactagtcattatggttcttgttactaactagtggtacgcaaaatgctattctggtgaagatacatgttcttttcagttcacttttacattgggcaagtttgtctggtcagactttgggaaaactagattgctgtattatacatctggaaggtttcattacttttgctttgcctttcattagtatttaaagaattccttggaaaaggtttagaggtgaaaatatgactcattctaggacattatttaagttgagcacttgtgaacttaatttcttgtcatcatttctcaaactaaaggttccctctgttcgtgtagaaatacatcttcctagagaccagtctggggaggtggactttaaagcactggttttacagttgaaggagacctcaagcttacaggaacaagctgatatcctctatatgctgtatactatgaagtaagtggtggatattatcaatctagtttaatgttcataatcagaggaattatagcataataaatagagcacagcttttggagtttcgctgatctggaattgaatatagtttaacaacctatccatcatgtgacttcaaaccctcagttgtcctcatttatagaatttggattatatatacctcatagagttattgtaaagattaagatataatatccatgaagtctctaatacaatgcctggcacatggtgggtgatcaataactgataaatattactgtcattaggttatttttaagcctccattatttggtcaaatgtacagataagtttttaactcaagaaaagtaagaatatagaggtttataggagaaagaaactaacatttttgtttgctatgtgtcaggcatcctgctaggtactttgtattagtacaaactcaatatgtccaaattgaactcctctctcctaaaccccacaagcttacacaaaaataatctgttctccctccttttccatgttgtagtcaccatgaagaggcaggatggactttcttcccctaaatttggtttggatgttgagatagatggtgacatacacataccaagaaggtgtggaatatttattactcacataataaggctttctaggaagagcaaagaaggttcccagcttgctcccaaaaaggcttgagagcccagggaaaggagactaaattgggggttttataatcattacaggatgagcattctcactggcttctagttttctttttttgttgtgtccttgtttggttttggtatcagggtaatgctggcctcataaaatgagttcggaagaactctccccttttccttttttttttttattttttttattttttggaatagtttgaaaagaattagtattagttctctaaatatttggtacaattcagcagtgaaaccatctggtcctgggcttccctttgatgggagactttttattactgattcaatctcctttgttattgatctattcagattttctgtttcttcatacttcaatcttggtagattgtatgtgttcacaaatttatccgtttcttctagggtttcctacttgttggcatataattgttcataacagtttctaacaattcttttaatttctgtggtatcagttatatctcatcttctttttttgattttgaagtgaggtctcgctctgttgcccaggctggagtgcagtggcatcatcatggctcactgcagccttcactgcccagtctcaagtgatcctcccacctcagcctcctgagtagctggtaccacaggtgcgtgccaccatgtccggctaaatgtttttttaattatttatagaaatgaggtcttactatgttacccaggctatatatctccttttcatctctcattttatttatttgggtattctttctttttttctttgtctagccaaatctttgttgatttttgtttatcttttcaaaaaaaccaacttctcattttgttaatcatttgtattgcttttttagtctctgttttatttatttccactctgatgtttattgtttcttccttttactaattttgggtttagtttgttcttgtttttctagttactttaggtgtaacattatgttgtttattttagacctttatactttttgatatatgcattcattgctataaacatctctcttagaatagcattttctgtatcccatatcttttggtatgttgcatttccttttcatttgccaaaagaaatttttgtaatttccttcttaatttgttcagtgaccccttggttgtttaggagcatgtttaatttccttgtatttgtaaagtttctgtggtttctcctgttattgatttctagttttatatcattgtgatcagaaaagatacttgatatgattttgatcttcttcaattcattaatacttgtttgtagcctagtatataatctaccctgcagaatgttccatgtaaagttgagaataatgtgtattctgtagcttttggatggaatgttctgtaaatatcaattaggtccatttggtctagtgtgcagtttaaatccaatgtttgtttgttgattttctgtctatgtgatctgtccattactgaaaatgggctgttgaaggcccgtactattattgtattgtagtctatctcttcctttaggtatgttaatatttgctttatatacttaggtgctccaatgttgggtgcatatacatttacaatagttgaatcctcttgcttaactgatcccccttatcattatatggtgaccttctatatcactttttagtgttttacttaaagtctatttttttaagacagtcttgctctgtcagccaggctggagtgtagtgccatgaacatggctcactgtagtctcaaactcctgggctcaagtgaccctccaacttcagtttcctgagtagctgggaccacaggtgcatgccaccatggccagctgatttttaatttttttttgcagagctggggtctggccatgttgcccaggctggtctcaaactattgggctcaagccatccttctgcctcagcctcccagagtgctgggagttccaggtgtgagccacagcacctggccctgaaagtctgttttatccaagtagagttacgtctgttgtcttttgctttccatttgcatggaatatcttttttccatccgctcacttttagtccatgtatgtcctcacaggtggagtgaatctcttttaagcagcatatagttggctcttggctttttttattcattaagctactctgctttttaatgggataatttaatcaactcacattaaaggtaattattggtaggtaagggcttactactgccatttaattaattgttttccagttgttttgtagaatcaatccttccttccttccttccttccttccttccttccttccttccccccctccttctttccttccttccttccttcccccctccttctttccttccttccttccttttttatttctctcttactatctgtctttatggctaagtgattttccttcataatatgttttgattttttgctttttatttttagcatatctattatatgtttttgcattgtggttaccatgaggcttacaaaaaatcttaacaatttaactatgattacagtaaaagagaagaaaaatctctttaactcaacctcccaacattttgagtttttgatgtcacaatttaaaatttttatattgcatatcccctaacaaattattgtagttactatttttaatggttttgtcttttaaccttcatactaaagatgtaagtaatttacacaccatcgttagattaatagagtattcatatgactgtgtactcagtgacatatatcttcagatgttttcatattattcattaatgtctttttctttcatcttgaagaactccctttagcatttcttgtaaaacaggtctgatggttatatatttcctcagcttttgtttgtctggaaaagtctatgtcttcttcatttctgaagtattcttggctggcagttttttcccttcagcacgttgaatacctcatctcactatctcctggcctataagggttctgctgagaagtctgccgttaggcttattaagattcccttatatgttatttgcttcttttttctcactgctttcagaattctctctttgtctttgatctttgacatttttattataataggttgtgacatagtcttatttggagtagaatttattttcaaatatatatcttcctattgaacatgtctaaagtcaaattcactgtctttactacaaacctactgctgttgtctttcctgactctattctgggtatcatcattccttcaagtaacccagacttgaaattgtgtcattgtcttcaattcctccccatcccctgcctctcgctacagcatcaacactaccacagggaatcattggccaaatctaaatcctctatgatttgactttcaacttttatttaccattgctcttcccttacaatgtgaatgctgtcaccaaaacagtctatttatcatacccaaagcacagcctctacatgcctaccttcataccttgattcttattttttcttctgcctagaatattctcctttaccacactccatttctacttcttgcatttctctctgtcaaggcctaggtcatctgtcacccacatgaaacttcctccaatctgtaatagtaaaaataatcttccactgattctgagatctcatagcacttttttcatatctttaaaatttgacagtgtcagacttggagaaaagttgtgaggatagtacaataaaaattctggatagccctccttcagatccatcagatgtttccactgagcttttaatctctctctctctctctttcacgttgatgtcatcatctatactcaatcacacacgcatattatttttttctgaaccatttgagagtaagtggcagacacgatccccatctaaccctaaataattcagtgtttatttctgaaaaattatgaactctcctacataagcacagtataattgccaaagtcaaggaattgtttaacattaaaccaatactattaactatctacagatactattaagatttgtcatatagcccaatagtgtctttatagaaaagaacatctaaaatcatgaattttattgagttctcaggtgtcttgagtctccatttatctggaacagttcctgagtcttcatttttcatgttgttaacatttgtgaggaatacaaaccagttattttgcagaatatccctcaatttcagtttatgtgttgttttgtcatgattaaattcagattatacattactaaggtaatgccaagttcttttccatgtgtcatatcatagtgttgattagtcccattgctgatactgtaaactttgatcgcttggttggatcatttggttaaggtagattcttccatgtacctacactgtaaagttattatgtcatcttttgtaattaaaaaagtatcctgtagagatgtactttgagactacgtaaatatacggttactcttcaaacttttgctcactgatatttttcatccattaatgactcttcctatagcacattttatttcatgttttttaatttaatatattgaatagatatattcctatggttcaaaaatttttaagtacaaaagaatatacagtgagagggtaaaatgtctttctcccatctctgttcccccagataccctgttccccttctcatgggcagtcagtgttgtgtgtgtgtgtgtgtgtgtgtgtgtgtgtatcctcccatggacatttatggatatgtaggtaaacacagacatatatggggataattttacccctatttatccaaaaggtagcatagtatacacacagctctaccttgctttctttcactaaaactatatatcttgatgataactacatatatattccaattatctattgcttcataacaaatcactctgaaactcagtagcttaaaataacaaaaatttaaaaatttttaaattatctttcacagttctgggacttgcctgtgttcagccaggcagttctcacctgaggtctctcatttagttttggtcaacaatttctggggctggaatcttcacaatgcttgcccactcatatgtctaggggttgatactggctgttggctagaacctcagctgaggttacctacagctggtacacccacagatgacctcctcatgtgtctctccacatcttcacagcatgatgactaggttctactagtaagtgtcccagctgggagctctattactttgtatagcctagcctcagaaattaggtaagtcacttttgccttaatcacaagcatgcctgggttcaagggaagggaacacagaactcatctcttcatgggaggagtgcgagagtcacattgtaagaagagtaggttggataggaaattgttgcagctattgttgaaaatatattaccacaatctagatctacttcatattttctgaataattgtgtcattccattatttgaatatatcataatttacttagccagcctcttattgatgaacatttgaattgttgccagaattcacaatcacaaaaatgctatggcaagtaccctcatagcatacagcatttcacgtgtgtgaaatttatcatgcaagtaaaccagaactcgaattgatagatcaaaaaataggtattttttaactgtacaattaaatggctttgaatgtattcacattgttgtgcattcttcaccactactcattttagaacatttgcattaccccaaaaagaagccccacttcctttatccatcaacccccaatccctccattcccccagccctaggcagccactaatctacattctgtctgtatagatttgtttgcttgggacattttatataaattgagtcttgcaatatgtggtcctttatgacaggcttctttcatttaacatgatattttcaagattcatccgtgttgtaacatgtatcagtacttcattcttttattgccagatattatatcctgtataaatataacacatcttatttatccattcatcagatgatggacatttgggttctttctactttttggctattatgaataatgctggtataaacattcatgtacaagttaatgtggacatatgtttttatttctattgactgtataactagtagtggaaatgctggattatatggtaattctgcatttaaccatgttaggaattgccaggctgtttttaaatattttcaatactgatatatatttccaaatagctctccaaaggaattgtccaatttttattccgatcagcagcatattgatggtgcctgttttctcaaagcctcaccaaaatagtgttatcaactttagggacttttgacaatctgataggttaaaaatgttatcttggtatagtgctaagttaaagtttttctaggagtgaggttgagcaccttttcctatctttaaaagccatctatttgttttgccagcagtatttgttttgccagcagtatttgttttgccagattttcttttgtttttaattttttaaatctacatgttggagttctttatatataagggaaattatcctatgaattgcaaacattttttcctagttggtaatttgtcatatgactttccttacagtgatttttgaaataattcatttgttaaatctttgtctttaatttcaactatattgaagcccatgaatagggtaaaagaatgcattttgtcaaaagcacagctaaaactaagacttattcttgtgtaggtactggctttcagagctgactgttaatcatagttttataaggattcttagtaaattacattgatttcctagtgagagagacctatcaaaaacaggcatgttcattataacactgaaagaaaagatgattgccagaagctttacttaaaactgatgtagtcctgtcgttaaaattctagaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggtactataaattcttgaatttataccaaatctaaataagcgtgctttttaaaaattggtttctataattgttttttaaaacaaccatagcctctaaccatttgagatgtcttttccacataaaatttgatattcagttcttttagtttgtgaatgacaagtaagaattgtagatttataaaatgttataaaccataacatctttataatgatattaagaattctatatcttaagaatgaatttacactaggttcctacctcctagaaagggaaacatccatacaccattagtgggaatggaacttagtatagctacttatgtaaaacactatggaggttcatcaaaaaactaaaagtagaactaccatgggatccagcagtccaactgctgggtatatatcaaaaagaaaggaaatcagtatatgggagagatatctacaactcccatgtttattgtagcactattcccaatagcaaaggtatggaataaacctaaatgtccatcagaagatgagcagataaagaaaatgtggtatatatacacaattggatattattctgcatcaaaaatagtaaaaccctgtcatttacagtaacatgaatggaactggagggcactatgttaggtgaaataacccaggcacagaaagacaaataccacatgttctcactcatatgtgcgagcttaaaaagttgatctcatagaggtagagagtagaatgatggatactagaagctgggaagggtagtcgggagtgggggatagagaaagtttagttaatgggcatgaaaatacaactagattgaaggaataagatctagtatttggtgtcacaatagggtgactatagtttacaataatttgttgtaaatctcaaagtaactagaagagcagatttggaatcttgccaacacaaagaaatgataaatattgaggtgatggatgtctcaattacccaggtttgatcattacatgttgtatgcttgtatgaaaatatcacatgtactccataaatatgtataactcttatttatccataaaaattgaaaacttaaaaatttaaacaaattttttaaaaagaaagaaaaaaaccccataaaccaaccaaacaaaaaagttcctactttctaggagatagatgaaaagacctcattgtttcttcctagaaatccttcttttctgatcttcatggtattttctgaggaagagagttcagtgtgtcattatgttaaagaggagcaaaggtttttcagctgaaaagagaaatgtttgtggaaacctgaggtgttacagaaacgataatattatgctatctcttgttaggcctgcacagaccttctctcccaccagaaacatttgacagtaggacttcctccagaacctcgagaaaagactatctctgcgtgagtatggctgggtttggtcaggcttctctgagaaggagtggtgtggacttagaattcccttgccctaatctgtcagtggatgataatgtcctacatatgttcacctctatcagagacacctagtggaagaatgttggtaatggtagggcaagagtaaatgaaggagaaaactcacagagtagtactcaaactctttttacttgttggattttccatacctgccattcaaaaaacaaaacaaacagggtaccctgaattagcaaccacaaaatgtcagccatactctggaaagagcaagtgaaagaaagtggctagagcacagggctgaccatgaaactccatgctgctcatggggaataaaggggatggaggtcatagtcaaagaggaaaaatggttacttacagagcaatgtgaggtagcacccctccaggaaccctgtaatcagagtgccactgtctgaggtctgccacagcctccaattggaaacagtaccctaagataggcttggcctggagggagatgtaagtcaagtgatggggctgggatggaaaattcagtctttatacatgagtcttccttttgccattggccatgccagtaaaattcatctgcagtaaatgtgtttaatttcatatcacaccagtgccaaaatttaaatcttgcaaacagtctgtatctccaagaaatatttttagagagattctaacttcattcataaatgatctgaagaatctgtttttctactaggagtaatttttaaaaagggtattcccccctgcttgccagttctacttctgtagccaatgtagttaaaaaaaaacttttgtcaatatttctccctcattttttcctggttaaactctatccagagcatgttttttgtttacaaaattttttttactacattggctacagaagggatacttttgctgatgtctgcatactccttccttcctggtttatgtccatgatttctgttacccttgagttccagttcaagctcccatatgaaggcttagagaaacaaaagttccagcaagcttcaccaccgcgggcttaaagtgctctgggtactaaatagactcaaaaagcagtctaggccacaaggactgcaattcctgggcaaatccttgtgctatgctggactcgaagccaatggacttggggtgcatgcggcctagtgagacatcagctagagtgggcaaaggagtgcttgtgccacccctcttccaactccagatagtgcaactctgggagagaatccttccttccactgaggagaggagaggaaatagtaaagaggactttatcttgcaagttggataccagctcagccacagtaggatagggcaccaggcagaggcatcagactcccattccagtccgtagctcctggatgacattttgacacataccttgcaccagaagggaacctgctactttgaagagaagtacccagttttggcaggatttatcacgtgctgactaaacagcccttgggacctgaacaatcagcacagtgaccagacattctggttccaagtgtgaccaaacacatgcccagccgtggtgggtatagggagagactccttctgcttaagaaaaggagagggaagagtaaaggggactttttcttgcagcttaggtaccaggttggccacagtggggtagagcaccaagcaggtttttgaggtcccggattacaggcctggcatttggcctaggaactgctaacaaatgtacagtgcagtggtggttcaagaagttttgcaaaggagatgagagccttgaagatgaggagcatagtggcctgctattgaaagttgacaacgaccaattgagagcagttgttgaagctgatcctcttaaaactgcatgagaaattgccgaagaactcagcatcgaccattctacagtcagtcattcagcatttaaagcaaattggaaaggtgcaatgggagaaaatatttaccaactacctatctgataagggattaataaccagaatgtataaggagctcaaacaattctatagggaaaaaaatctaatagtctgttttaaaaatgggcaaatggtctgaatagacatttctcaaaagaagacatacaaatggcaaacaggcatatgaaaaggtgctcaacatcattgatcatcagagaaatgcaaatcaaaactacagtgaagtatcatctcaccccagttaaaatggcttttatccaaaagacaggcaataacaaatgctggcaaggatgtggagaaaagggaaccctcatatattgttggtaggaatgtaattagtacaactactatgaagaacaatttggaggttcctgaaaaaagctaaaaatagagctgccatatgatccagcaatcccactgctaggtatatacccaaagaaaggaaatcggtatattgatgagatatctgcactcctgtgtttatttcatcagtattcacaataaccaagatttggaagcaacctaagtgtccatcagtagatgaatagatcaagaaaatatggtacatatacacaagggagtactattcagacacaaaaaaaatgagatcctgtcatttgtaacaacatggatggaactggaggtcattatgttaagtgaaataagtcagacacagaaagacaaagttcacatgttctcactgatttgtgggaactaaaaatcaaaacaattgaactcatggagatagaaagtagaatgatggttaccaaaagactgggaagggtagcagggtttatgggcgttgggggtggagatggttaatgggtacaaaaagtagttggagagaatgaataagatcttgtatttgatagcacaatagggagactatggtcaaaataatttaattgtgcgttttaaaataactgaaagggtgtaattggattgtttgtaacacaaaagataaatgcttgatgagatggataccccatttaccctgatttgattattatatgttgaatgcctgtatcaaaaatctcatgtaccccagaaatatatacaccactatagacccacaaaaattaaaaattaaaaaaaaatttaaagaaaagaatttgaggagaggacataattcaatccataaaatcttgcttctggaaaaacaatcttttttgtatcagttttgtgacactgtaggtaatccaaagaagatggcatggttcatgccccagagtgctttgtgtcagcaggagaatcagaagtgtgtgaggatgtgtgtatacgtgtgtgtgtgtgtgtgtgtgtgtgcatgtgtgtgaattgaaactatagaaaatcaaacaactctgtcaactgtgattgtaaagtaataaaatggcttcaaaaaggcacagctagtattccattgtaggggtgggatgctgaagagatgttggttaaagaaggaatacattctaatgttcagtagcagagtagggtgactattgttaacaacaatgtattgtatatttcaaaataactagaagagaggacttgaaatgttcccagccaaaagaaatagtaaatgctcaaggtgatggataccgtaaataccctgacttgatcattacacatcctatgtatgtaacaaaacatcacatgtaccctgtaaatatgtagaaacattgtgtattacaaaaaaagcacagcttaaaattaatttagtactttgtagccataatagttacttgtcaaatgttcaaagctaactatgaaagactagtctagaagaacatcatggtgtgagttttaaataaattttgaaggaggaagagaatccagatttagagagaagagagcagagctcctctaagttgatatgggccagagtggtttcaggaggcaatgaatgagctttgaagtttgaaagaatcagaatgctattggtaatgatgaaatgttgaggcagtgacttggacttggataaagcttcttcattttttcaacatatttaagattaagtggttgtagaatattgtctttctttgctgtctttttccttagacctctgccctatgaggcgctcactcagctgatagatgaagccagtgaaggggatatgagcatttcaatccttacacaggtgagaagaattgtaaaggctaatctggtgactgatattttaaagtttgttttcaattgatctagcaatttccaaagacaacaaaataggcattgtgagacctaggccattatttttgtctatatctactctgtgtgcaggaaataatggtatatctagccatgtatatgcgaacccagcctggcctctttgctgaaatgtttcgacttcgaattggtctgatcatacaagttatggcaacagaactggcccactcccttcgatgctcaggtacttaattcagtaactattttaggtggaattcacttttgatgtaagtttatagagtttggaataaggaaagaaagaaagctaaaacatttttatccatagctcagaagctggatatggcaaccttgttcccctgttggtcactatttatgcaagtcaaggagctgatatgatgacacatttgtgtatcagttcgcagcttcagaatgccatctcctgtgggctcttcactccaaatccctcttgacttatcactcgttgctaacttcatttctctaactctggagagtatttgagtgtgacagacagagttgggttaagatttaggcagtggagcgtctgtacaccaagaatgagtcactacatcagtggatcatggtgtcagtattctgtctagtcaccatcatgactgaataaaggaagatgacattttcattaacatctatctgacaagactctctttgaaattaactataggtgtatttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaattgttttatacctaccatatgccagatactgtgctttttgctttaagtttacatatattgtgtcatttaatcctttcaagaatcctctggagaagaaggtattattgtgtcacttttaccaataaagaaactgaaactcaagaaggttaactaacttccccgaagcaacatagctagtaaatagtggaatttgagtctgagtccacctgattgcaaatgatttctagttcagtacattgttatagataaacattatatagtataatgttgtttttttttttgcgagagagtgtgattgctcaataataaacctcaataagggataagcccctgaatattcacttttccttaatttagcctgttatatttcttgttttcctgtggattcatgaaaaccatggctctttattccttataggataaagtcaagatccctgggtctgatgtttaataccctcaacagtctggcctttatcttctactcccacagtacttcccactaattttgtcagttccagtccttggagattgatgtctccattgatttcaaaggcaattattgtctatacctctcatttggcacatagaatatgcaatgttttattgtttatcttgttttcatgttccatcactcccaaagagatagtcagactcaagattaggtatcatgtcgtcatacctgcttgcacaaatgttacttaaaatgatgacctgcatgtagtctacttttaataaatgtgtgatgctgattaacatgttcaagttatcctcatatattcataatttcatggattcaaatctatctcttttaagtctctattatttccaggctgagaagttttaattattttagtttatctgcatatatacattcattgtctttctctgaatggcctccagttccattgttcttctttcattcttcccaccttcaaataaagattttactaagtaccctaatggtctggaagcagggtgaagaagaaatcaattacctcgctaatccacaaactggatagtcagtccttaaataattaagaatctatggaagtaagaatacctaagcagtagggtgctatcaatttattttgtaattctgttcttccaatcaagtgactcagaaattctaagcaagaaaagaaatagagaaaatatagagagggcatggcaggcaaattagaagtccttctgttctaacatttctgctgactagctgaggaagccacagagggcctgatgaatctcagtccttcggccatgaagaatctcctgcatcacattctcagcggcaaggagtttggagtggaacgaagcggtgagattgaataactgcattttcatttcatactgtttggtttaagtgtctcattggttttaaaatgtttttccttcatcacagaaacctttttccccaaataaataaactccaatatataaaacagaaaccaagctgtcttctggaacaagatttggaaaccactatatttttccttaaatggtatatcaactaagtggattgattactatcatgtttcatttttaactgtttaatgcattccctcacattatcttaagcctccactttaggacaactagcaacccatatcatctgaaactttcttgtattctaattggcaataattcagtagctcttacagtattgtattatgtgtatagctgcttacagtacttctaatgtaacccttcaactttaaactcacaaattaatagtccacctacatttgtggttttggttggatttggcattgcgtacctaaagcagcagagcaaatgaaaagtggtcatctctcatgctcaactttcaaggttagggtaagtagatatatatggtcagatggatggatgtcagaccttagagtggtaaaagaaagttgaaaagcagtgcgtttcaagaagggtatcttgctaaaatgcacattttgattcagtagatctggggtgggacctgagattctactaacaaacttgtaggtggtactgatgctgttggtccatggaccacatttcaaatagcaaggttatagtttttaaattaagttaaaaataaggatatatatgaaagttttttttaaatgtgatggggaagaaattgaaccttattatcctctctctttctctgtaatctctcatactacatagttcgtcccactgattcaaatgtcagtcctgctatttctatccacgagattggtgctgttggagcaaccaaaacagaacgaactgggatcatgcagttaaaaagtgagataaagcaggtaagatactacctgggagattagctgggatattgccatgtttcagaacattcttttggaatcagactttgttgggtcatttattttgtttcacattctgagtttaatttgagccatttatgtttcaggtggaatttcgtagactgtcaatctcagctgagagtcaggtgaaacaactagggatcatttaacatggtttaacttacctttagttctgtataacatgcatgagctcatggcctttttacaaataagataacaagtcatggagtagattgtttgaatcgcctttataacagtcattttgcagatagctttcctttttctggaccaaagtactttgttaattttagaaggaaagtaacttgcatctgataataagaaattgaagtttctcttattaggactgatgtaattttggaattaattttctttataaaacaagacttagacttcaagcaaagagtctttgcttggccagagtttaggtgggcttctcaaccttttcctaggcccatttgtgcacttccttgtaaaatccagctttagcaagagaaccctgctaagtcagtttagccagaaactcctatcctcgatatcttatcatccttgacatctgatcaggctcctcatcttctaccacccccaggtgatgtccaatcaccctggcctgtcttcagcaaaaatcctgttaagatggtttagccagaatcctccctacctctgatgtttccctcttagtaattttccaccacttggctataaattcccacttgattatgttgtattcagaggggagcccaatctctctcccttactgcaagacctcattgcaatggttctgtacctattaacaatggtcctgaataaagtcttccttaccgtgctttaacaagtatcattgaataattttttctttaacaagatgtagaaaaggtgctgtggacacagagggagaaacatctaaatcagtctgggagatagtgggagtcactaaataccatgttgtagcctcttaatttttcctgcaggtgagaatagagagcggttgctttatacaaggaaatagttaacaaaagcttccatagcttctttttaaaactctaggaagtcatgtggtttcaagatctccaagttgagaaattactgatttggcctctcctagaagcacattttatgaaaagcttaaaactactcctgttttcagaatagaattatgatagcttgcagtattgaaacccccagaagaggagtggtgaaatggaaatttggagttttgtttttagttttcgtttcttttttttagctttttagcactggggtctcactatgttgtccaggctggagtgcagtggctattaacaggcacaaaatcctggattcacgcaatcctcctacctcagtcaccagagtggctgggactaaggcatgccaccaccttgctatttggtttttttaaaaggaattagaaaccatttaggaagacaatgagccagtgcttgaagcttaatttgaggtaacttgagtacactcatcaaataccctatggcatttatatttatgcaagaataagtatgaaaatggagtaagaaagggccttgtattcactttacagttttctcgaataatttgaataatctgaatattttcctatttgaaacgtgaaagaactacattcagtactgaatagttagttacattggcattatctgtaaataatctttgatttggttgagagttattggataaacattttataattgttgatagtcactcagtattacttataagttcattatatatttacaacttgaagtacatgttcccagctacattaatatgatgttgagacttgatctacccagctacatcatttaagttttttctaaacattcactacctataggttttcaagggagccaaaatcactaggactataatttagaggattgagagtcctaaatttgcattactttcttatttctaaatattaacttccatcctcacctgcctgtctggtattttgtattgttctaagccattttttccctatcactcaagaatgccctcttttctgattatgaaaaaaaaaattataagggtatttttatttcttttcccttcaccatggcttctagggtaaagctatttcatcagctttttaatgattatgtgctgactacatactgaaatagtctgtatttttactccactagtgacttaaaagtacaaataattgtttcctggcctcatatcttttaaaattttattttctcaatttgttctcatagtccaatggtggtcatcccctgggtatagatttgatgtcaccgtcttttatggtaactgctgtgatcttctcgtatatgccattcacatgtgctttgaatatgctcttatataaatcatgacatatactggttgattaaaaaaaaaattaatcaagaattaaaataagtataaagcaatttcatatatgggggtgaatcttttcatttattttccaataacatagggaagggagttcaactccaacctctttgcgatttcagaaaacaaaattcaatttgctaagtattggttaagtataaattcttggtcccaccctaagtacacagagtcagaaagactgcggatgaggcccagtaatctgttttatttagatgattctgatgcatttttaagtttgaaagccactgggttagcttttcttctgattatgaattcatttagtaaatattaattgagtgccagttttgtgccaggcactgtgaacaaaatggatgtggtctttgccctcgtgaagcttacaatttaggaggactgacctctaattaaatttatttggtttaaatcaaagactcataatggcctatgatttcagatttctcaagctgaagagatttaggctagacaattaccaaacaaaaaatggaaaattattcgaaacaatattagtatttaggttaacctaaatcaaataccctgtaatgaactaataagacttggccaactctatcatatccacactaacataggacaggggtatagaagaaaatttaaaaactcaaaatgattgatatttggctttggaaaacagtctgaattgtactttatcagatctataccctttctggtttgacctcacaatcaacagcctaggatcttggtggtataaacaagacaatgaagataattaaatggcagttcatctactcaatagatcagtgcgatagtcacttgccagtagaaatgtttgggggctcttttcttttttacattgcattggttggtgatttaggcatttggcccaaattaaaacgtgagaagttattttctcagaaaatatttctattatcttctatcttatatttatttctgaatttaaactgttaaccactttgcccaatgtattttatcctttacttagtataagtttttcaaagttcattatgttttagcatgtatcaaaagtttatttttttcattgctgaataatatcctactaaattaatgtaccacattttatttatccattcatcagttgatggacacctggattgtttccactttttggctgctatgaataattctacaatgaaccttcatgcacaagtttttgtatggacatatgttttcacttctcttggatatatatctaggagtggaagtcctgggtcatatggtaactatgtgtcgcattctgaagaactgccagacatgtccaaaagggctgcaccattttacattcccaccagcagagtatgagagttccaatttctttacatcttcaccaacccttacaattgtcttttttattatagccatcctgatgggtgtgaactggtatctcgtagtggttttgatttgcattgccctaatagctaatgatactgagtgtcttttcatgtgcccaatggccatttgtttatcttctttagagaaatgtcaattcacatttgtacctattttaattttttttgtctttttattgttgagttgcaaggattctttatatattctggatacaagtcccttttaagatataaaatttgcaaatatttctcccatcctgtgggttgtcttttcactcaataccattaagtattcttcaaacaacaaaaatttttgatttccacaaagtccaatttgtctattttttcttttgttaatcatgatgtttttggtgtcatatctaagaaggctttgcctaacccaaggtcacaaagatttattcctatttgtgttctaagggttttatagagttagctgttttatttaggtctatgattatgtatggagggatccccaagatcaccctcagatttaatgattcactaggaagactcatagatctcagcatatagtcatactcactgctacggtttattacacctaaagggtacaagatgcattgggcacagtgtaactacagtcaacaataatttattgtacattttaaaataataaaaagtataattggattgtttgtaacacaaaggaaggataattgcttgagataatggataccccatttaccctgatgtggttattatgcattgtatgcctgtaacaaaatgtctcatatacctcataaatatataaacctactatgtacctacaaaagttaaaaaaaatttaaaagagtcattggtcaaagtctagggaaaacagacacaagcttccagagtactctgtcagtagagtcaccctgcaatgagttgtgacaagatgtcattgccaaccaaggaacctaataaagactcagcacccattgttcttgttgagggctggtcacgtaaacagcctctgtctggcgtgtatcaaaactctggactcccagaaagaaagcaaacgttcaacataaaccatagcgtttgtacagtttaggcatggtaagccactgttattagttctgggaatggtgagaactctcccagaatccaagtttctaagtttctaaatgccagccaagggccaaccttgtaagcaagcctttccaagaatagcagttctggcctactgtcttaactcttttctgcacaatgggcttaatttttgtgtgtggtataaggtagagttcaacttcattcttttgcatgtggatgtcactgttccagcaccatttgttgaaaaggctatttttccctcatttaattatcttggcgtccttgttgaaaattaattgaccaaaatataatggtttatttttgaactccctgttctattccatcgatctatatgtccatcctataccaatatgacacagttttgatagttttgtagttttgatagctttagagtaaattttgaaatcaggaagtgtgagctctccaacttcagtcttctttttaaatatgaatgttaggatcagcttgtcagtttctgcaaagatcccagctggtatgttgatagagattgtgttcagtctgtacatcagtttttgaaatattgccatcttaatgatgttaagtcttctgacccatgaatatggaactatatttcaatttatttaggtctttaatttttttcaacatgttttatagttttcagagtatttgttttggacttcttttgttaaatttattcctacatattttgttattcttaacgttattttttaatggaattgttttcttaattttattttaatattgttcattgctgctgtttacaaatacaactaatttttttattatagtaagacatttaacatgagatctatcctttaaaaaatttttaagtgtacaatatagtatcattaactataggcttgatgttgtacagtagatctctagaacgttttcatcttacataactgaaactttatacccattgaatagcaagttcccattttcccctctacccagcccctgacaactaccgttctactctctgcttctatgagtttggctgtttcagatacattacataactggaatcatacagaatttgttcttctgtgactggcttatttctcatagcatagtatcctgcaggttcatcgacactgtcatattttgcaaaatttccttcgtttttaaagtctgaataatattccattttatgtattaccagattttcttttgccattcagttgttaatatatatttaggttgttttcatatcttgactattgtgaataatgctgcatttgaacatgggcatgcaaatatctcttcaagattctgacttcaattcttttggataaatatccagaagtgggattgctgaatcatatggtagttctatttttaatttttgaggaacctccataatgtgttccatagcggctgcagcattttacattcccagcaacagtgtacaagggtcctaatgtcttcacattctcaccaatacctgttatctttgggtgtttttttaaccacggtcatcctaacaggtgtgaggtgatagctcattgtggtttgatccgcatttccatgatgattagtgatgttgagcatctttacatgtgtgtggtggctatttgtatatcatctttggtgaaatgtctactcaagtaaaatttaattgatttttgttattgatcttatatcatgaaacttcactgaactcatttattagttgtagttgcttgttagtgaattccttagaatttctatatacaagatcatgtcatctgcaaatagtttttacctcttcttttccaatctggatgccttttatttcttttcttacttaatctccctggttcaggccccccataaaatgttgaatacaagtgataagagtggacattcttgtcttgttctgatcttcggggggaagccttcagtcttcaaccactcattatgatgttagctgtgggttgttgtaggaaaaaaatctaaacttttattagattgaggaggttcccttctgttcctagtttgttgagtgtttttatcatgaaggtgtgtcgaattttgttatgtgtttttttctgtatctattaagatgatgcgttttttatcttttattctgttgatgtagtgtattacattaattgatgttcagatgttaaaacagccttgaatttctggaatcagtcccacttcatgttgtataatccttttagtatatcactgaatttggttttctagtatttcctggaggattttcgcatctatattcataaaggatattggactgtagttttctggtgacatctttgtctgattttggtatctgggtaatattggcctcatagaatgacttgggaagtgttcccttctcttttctggaagagattgtgaagagctagtaataattcctctttaaatgttttgtagaattaaccagttaatccatctgtgcatgggctttactactatgtgggaacgtttgtttatttgtttgtttgttcgtttgagacagagtctaacgatatcacccaaggtggtctcaaactccggggctcatgcaatccttccgcctcagcctcccgagtagctgggaatacaggcacaagccatatgcccatgcaccacgagccaagaacccatactttgaaggaagttttgtacttactaatttgatatatttgtttgtaatagttctattaagatgttatctttctttatgagttggtttgggtagtttgtgtctttctaggaatttgtctgtttcattgagattatgtaatttgtccgcatatggctgcggatggtatgcccttataatcctttttctttctgaaggtcagaattgaggtctttatttcccctttttttcttggtctttctatctaatgatttgtctattttgttgatattttcataggaaaaaattggggattcatatgctttccctattgtgtttctagtctctatttcatttctttccactctaatccttattatttccttccttctgcttgctttcaatttagcttgctcttctttctttattgtcttcaaatggaaagtttgtttattgatttgagacatttatcctttctttaatataggcatttataacataaattgttcgttaagtgctgttttagctgcatcccataagttttgctatgttgtgctttcgttttcattcatttcattattttctaattttgctagtgatttttttccttaatgcatttattatttagaagtgtgttaatttccacatttgtaaatttccttaatttatttcgattactgacttctgttgtggttagagaacatacttcgtatgatttcaattttaaatttattatggctcatcttatggcccatgagggcaacaaactaaaccatggacgagctagaagtttaacagagataatcaggtcaagagacagctaagaatgtcccaaatcatcagtatttttatgacttttctcatgtatcaccagattgctttcaaaaaggattgtaccagcgtacagcactgctagctacatataagtctactagcttcactataacctctttgtcttggctgcttcacttaatatttggtttataattctgcagagtaggtttattgttcactataaagttcaaagacttgggccgggtgtggtggctcacgcctgtaatcccagcactttgggaggcccaggcgggtggatcatgaggtcaggagatcaagaccatcctggctaacatggtgaaaccccgtctctactaaaaatacaaaaagttagccgagcatggtggcaggcgcctgtagtcctagctactcgggaggctgaggcaggagaatggcatgaacccgggaggcagagcttgcagtgagccgagattgcgccacgccactgcactccagcctgggcgacagagcgagactccatctcaaaaaaaaaaaaagttcaaagacttcatcatagaaacagagataacttttgatttatgttctttcctctcctcttccaagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaaggtgagcataatacattgttgatgtctcatttttgccccttgaaattctcagtctccttggcagagatatgacatgactaatataatcactgcaattatgtaaaagtcataactcagatagacaaaaccaagaagaaaacataaaaatgaaacagttgatttgttattgtggcattattaataatttagtctctttctattattgttgccatagtcttgtttctaaattagacttttaaaatcatcacctctctgcttctggccatagttggacattgtgatacatttgctgctaatcaaacgaatttgttactaaagagctaactttctttgtagctgtggagggttgtaaatgttatttgtagcaacgtgctatcagtagagtaaaacaaatgtatcagtagagtaaaaccaagtatcagtagagtaaaacaaatgcagtacttggggagtttgtgttaggagttattacctatattttttcttggatgaaaactactaaataaatgcaaagtcataatgatggtaatagttcggagactctttgatgtgaccaatatttatttttcttttgaaggcctatttggccaaagaaatttaagggcatgccacactattatggtggtgacagttttagagggccaagaacactattatgctcagcataggtctcattcatagtctcttaggtgccactttctgcatcactggctttaataaggacctgaagatcacttcatccaggacttaaaacccttcagttatgttttttcccctttgggcatggatattcttccaaggacagaatcaggtgatcttttggaaaggtaaaagttggttcctcagactatgggctctggcaatcttcctttaaagagtactgataacttgctttttttgcagctaacttctatagcacaatggtgacaaatattattttatctcttcagttatgcatggattatggcaatgttctatgtgctcatacagcaaagaacaaaacagataataatcttcattctccttgaacttatattctactagggaggaacaaattataaataataaacagtaaataagcaaagtatctagaatgttaaaagatgataagtactgtgtaaaaacaagaacagggtatgagtatttatgaagggatgggatgcttagctagcaaatgtagtaacagtacatgtccgataaatgcatgtcttgatttcattttcaaattaagactttatgttcaaagaaaagcacttaaaatttaaatgaaaatatattgttttaaatcattcataaaccaatatctctcatatacaacatgcagtgtacagtaattaaaattggcatttctgaaagctttgttataaagatatttagagttatacccagtaacagatagctttgttgaatactgtaatatggaacaatagccagttctataaatgactttaaaattctaaaactattggtgtgctaggaatgacaaatttgatttgtgtgaatactctttaaattctgtaaaggtttttttttctttttttttaattatactttaagttctagggtacatgagcacaatgtgcaagctcgttacataggtatacatgtgccatgctggcccactgcacccatcaacccgtcatttacattaggtatttctcccaatgctatccctcccctcgccccccaccccatgacagacctggtgtgtgatgttccccaccctgtgaccaagtgttctcattgttcagttcccacctatgactgagaacatgtggtgtttggttttctgtccttgtgatagtttgctcagaatgatggtctccagcttcgtctatgtccctgcaaaggacatgaactcatgcttttttatggctgcatagtattccatggtatatatgtgccacattttcttaatccagtctatcattgatgggcatttgcattggtcccaagtctttgctattgtgaatagtgccgcaataaacatacatgtgcatgtatctttatagtagcatgatttataatactttgggtatatacctagtaatgggattgctgggtcgaatggtatttctagttctagatccttgaggaatcaccacactgtcttccacaatggttgaactagtttacactcccaccaacagtgtaaaagcgttcctatttatccacatcctctccagcatttgttgtttcctgactttttaatgatcaccattctaactggtgtgagatggtatctcattgtggttttgatttgcatttctctgatgaccagttatgatgagcattttttcacatgtctgttgcctgcataaatgtcttcttttgagaagtgtctgttcatatcctttgcccactttttgatggggttgtttcattttttcttgtaaatttgtttaaattatttgtagattctggatattagccctttgtcagatgggtagattgcaaaaattttctcccattctgtaggttgcctgtgcactctgatggtagtttcctctgctatgcataagctctttagtttaattagatcccatttgtctatttaggcttttgttgcaattgcttttggtgttttagtgatgaagtccttgcacatgcctattgcctaggttttcttctagggcttttatggttttaggtctaacatttaagtctttaatccatcttgaattaatttttgtatgaggtgtaaagaagggatccagtttcagctttctacatatggctagccagttttcccagcaccatttattaaatagggaatcctttccccatttcttgtttttgtcaggtttgtcaaagatgagatggttgtaggtgtgtagtgttatttctgaggcctctcttctgtcccattggtctatatctctgttttggtaccagtaccatgctgttttggttactgtagccttgtagtatagtttgatgtcaggtagcgtgatgcctccagctttcttctttttcttaggattgacttggcaatgcgggctcttttttggttccatatgaactttaaagtagtttttttccaattctgtgaagaaagtcattggtagcttgatggggatggcattgaatctataaattatcttgagcagtatggccattttcatgatattggttcttcctatccatgagcatggaatgttcttccatttgtttgtgtcctctcttatttccttgagcagtggtttgtagttctccttgaagaggtccttcacatcccttgtacgttggattcttaggtattttattctctttgaagcaattgtgaatgggagttcactcatgatttggatctctgtttattattagtatataggaatgcttgtgaattttgcacattgattttgtatcctgagactttgctgaagttgcttattagcttaaggagattttgggctgagacgatggggttttctaaatatacaatcatgtcatgtgcaaacagggacaatttgacttcctcttttcctaattgaataccctttatttcttcctcttgtctgattgccctgtccagaacttccaacactatgttgaataggaatagtgagagagggcatccctgtcttgtgccagttttcaaaggcaatgcttccaatttttgcccattcagtatgatgttggctgtgggtttgtcttaaatagctcttattattttgagatatgttccatcaatacctaatttattgagagtttttagcatgaagggcttttgaattttgttgaaggccttttctgcatctattgagttaatcatgtggtttttgtcgatggttctgtttatgtgatggattacttttattgatttgcatatgttgaagcagccttgcatcccagggatgaagccgactcgatcatggttgataagctttttgatgtgctactggattcggtttgccagtattttactgaggattttcccattgatgttcatcagggatattggtctaacattctctttttttgttgtgtctctgccaggctttggtatcaggctgatgctggcctcataaactgaattagagaggattccgtctttctattgattggaatagtttcagaaggaatggtaccagctcctctctgtacctctggtagaattcggctgtgaatccctctggtcctggacttttttttggttggtaggctattaattattgcctcaatttcagaacctgttattggtctattcagagattcagtttcttcctggtttagtcttgagagggtgtgtgtgtccaggaatttatccatttcttctagattttctagtttatttgcatagaggtgtttatagtattctctgatggtattttgtatttctgtgggattggtggtgatatcccctttatcattttttattgtgtctatttgattcttctctcttttcttctttgttagtgtagctagcagtctatcaatttttttgatcttttcaaaaaaccagctcctggattcattgatcttttgaagggttttttgtgtctctgtctccttcaattctgctctgatcttagttatttcttaccttctgctagcttttgcatttgtttgctcttgtttctctagttcttttaattgtgatattagggtgtcaattttagatctttcctgctttctcttgtgggcatttagtgctataaatttccctctacacactgctttcaatgtccgagagattctggtatgttgtgtctttgttctcattggtttcaaagaacaccttcatttctgccgtcatttcgttatgtacccagtattcattcaggagcaggttgttcagtttccatgtagttgtgcagtattgagttagtttattaatcctgagttctaatttgattgcactgtggtctgagagacagtttgttgtgatttctgttttacatttgctgagaagtgctttacttccaactatatggtcaattttagaataagtgccatgtggtgctgacaagaatgtatattccgttggtttggggtggagagttctgtagatgtctattaggtgtgcttggtgcagagctgagttcaagtcctggatatccttgttaaccttctgtctcattgatctgtctaatattgacatggggtgttaaagtctgccattattattgtgtgggagtctgagtctctttctaggtctctaaggacttgctttatgaatctgagtgctcctgtattgggtgcatatatattaggatagttagctcttcttgttgaattgatccctttaccattatggaatggccttctttgtcttttttgatctttgttgctttaaagtctgttttatcagagactaggattgcaaaaccctgcttttttttgctttccatttgcttgggagatcttcttctatccctttattttgagcctatgtgtgtctctgcacaagagatgggtctcctgaatacagcacactgatgggtcttgactctttatccattttgccagtctgtgtcttttaattgcagcatttagcccattcacattaaggttaatattgttatgtgtaaatttgatcctgtcattacgatgttagctagtgattttgctcgttagttgatgcagtttcttcttagcattgatagtctttacaatttggcatgtttttgcagtggctggtaccggttgttcctttccatgtttattgcttccttcaggagctcttgtaaggcaggcctggtggtgacagaatctctcagcatttgcttgtctctaaaggattttatttctccttcacttatgaagcttagtttggctggatatgaaattctgcgttgaaatttcttttctttaagaatgttgaatatcggcccccactctcttctggcttgtagagtttctgccgagagatcagctcttagtttgatgggcttccctttgtgggtaacccatcctttctctctggctgcccttaatatttttttccttcatttcaacctgggtgaatctgacaattatgtgtcttggtgttgctctttttgagaagtatctttgtgttgttctctttatttcctgaatttgaatgttggcctgccttgctagtttggggaagttctcctggatagtatcctgcagagtgttttccaccttggttccattctccccgtcactttcaggtacaccaatcagacgtacgtttggtcttttcacatagtcccatatttcttggaggctttgttcgtttctttttacccttttttgtctacacttctcttctcgctttatttcattaattcagtcttcagtcactgatatcctttcttccgcttgattgagttggttactgaagcttgtgcgtgcgtcacgtagttcttgtgccgtggtttgcagctccatcaggtcacttaaggtcttctctccactgtttattctagttagccattcatctaatcttttttcaaggtttttaccttccttgtgatgggttcaaacatcctcctttagctcagagaagtttgttgttaccaaccttctgaagcctacttctgtcagcttgtcaaagtcattctccatccagctttgttccgttgttggtgaggagctgtgatcctttggaggagaagaggcgctctgggttttagaattttcagcttttctgctctggtttctccccatctttatggttttatctacctttggtctttgatgttggtgacctacagatggggttttggtgtggatgtcctttctgttgatgttgatgctattcctttctgtttgttagttttccttcttgcagtcaggtctctcagctgcaggtctgttggagtttgctggaggtcccctccagaccctctttgcctggttatcaccagcagaggctgcagaacagcaaatacttctgcctgatccttcctctggaagcttcgtctcagggggcccctgcctgtatgtggtgtcattcagcccctagtaggaggtgtctcccagttaagctacacgagggtcagggacccactagaggaggcagtctgtcctttctcagagctcaaacactgtgctgggagaaccactgctctcttgagagctgtcagacagggacgttcaagtctgcataagtttctgctgccttttgttcagctatgccctcccgctagaggtggaatgtacagaggcaacaggccttgctgagctgaggtgggctctacccagttcaagcttcccaggcagctttgtttacctactcacgcctcagcaatggcggacacccctccaccagccaggctgctgccttgcagttcgatctcagactgctgtgctagcagtgggcaaggctctgtgggcatgggacctggtgagccaggcatgggatataatctcctggtgtgctatttgctaagaccactggaaaagtgcagtatttgggcgggagtgtctctattttccaagtacagtctgtcacggcttcccttggctaggaaagggaaatcccccaaccccttgcgcttcccgggtgaggtgatgccccaccctgttttggcttgccctccgtgggctgcacccactgtccaaccagtcctaatgagatgaaccaggtacctcagttggaaatgcaaaaatcacctgtcttctgcattgatcacactgggagctgcagactggagctgttcctatttggccatcttgaaatggagacccaaggttttttataaacatcttttttattaatcaatcataacatggcaaaattgcacacttgccatttctgaaaagtgatccaaactctacatccacagatgaaaaattcttatagaattttgtgaaaagcatacattttgagttaaaaaaattttatagctgttggagtgccatgaaattaatacttgcattttggactgctgtagtttatactttttatatgtttcaaatcaggtgtgcaccatttgtacttagaacaccacaaaatgaagtatctaaaatcccttgattttaatatgtgttttggtttattaacaaatgatagtaatttcttacacatttttggaaattacttgtataagaatatatgcatctgcttatggatacagtgtgtaaataaaacttgtgctcaccaaactatcgcaaggacagaaaaccaaacaccgcgtgttctcactcataggtgggaattgaacaatgggaacacttggacacaggatggggaacatcacacactggggcctgtcatggggtggggggaggggggagggagagcattaggagatatacctaatgtaaatgacgagttaacgggtacagcacacccacatggcacatgtatacatatgtaacaaacctgcacgttgtgcacatgtaccctagaacttaaagtataataataaaaaaaaaacaagtgttaaaaaaaaaaggaaaacttttgctcactaaaatataagtaaataaataaatgcatgtcttgagttttttcctatggcctaaaattttttctaaggcctgtttgtgatggccgtgcgacctagtatgatatctttccagatagtctctgaatatttgggactagtctatcccaaaagatagagctttcctactcattccatttccctaagtagaggatgaaccttaggtctcctatagtccaatcctgcatcttggcacttaggcatcacaactccatggcaagggcacttggactgcagagccccttgctagtctgtgattactcagcatataccacatgaggcacacttagaaatacagcgtctcctcatagcctccccgttgtttgtctatccttggtgatatggtttttggtgatatggttttttttctgttttgcagtgtcacggactttctgttgaagggtttgtccttccttcctctaccactagagaggtaagagtctctttcttgcacatttatgtgactgataactttgctggctaaagtatcccagtgatcacttacttttcaaagtgacagatccatgcttttataaatcaactgaacatgaaatgcatttgaagaaaagacaatttttttaatggaaagagaatattatagaataagtatggattactttatatgaagacaaattcttttaatggttgattaagttaggccggcttatgtgagcgttgtgagggttagacaaggcagagggatcaaaatctatgaatgcatgacttctcatgtctcccgtccttcacattcctacctttctctagtaggatgtttgtagaccattagaacataaaccagtggttgttagctacaactatatgttggggtaacccgggttccaatttccaatttagtggattagaatctccagggatgggacgtgagcatctgtattttttttaatctatagaatgattctaatatataaccgtggttggaaaatattaccatgaaccacagacatagattatcagatgcttttatattttcctttttgtccaaactacacagaaattataaaaactagcttttacacagagtcaacaaaggagctagtgttagcatgattgaagtagtaagattcaatagtagaaagttctcaaaaatgctggggttgtttcagatagcatcttgggggacaggtacagaaagctaatgttatgcttcagggcttcactattgcctacaggccttttctctaatcaagaatgccatgtcccccatttgtcttttctctacctttacgcaagagtgaaatgttcatataattaataatacatacctgaatagtacctttaagagtcttcaaacattatttttacatttttaaatttggccttaaacaccattatgtaaaataggtaaagaaggaattatcattcctaatttatggataaggaaacaaatttagagattaattgtctaaggttgtataactagtaagtaacaaagataagacttgaacccaagtctttatactccaaatctacattgcctccctagaggatatactcaatacaagtttaccaaagtatacttctcaatccccttcaccccaaaataactttacatttcttaatgccctttttaatctaatagtatatggatgttttacataattctaatttttatgtattatacatacaattttaagttttacctcagtttttcctttatttacagtgatcagattttaataaacagtcatgtaaaaactcatgaagttgctatgccatgatatgccgttcccatgtttaggttacctctagttttacacttgtgactaaagctactataagtactcttctatatggagctttcttcctcttttgaattactatcttaggatgaactctcagaaataggattatgggttagagggcatggacactcttatagctcttgttatgcgttgccagattgccctccaaaaagattgaagcagtttactcactcagttattttgaagggggctgaatcaatgctcatggctacagtgtttttactgcctttcagagcaggtgattgatgtttcttggatgatggactcttaggaagtgattttctttttctctatcacagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacaggtaggcaaacctgttgttttctcaatagagaaatgtttttactccaacctgatgacattcagaggtctttgaggagccacggtcactttcttgtgccctcttcctcatacttcttttttgggccccctttgtagcggctctgagctctgtttgcaaaagaagtaggccgcaggaagacctctgtctttcaccatgtgtttttggtttgtgttagagggtaaagttgcctggaactcaggaggctttatgcttttccctgaaaggccctgaagcataccattagcatcatatttcaaatttctgatcacagtgctttttgtagctttaaggacttaataagaaactattggatggcatatcctttctgaactattgaggaaaagagatttggttttagttttactttgcttttgctattcacctataggaaaataagaaagtgaaacttttactcctacatttttcttattttcttaataaatcttcttccaggaaattatccacattcaaaaatacaaactattgaaagtgtcccaaatgttgcccgtattaacagtaggagcacataagtgaaggacaggcactgttggcagtaaaaaaattttcaaaacatataatagctgttttcattctgttagccactgggaggagatgcaaaagaaaaatatccagggctttctaagaagattctaattttaaaaattatggattgctgtcagtccatgtatctaaaaatgtgttcccttttaggcatagacctctagcctcagaaaacttagtctatttgaattaagtcgccttagaaagaaatcatgatcaaatgcaggataaaagaatacaagctgaaattagtagtactagaaggagtcagaccaaagctctactacggtgatttgtgttaacatttgtctattaataggtatgactcaatagatgaatgattatatttaacttttagaaattgatcataatggggaaaattctaaacaattaataatttttaaataatttacatgatttggggacctagtgaaaaatgcctgcatacaaactcatattcacccttttgtccataaacctatttcttcctggataaacagtctagggcccaactaattggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaa

SEQ ID NO: 4733 - DNA, 71803 bp, human
ctcctcctgctcctcctcctcctcctcctcctcctcctccttctcctcctcctcccggtctgagggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcaggtgagaacgtccgcggtagaggtgacacccagggcctgcgggtctcagaggcccggtggcctgctcctctcctccttgcccaagaaacccccacgggggcgcctgcagcggggacaccaagtgctccccggagccctgggagcacttcttctgaggcatggagcccctgctcaggtgcttctgaaagttcctttgtggaccccagaaacccctaggcaactgtctgccccgccccgcgcccccgccgccccccgcccccgcagtacccctccggcccccgacatccctgatgcgcatgcccaggggccctgtgagctagaaagtagctgagctggtgcagtacctgctggttaagaaccggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgcatactgcaaagttttgtttgccttaattaactttcttttataatgatgatcattttacaggaaataaactggttaaaactacatgatgacagaattatatcagagttgaaacaaacgccatacctaagcatttttttcaaaatcctttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattagacaccttgctcatcgactcatttattcaacatacatttactgactacctactatatgtgaggcactgtgccgggcgctggagatagaggaatgcaccagactcagcctctgccccacatctgagagtctagatggggctgtcatgtaagtaaatcagccagatgtggcagtttgatgtattaattgccgggatgaggataaggaccaggtggtatgggagcccggaggagagacacttaaccctgggtggtggatgtctgggaacaaggaaggcttccttgtagtgagatgccatctgagatctgaagcactgaaggagtagtaagtgcagtgtgtccccgaggcagggtattgtgggcatcgggagcattccatgttcttcagtggaactggaaggttagaatttggggagactggggagagatgatctgggggtggggacctgtacaggagccaggatcctcagttggtggacttcacagctgagagattaaaaaataatagtaataaagtaaacgtgtagtggaaagtgactctttggaaagcagctgctcttggctcttggatgagccagagaaaagactccacctgtggcatgcctagaagctgtcctggcctcctgtccctgtgcagtttctacagtgcacacagcaggtgctttacattcagcatccgtaaggagtgatgggcaagggggtaagtgttgcactcaccggagctgattcccagaagctactgagcagatgttcgcccctgaagcctgggagagacagagctcagtgggttatatgactacggttagttgttgttgttgttttaagaaacaaaggcctagatgttagaatggataagttatcctgtttatacagagggaaaactgtttgtaggggtgagagataagtctagactagcctggagcgaagccaggaagagccttgatggctcaaacctgatttggctggcccaggaagctatggaggtttcctgagcagggaaggatctgatgaaggccaaaccctaccaaaattacagtggccagcaccagcgtggttttcaaaggaccagtattctccatgccttagaatggtcctggtgggtatagtgatcataataactagcctaaaattatcttcagttcttagagattgacatgcatgttttacatccctgcccgttggccttgcaaagcctttttgtgcccttcgtcacaaacactgtgggatcctggcaccagttctctcagggcctaccctaggatatgtaggatccagagaatattacactgtaacccctcacttgcattcctctgctggcgtcagggaaaggctggaggtggtggtggtggtggggtggtgcagtgggggtgggggtatcataatgtgaaaacatgcaatctgaggtgaatggggaaagggttttggaagggctctgtcttagtttggggtggggatagttggagctgattatgtgtacctcaatctgaggcctttcctcaaaatcccgagccgcctgctctccatttgaagccaataaacattgtcagttatgaagggtatatgcatttgggcagggagagatgatattttttctgcattgttacactgaattgccctcctcaaggccatagcaagatacctgtggaaaaagcattgtctataggtcacagtcctaacaggtacttaggaagaagcaatgctgtcccatgactataaccacatacatgagtccagatacgtatgtatgtcttaagctcctctccatctccaacagccaaccctatcccgattaaatatctttctcaagaggtgtaaaaagatattgacccataaaaccaccaaacacttccagatttatttcagtcttaatgagagagaagcaagagaatgtgccagcagggaggatgggtcagcctcctgtgggagtgggtcctcgagagtgttgctgtcccctgggcatgctgagacactagagctgcccagcctgcaaagctgaggaccccactctgggagcacccgtgggactcagctcctcattcagaaagtgaacagatcaatgtaatttgacgtgggcctctgtgaggtcctcccacccattactgtgtgtctgaaaggcccgccgtctctccattgaccttggtgattgcttgtgttgcaatttctaacaggttaaaggaacaagtatgctccaaccccctttgtagaattctcctgctgatactgtgttgcagcacatatcaaggtcacctcaggaaggcaaaagaaagaaaaaatgaagccctcctcttatgaaaacgagcaacgcgtaggtggagacgaggtcgtctgttggaagggctctctctcttgcggtggggtaggggggcctgggggctctttgtcagtttaggggttaatgccttttctgagatccacagattcttcctccacatgaccctcccgcctctgcatataaacactgcccagttttcctccgatatgaagaccgtgcgcattgctgggggaagagagatgttattccgtcgtcattcctgcatgtaagtgcctcaccagggtccgagctgccagctgtggaaaactcaccattgattggccacagcccatcgccaccaggacccaggaacaagcagcgctgcctcgaggaggagggcggacagcctaacagggctcaggaagatgctagctctctccctccacaaccccaccaccaccaaagctgaccacccccacttcacccgacgtgttgaaagttacatcaaatgccacaaagcaaaaacagtcaagcgtgccagcatttatttcaggcctggtgactgggacactgcggcgagcaggggcatggagcagcagaaggggcttggtcaccgttcatggctctgtgtctgtggctccggtggtctcagattccgagtgcccggtatcctcccctagggaggaaagcagagtgacaagtggaccctcgggagccctggggatttctggcttggcctgaggttctcttggtggaacaggaaggggaggcggatgggcttggtggcgagcagtgagagaggcagaggcgtgctccgaaggagctctcacctgaaacacttggtgaaacatgccagggctctctggaaccggctcctccaagaccctcgcagaagagcaggttccctgggcaagcctgtgccaccggatgggtcctccgtggcgtcagacacagccacccattcctcagggtcgttttgcagccctttcacattctgaaagacagactaaatagccagatcctaatgctccctcccatccctggcttccttcaccccacccagcaactgttgtgtgtgtctctggccctcttgcaggggctggggatgcagcagtgacctgcacagaccaaagcccaacctcctaggggacattccaggacaatggagggaagccagactcaccaggtcagcaggtggaaggaagggagtgaagatcatgcttccaggagtgtgtgatgtgccggtagggaccgacaggacttcgttgaagacaccggcgaagctcgtcactctgccgggtgcaaagaggccgagggcctgccccctccacgccccattcagcccctctgcccctgccccatcgtccctccctcctacagccttgtgctccagcaggggatacatttctggtatgtcacattccgtctgttcctgtgtttcttactcccactcctccaatctttctttcctttgtttcttcctcctggccctcccagcaggctcgagtcacgcttctgcttgctgagcagaacagccccgagggtcctcctcgagagaacatgatgtgtagaggtcttctacaggtagctcattttatttggccatgaatggttcattgcatgccaaggtcacacatggtcctagtttgccatgagtgggaccattccggttttaaaacttaaaggcccctgtcccgggaaagctctcagtcccagggaaactggaactacttcattcatgtggacactattgtcacattactgtgcactgtttttctcacatttaacagttggaccttgtagatgaaattgtaagagtgatcctgatacctaagaagtagacatttatgagtaatcgatgtgtattgaaggctctgtatatcttcatagtgtggaggtaaatgcagcattatgtgtttgcccctgaatacatatccactaaaagcctatgattggacctcagccatcacatctgctcttggggtgtcacaccagagttctagatggacccagaattgcagagagacaaggtcaggggaaggagccgggaaagaggttaacaagaccacagatgctgcagatgggactcacacgaagatgtccttcccaccagccaggccatcgctggctttgtaaggtaatgagattagcaacattagaggtgctgaaacacagcctgagcggtcacttgtaccgtatgctgcagagaggagggttcaaatggtttcagacagccctgtgattcataggattcgtgtgcaaatcagaggtaaagagcccttagctttcatgtaaatacgtaattccctctgacgtgtacaaaaattctcctcaaaatcttgtgaatttccaggcaagtgttgtgaaatacttagaaactcctccaagaagtgagcaggtctcattgtctgtcctatctcccttttctctccttgaatctactccagttaggctttctcctacaccactccactgaaacttaggagttaattgaacatgaaccaatgaacaagtgaaagtaatgtttcttatagttgtatatgactagctatgtgattaaaatgaccaaaccggcaagttgtatttaaatgcttaataaaagctaggtttaaattgttaacttaaaaaatgaatagaaatgaagacccaagtaactacactgtcatctcccagcacaactttcattctcatataaagaaactcattttctaagtaggaaggttgttccaaactgctggaaattcccaggaagaaaggcccaggttttatggagcttccacctgtttccttgtagacgcagccaactgccaccaggtggcagaacaagatgagaaaaccgtgccccacggagtccctgagcccctgctgctgcagtttttgagtgagttttctcaggggctggaatcactcctggggaaccatcccaaggttctgccctcttaagctattccagggtgcacccagggcctggtccagggtttctgacgtctatgatgacgcttaaggcagtgacatcgatcagccgggcctctgggctaggagacccagttcacctcctcattagtaaccctgggatgtggtagtaggtggctttaggcaggatgaggggccagttgtatctgtcagtatgtcagggtagtgacatctgtgattctgcagggacatttgaacagcagggaatcagaaacgccagaaagtgagggtccgcaacacaaaaccttgccaactgctgtggactgaattgcgttcccccgccctgcaattaatatattgaagccccgacccctaatgggactgtatctggagctagaggctttaggaggcaattaaggttaaatgaggtcataagggtggagccctgctcctacaggattagtgtccttatgagaagagacgccacagagctcattgtatctgtcagtatctcgaggtagtgacaactgtgcttctgcagggacatttgggtagcagggaggtctcttcttctctgcactgcatgcacccaggaaaggccatgtgacgtcttagcaagaaggaggcaaaccatgaggagagccttcagcagaaaccaaatcggccagcaccttgatcttggacttcccagctggcagaactgtgagaaaataaatgtctgttgtttaagtcacccagcctgtggtattttgttatggcagcccgagcggactaatacaccaacctagcggtttttcaaagaaaggagtcccgggctggcccaggaggccaggctgctcagtccccgaagcctgatggcaggtgaggtggacaaccctgttgtcccgcccagtaacatttccttttttttttctgaatctcctttgagaaaataagctgcctctgtgcaactgccttgaatggacccagagttctgcaaagagtcagggaagggctgtgagtgatggtgataagacccgccccgcaccaccctgtggatggatgggatttatatcgagaaaggctacgaggtcagcccctcgtagctttataccatgtctccctcagctgagattaaacaagtgtgtagggattcaagaaaaagttgattttttaatttggagtggttgttacagggagtaggggtcaactggattttgccagccctgagattgaactggataaattacaggtaaattatatgtgtgaaagcactgggtacatgagaggatctcaatacaatttcgttgacttgcacgcaagtttcgcagaagctcctgcaagaggcgaagtgattcttattatgacaaataataacagtttctttttattaaagacctagtaagtacaggtatatcacctgtttacaatactgtcttatttatgcaaataatcctcgtgtatgaaaacaatacagacaaaacaatagtctcccttgtccacccctctccgtcaccagccccctcagcaatggtttaatgtgtttcctcaaaaattcctcaatcgatgcatttacatacacatacatgcactaatagaaacatacgcttgtcttttatggggccataagatacagactggctcaggatgcacgtattgtgtggcacttgatttttgcattttacagcaagtctgggtgaacttctcctgtcagttcatggagaactgtctcatcatttttaacttctgcatagtgttctaagtgatatgccataattctttaactacttccatacacaaggaccttcacatttttttcctcaacttttaaagttctcaaaagtttttccaatatctttgtttgcagaggatgtgtcgctctagaagagatacacataaatagaattttggcacaaaaccctacaaatatttcaacactgagtagccgttgataaatggatctgaaaagaggtggcagcaatttattctctcaggagcagtgtaggatagtgttcattgtccttcaccgtcgctcttgatgttattcatccctttaactatttgctaatctggtggttgatatataaaaggttttgagacaaagccttccttacagaatctgtgaaggtccagggctggtcatgcctgcaagcccatactcagatgtcgcctccagtgggctgggtggggagaggctgagaaaggcacaacagagtacaacagagagtgacaggaggaagtttcggggtccatgagaaggctcagacagggcacccactcagccttggggatgttaatggagtcagtggaggtttcccagaggattaggtgcctgaaaggcgtgaggaaagaaattagacagggaaagggagaggaggaacagcacttgaagcacaaagaccaggccactgaggtgattttggaaactgcaaataagcagacccagtttctattctgtgcacttgtagcagtcaaggttggctaccatgaaacggtgctggatcagaaacgtgtgtcccagtggagactctgagttcctctgctgcagttctctagaatgagggtgctcaatcaggggctagcctgagttccaaggtccagcccttgaggatcttctgggttgcatccaggccctggcctagagtttctgaagtctgtcatgggacataagatagtgatacatatatatatagtctcctaaggacctagcctgggagactctagtcagctgcccacccattctgtagctctggggtatgaaaagaagcaattttaggcagggtgagatgccaatggtgtcatgcagtatcttagggggtagtgagggtatccttagaggatactgaaaatacttgcaatggggctcatgggaggcataatagcccccagggcagcagtgccatcaggggacttgcaactaggcagctggctgacacagcaggtagctgtgaatgtagtagtcccctaagccacggggtcactaaatgtgtgagaagaacaagaatttggaggtcatttagccaaagatttcagtatgtcaatagggcaatggaagctcaagaaggtatagcaacttgctcaacacagagagaaaatgtatcactatggtgagacagtgaagggaggacactgtgactaacactgacagatgaaacctgtcttcccctgaacctgagaggttctagaaatcaagagcctgtgcaaatgggtcatcacagcaaacagcttgaggaggttcatggcagccaggtcccaatcagcagcagtgttgtgcctctgaggatataatgtgtgaggctgtgttggtgtgtgaatcagcctctggtgggtggtgaacagggggctccaggctggcgttcgctctctctctctctctctttctctctctctctctctctctctgtctctctctctctctctctctctctgtgtgtgtgtgtgtgtgtgtgtgtgtgtgtgtgtgttttagaggtgaggtccccttgacaccaagccctgctctattaaatcccctatgactacttgggttttgactgctgttttccaagttatggcccctcgtaacccactggattggttggacggtggtatcgttgcagacaagggtcctccctctgagcccaagggaaggaaggagggaacaaggtggcctcaaatcttgtcccctgggcctgagcctcttaagctacagtggcagcttcatccatatctgtgtcccacacagtctcatatcccttgccctacccacattcagccagcccagattcatttctggactggagaaaaggcctcagcacctccaggaagacagctctgagtccagacattgaaaacatctggttcctgctgagcaggaggctctgggctccaagctagaggaaataaaaggaatacttctcacccttatcccagatcagagagtccaggcacagcaaagctctggtggacacatgctcattgatttgttttcttcaataaaggtttattggtgccgtgctgtaggtaaagccctgtgtccaggtactggctgttccaggactaacaaggcagagctcatgctccagagatgagaacctgggtgaggacagtcatgcaaattaagctgccagagggggcagtctagcatgagaaatgctatgatagagaagagtacacagtatgtttgtgtgttagtcaaatatttcatcatatagatagggaaatggaagcccagaaaggtatagcaacttcctcaaggtaacacagagagaaaatgtatcactatggtgagacagtcaagtgaggagactgtgattgggactggcatggtggaggggagacatgttaccaagggaagaaggacgtgttctttttgagggtaggaacatcagagatcaaaaggacaagtgacaggctgagcaaggaaatggtggctccagaggagagccataatgcaaaggccctgaggcagggcagaattaacagctattttcgggggtactgaaggcaaattttagccacgctgtggagagagacgaggctgtaggagaggagcagagttgagatgtccagatggaaagtctgagggatgagagacaatgtcctggatagaaaggggctctcacagaatcatctcatttggatctggatggtatagaaggaagtctccattgctggtccaggatgagtcctgggctcccgtccctgtgcagttttctacagtgcatacactgggccttctaaacacaccaactctaaagcgcaatggtgaggtcagagtgatgcccacccaagctgttccctagaagccagtgatcggataccatcctgtgtggctggggaagctggcaaacagtgcataatgaggacattgatatgggttcatctagaataaaaccaggatgacataaagaagggctgggtttctagtaggggtcaaatgagtgtgaagaggcagaattgtggggtaaagatattggaatcaggcctcggcgagaggggaaggcagagagagagagaaagtgaggagagggagaggaagggagtgacggagggagggagggaggaagggatggatgggggcagggaggaagagaggaatctagggagggagggagggaggagagcatttggtcctttgcataagggatatggcctatgagctgcagcctgctggggctgcctccctcacaccagaatttttggaaaagtatccactgtgatgggcctctcttcctggagaacagacgcctttgtcctacttgctaggaagatatttttcctgcactgtttttgggttttggtttttgttttttggcactggaatgacccggagtcacccgggagctcccaagaggaggatgcagggtcccaggtcaactatattactactcatggctgccacttactgagggcctaatacacatcagacactctgtcgtgtggattacataagctgacacttatctttccaacggtcctgcaagttcaatgtcagtcaaattttacagggtgtaatctggagccggagacttcaagatacttgtccaaggtcacacagatatttactgacaaagctgggacttgaccccaggtctgactaaaacgtgggcgcaccatgcaccaccctggcacctgagaacccctcccagccttaatggagccttctgtgtcttgcacccagtccctagcccccagatattcctgctgtcttaattgttattgattgctgcataaaaaactaccccaagcatatcaagttaaaatgataagcagtttttctctgagagttctgtagatcagggatccgggtatggcttaactggatcctctacttcccagtctctcacaaggctgccagcccagggacaacagtctcatctgtaggcctgactggggaaggattgacttccaagctcactcatgcggctgttggcaggatccagttcctcatctgtaggctcagctggggaaagatagacttccaagctcactcatgtgattgttggcaggctctagtgggtcgctggcctgagggcctcagttcctctatggctgttggccagagactttcatcagctcctcgccagctggccttctccatctgggcaaacacgcgtgcaggaagagcctgagggagagaatgaatgccagcaggtcagaagtcacagtcttgttatagcctaagcatggaaatgacacgccatcacctttgccaaattttgttggttagaagcaagccactaggtccagcccaccctcaaggggagggaattccataggagcatgggtgccaggaagggggatccttggaagccattctggaaggctgcccaccacacctgctcctgcacccacctcagtatagtgagcccctttgggtatcaaccaccttgacggagcaaatggttgatgggccaccttggactgtgctatgtggcctgcatctatctgatcccacctctcttccagcaggcccaggactcgagtctgcctggccttgccttcctccccaaacctaccagctactcctggccactgagcccatgagatgtcacagcagctgaaaagggacctgctccctgtgactgaagcacacacccatcactcgggtgggactgggacccaggatggtgctccaggcctctcctggtaaaacagaggtgaagggctcagctctcccactgagacagggcccacctcaggagaacacgggtacaggtgggagagggctgggtccagagttatctgtgaaagctgcagagatgttcttgcttttaccctctgggttgggattctgggtagaatccccccaagttctccagcaggcatcacagaaacatctctaaggcaacgtgggagcacccatgccagagaaggagctgctctgaagctgcgtggagacccagaagtgttcagacgcctaagatgggggacctactctagggaggagaggagtgagtatagattggggatggtttgtgtgtctccaaaatgtatttaactcaaaagcagagagagatgtgaagcacatatagcaaagcatttttaagtagggatggtggctgctgtattcttctctctgtttttctgtaggtttgaaatatttcagtagtacaatactctaaaagtagaaaacagaagagaaggagggggctctcaggacccctggactccacatttcccaggcgtgtctcagagccaaatgcgtcaagctggggggtggcattgtgaacttgtgagtttcctaggaacccagtggttccattaggctgtggggatcgggactgcaggtggctggactcccatggcagaaccttagccaggagcagagccatcccggagaagcctgggctttttccagttctgggaagcatccaccagactcagctcttcccactgctgctattttcttgcaatatatatcaggggcagcttacaaagagacacggtgtcataataagagacaaacaacctgaggtgatggatatgaggccatgtgctggaggggctctctccaaggttgaggtgggggttgttgtggtcagattataacttaatgcctctgaagcctttcctgtggattctgtgacatcttctctccttctgacctcacctccctgtccctcaacctacagccctcctctccggcccaagggctatcactcagtcagtgcccatcagccaccctatatgaagtgtttgaaaccagtagcatgtttactgtccatcaaccattgtgctattgcaaaagtgactgggggacatgcagtactgctccaaggtacgaggacagtaacccatttggctaggtaccccgtgcctaactctctctccacagcgacccccttccctgccaccttcaccgaaagaggcaaaccataaatcacaggaggtggatattcatgtggagagggacatcaaatatcataacaccaaaagagtcaagtgtgccagtatgtatttcaggcccactggggtgagcaggggcatggagcagccgaaggggcgtggtcaccgttcacggctctgtgtctgcggcccccgtggtctcagtttccgagtgtccggtatcctcccctagggaggaaaacagagtgacaattggacccttgggagccctggggattctggcctggcctgaggttctcttggtgggcttggcggtgagcagtgagagaggcagaggctctcacctgaagcacttggtgaaacatgtcagggctccctggaaccagctcctccaacaccctctcagaagagcaggttccctgggcaagcctggtcctctatggtgttggcaaaataaaccaagggcatagtgtctttagctgagccagttccgttcaggaaaatagggaaaaatcattctagccagcactaacattgcttccttcattcgtcgggtgttcgctgggggcctgttttgtgtacaccaggatcagttgcaggtactggggatacagcaatgaactctagagatctagatcccagctctcctggggctgactatctgccacgctggagggaaatcaggctcaccaggtcctcaagagtttgctcttccttgggaaggctaaaaactgcagctgcccaccttgcaaagctgagagcaccagtctgggggatgcggctttctccatacagtcagatcaggactcagcagcagcaggaatgccagtgaagttcatgttttctgagaagtgcgatgtacatgtggtgtctgaaaggacttattgtcagaggccggcagaactcttcattgtgctgggcctctggctcagggcctgtccccccctgtgaaaatccatccccgtgtccctggcctggatcttcaccctcccctcctgtagatgagtatgctcttttcaagcagttgatgatacattctcgtaaactcccgcacgtgctgagatgcctcattgactagtatcatcgcttccctttcctctctcccgactcccccttgaacccactctaatcagcttccagccccacaacgcgactctcatgtagatgattaaatgacgaattgaaagtgatggtttctgattttcacattactctacttatataagcctaaagacttaagggaagatctatttctgcattgttatctttaaggtttactgaaattcaaaccggggtacttgccaattatatttttccccccaccagctccatcttcatgtcaagaaactcagtgagtagacaaccctgaaactacccctaaattcccagtgagccgaaccccagcattgctggggatccacaatcaaactccaggtttctcttctgtgcattagtggaagccaacgtagggtgcttgagggaagcatggatgtagaaaactgtgtctcacggagccctgagatttttagctataatttttgagtcaggctgctcagtcaaggctcaggctcagcctacgggagccttccaaggtcctggccttgaggatgcccaggggtctgtcaagggcttgacagaacccttttaggaccctgtgatgggccttgagacagtggcatctgagcccccagggctctggtctaggaagcatcagttttcccaccctacttctagttatgattggtgtcaggaggaagaaagaatttggggatgcaccatagggtaaatatattaaaactgtttaatccctgacaaatggcactccaaatgtggagtgcacatttggcgcgtagcgtgaatctgtgccaattcacactaccagcgtcagaacctcagtatatgatacccgattggtatcattataattttaaatgtttgtcaggttgcagtttgaaaagtggaatctcactgttatcttaattccattatgacttgtgatgtggagctcctattcctttcatagtggccatttgtatttctataaatggcctgctcagattgtttgttagctcttctattgttgtttgttctcgcatgtgtttcttgagttgtctcatcagagctctctgtatattgcaaatgtgattatttagtctgttataattgaagaagatgtttgctccctgtctctcacttgtgtttgcattttgtttcctgtgtcttcttgcatggacacttttcatttggggtgttcatacagactgctttattcaggcctcaccacaaccatgtgaggttgttcgtatttacctcagttttctttttgtttggttggttttatttacatttaataaatgctcattgagttaggtgtcagaggtactctgcacactggggatagaatcaccatagttccatgcgccaagatcacactgagggctggcggcacagtaatgagctgtacccttacagagctttccacctgtaagagtttcgggcacactcttaagcttctttttcttttcattcatgatttaaaaatgcattacttacacataattgtacatatttatggggtaccgtgtgatgtttcaacccctgtatacattgtataatcttcaagtcagggtaattaccatattcatcactttaaacatttatcatctctttgcagtgttaacatttaaaatcttctagatttaaaatcttgaagtatacactacattggtattttctatactcgctctactgtgtaatagaacaccagaactcgttctttatgtctaactgtaactttttacatttttgccaacctctcccgttgccccacacccccttccctccccagcttctggtaaccactactctagtttctgcttctgtgaaatcaactttttaagattccacatctgagtgaggtgatgtggtgtttgtctttctgtgcctggcttatttcacttaacataatgtcctccaggttcacccatgttgcctcaaatgacaggatttcattttgttttatggctggatggtattccattgtatatacaagccacatttttctttatccattcatctgtagatgggcatttaggttgattccatatcttggctattgtgaatattgctgcaacgaacacgggagtgcagatgtctcgtcaacgtgatgatttccttttctttcgctatatacccagtaacgagattgctgaatcacacagcagttctattttcaattttttgaggaatcttcatactgttttccataatgactgtagtaattttcattcccaccaacagtgcataagtgttcctctttctcaacatcctctccagcatttgctactttttgtctttttgataatagccattctaactggggcgaagtgatatcacatcgcggtttagatttgcatttcaccgatgattggtgatgttgactgttttcatatatccgttggccatttgcacatcttcttttgagaaaggtctattcaggcatttttcccaatttttaattgaattattatgaattttgctattgtttgggctccttatatattctggatattaaccccttgtcagatgcatagtttgaaaatactatttctctcattctgtaagctgtctctttactctactgattgtttcttttgctgtgcagatgctttatagtctgatataatcctattggtctatttgtgtttttgttgcctatgctttcgaggccttactgaagaaaagaatcgttgcccagttcaatttcgtgaaacgtttcccctatgttttcttctagaagtttcacagtttcaggtctgacattgcagtctttaagtcattttgatttgacttttgtatatggtgagagataggggtctggtttcattcttctgattgtgaacgtacagtttgtccagcaccatttattggggagactgtcttatcctccatgtatgttcttggctcctttgtagaaaatcagttggctgttaatgcttggatttatatctgggttccctataatgttttattggtctatgtatctgattttatgtcagtgccctgttgtattggttgcttttgtatatttcgaggtcaggtagtgtgttgtctccagctttgttcttcctgcttgggattggtttggctatcagcatcttttgtggctccatacaaatctaggattttttttttctatccggactgtcattggtattttgacagggatgtcaaatgtcgaacatggagatcactttggttaatatggacattgtaacaatattaattcgtccatgaatgtgggatctctttccatttatttgtgtgctcttcagtttcttttatcagtgttctacagttttcactgtagagatctttcatctcctagcttaagtttattgctaggattttattttttatttttttgtggctattgtaaatggaattactttcttgatttctttttcagatagtttgctattggcaaacagacatgctactgattcctgtatgctgattttatattctgcaactttaccgaattcacttattagttctaatagttacttggtgcagtctttagggttttctctatataagaccatgtcgtctgtaaacagggacaatttgacttcctcctttcaggttggatgctgttatggtttggctgtgtccccgcccagatctcatcttgaattgttgcccccataattgccacgtgttgtgggagggacctggtgggagataataaaatcttgggggcggtttcccccatactgttctcgcggtagtgaataagtctcacgagacctgttggttttataaggtgtttccccgtttgtttggctctcattttctctcttgcctgccgacatgtaagatgtgccttttgccttccatcatgattgtgaggactccctagccacgtgcaactgtgagtccattaagcctctttttaaaaaataaattacccactctcgggtatgtctttatcagcagcgtgagaacagactaatacaggcgctctttatttctttctcttgcctaattgctccggctagaactttcaatactaagttgaatttaagcagtgaaagtgagcattcttttcttgttacaaatcttagagaaaaagcgtccaactttttcctattcagtatgatattagctttcggtttatcatatgcggcctttattttgttgaggtatgttttttacctctttgcccactttgctgggagtttctatcatgaagggatgttgacattttttgaatgcttctcagcatctatcgaaatgagcatatggattttgtcctttgttctgttgatgtgaggcatcacttttattacattgcacatatattgaaccaaccttgcatccctgggatgaatcccacttgatcatgatggatgatgtttttaatgtgttgctggtgtttggttgagggttttcgcatccatgcttactagggatattggtctttagctttgttgttttgtcgtgtcctcgtctggctttggaattacagtaatgctggcctcgtaaaatgtgtttgaagctattccctcctcttcatttatttgcttgtttgtttgtttgtttgtttgtttttaagcctttgagaagaattggtaccagttctttacatgtttggtagaattcaccagcaaatccatcaggtcctggacttttctttgatgggagagtgtttactcctgcttcaatgtcattattccttattgtttctgttcaggttttctatttctttgtgatgcaatcttggtagcttgtatgtgttcaggaacttatctgtttcttctagattttgaatttcttggcagatggttgttcatgatagtctcttatcatcatctccaccgctgttgtgccagttgtaatgtttcctttttttatctctgtttttatttgaatcttctctctgttttccttagttagtctagctaaagatttgtcaatttctttatcttttaaaaggctaactctttgttttttgatttttaagttgtttttaaaaaatctctattttgtttatttctgccctgatctttgttatttcttttcttctgccaactttgggttttttttttttttgttgttgttgttctttttctagtttcttggggcgtaacattaggttgtttatttgagatatttccacttctgttacacaggcatttattgctataaactttcctcttagaactgcatttgctgtatcccataggatttggtatgttgtgtttccattttcatctgtctcaaggaatctttaaatttcctttttcctttttaattccttcattgacccatccattgttcaggagcatgttgtttcatttccacgactttgcccagttttcaatattccctctgttattgattacttcattgtggtcagaaagtactcaatgtgattttgatttttaaaagtttgttaagacttgctttgtgaactaacgtatggtctattctgaggaatgtttcatgtgctgttgagaaaaaatatgtattctgtggcttttggatggaatgatctgtaaatatctgttaggtccatggggtctagagtgcagtttaatgccgacattaattttctgtttggttaattttctgtttggatgatctgtccactgctgaaagtggggtattaaagtccctcactattattgtattatggtcaatctctcctttcaggtcttttaatatttgctttacatatttggatgccctggtgttgggtgcatatatttataacaattataagtatttatatatatttactatatatatatttacaaaatatgtatatttacaatggttagaatatacgtatttaacaattaaatatatattacaatatatattacagttgttaaaatatatatattttgtaatatatattactatatatacaattgttacaaaaacatatgtatatatatacacacacatatatttacaattgttatatccttttgctttattgacctgtttaacatcatataatggccttctttgtctttttctttttatggttcttgacataaagtctattttatctgatctaagtagaggtactcccactctgttttgggttccatttgcatggaatgtctgtttccaaccctttgctttcagtctgtgtgtgtctttgtcggtgaagtgagtttcttctagacagtatttagttggggcttgtgtttttagccactctatgtcttttaattggagaacttagtccatttacattcaagtttatcattgacaggtaaaagtttaacactaccattttgttacctgttttctgttttttgttttttgtttttttttttggtagatctgttcttcctttgttttgctcttactgtcttcttttgctgttatgtatttttctctagtagtaaatcttgattccttcctatttatattttagtgtccctattataggtttttgcttcgtggttaccatgatgagatgtataaaatatgtcttataattacaacaggttattttaaacagatagcagtttaactttaatcacaggaaaaacgaacaaaaacaaactctacactttaactcatccctccctccacactttgactttctgatgttttaagttacatctttttgtattcttatctcttaaccaattgttgtagttattactgttttgaacagttttgtcttttaggtttcatacttaagatatatttggcaacccgcgatgacaatattatagcattgtaaatctgtctgctttcttactattacctgtgagttttataccttcggatatttttttgttacatgttagtgttcttttctttcagactgaagaaaccccgttagcatctcttgtaagacaggtgttgtgttgatgatttttctcacgttttttcttttctttcttttctttttgtttcagcaagtctttttctttcttttttgctggaaggatagctttgctgaatatggtattcttgactgacagtttttttcctcttcatcacgttgaatgtatcattcctcccttccctggcctgcagggtctctggtgagaaatccactgaaagctgtattggtgacccattgagtgtgatatgttgtttttgttgtttttctcttgatgctttgagcatttttctttgcctctgatttgtttaaataatttgaatatggtgtgccttggggaatttgtctttgggttgaattttatttgtcacctctgagcttcctgtgcctgaatgctatgatctttctccagatttgggaaatttcagccgttatttttctaaatatgctttctagaccttgtatttttttttgtcttcttcagcaatttctattatgcagagtctaattttcttgatgatgtcttataattcttaaaggccttcttccctcttttaaaatgcttttgtctttttcctcctctatatatgttctgtcttggagcttacagattctttcccctgtttggtcaactctgctgttaaacctttctaatgaggttttcagttcagtcactgtattctctattttaggacttctggttttttttttttttttttttaattgtttttatttctttgtcaaattttttgttttgttcctggattgttattcaaattttatttagtttgttatccatattgtcatgtaattccccaaacttctttaggattattctgaattgtctgtcagacattccatagatcttcagtttttctgggtctgttactggagtttggttggtttcttttggcgtgtcacattttgtgagttttcacaatccttgtctctttatgttgatgtctgtgtgtttaaggagatgctcacctcttccaggttttgcagctgctccttggtggtgtcaaacctttactacttaatattggaacttaatccctggccagctgttgctttcagtctggaaaagacttactgtgagcaccagaacttaaatgctccacttaactatgttgctgccctgccactgtttcttggtctggggaagacttaagcgaacactggcccattattgccaaccttttagttctttccaggtcaagggaaggctccatgtgatcacatgggcttagtgagaaatctggccagggatctgggccttcctgtgtgttgcgcccccagcagtgctgtggttctggccagtctcctcagcattggcatgcccactgatcgtggcacagagcagctgccaagatccacgtgagagttgctgtgatcagtgcacccactttctgttcccaattcaccccaggtgtttcagctctcttctggaactctgaagggtacccgtgggatagggctggaggggacttcccatgaagattcccagactgatggggaggtcacatgtccacttccagttccctccttccacctcagaaattgtgggtctagagaaattctctgtgagtagcattatgctggtttgggggaggaggtggcacagtctaacgtgactgttgttcctcttactggttgtggcttttctcagttttgtcatcccaggaagtttccttgcttctcccccaagttctagtgaaaccagggtggtattcttgcctttgattaatttgtagttgtacttttgtggggagagtggtactgtgggatcatctgttcagccttcttgctgacgtcgctcctcctatttaccccagcgctcaaatgcagaaagcgaggctaagaaaaggtgcagggatttgtccctagattctaatccaagatcccgacctatgtgtgcctaactggaaagctatgcagtgacgtgggcccatggcaggctataggccaacattaaagccccattcatactggcctcctcctagacacagagggaacacagcatgtagcagaagaagccctcttttgtcctcagaggtgtgtgcctacttcaaagcacacaagacaaggaatggcagaagaaggggcataataatgggcctgctggacaggacacttgtagtgagggttgggagatctgggggccaggacaagacccaccactaactgtgactttgtctaagcaactggctctctcctggccacttctctaataaccagataacagttctgagccaccattgcaagtgtcggaaaggtgggttttttgaccccagctgggataaaaggaaagggggtgagacatacctccagcaatcatttcagcagcccatagctcttatcaatgcaacctctcaggcttagcagctattgctagtatcatcatgatttgcatgtaaatgactgctgctggatgatgatctggggacaaatggcatccagagcttatcccaaagggcctgatctcaaggaacctgatggatgttgcctctaggcctggtacaacaccagctgctctgtggagggggcatcccaagtaatcttcacaacccctctgtgagacgctttctttcccgctcccacaaagagtaatagcgtcggtccttctcaaccacccaggactgctgtgaggagtaatgagaaagctcccaacagccctggaagatattagaaagtgagatacacctgctatgtacccacaacaacagcaacaacaaaaaaacaagaacatgaggaacatgatgcaagtccaacagattactcatccaggcaattgcagaaaacataccagagctgtgtattatgagacaaatggtcaccgacattactactaatcattaaatgcccactgatgatactattcccagtggagttacaaatgccacccaaagaatccatagctcctgtcctctcggtagatatgggaagtcactgttactggggaccaggttttgcctggcatgcccccacacgttttaccccatctagttctcacagcaagtaaataagacaagtctagctcctacctctgggaggaggctgttcaccctcccctcacaatccccagaggacgctgatggataagtaaaccaagaccaaagcctcctaacccatgctccatggtgtgtgccaatggtttatgatgtctctgcactacaggtcttgtccacccttaagtggccaattagggcctgggacagcctgcaaatattacccaacatggttgagcaccaccagttttgagcctcacctttacaccatacaccaaaacatacatgtgttatcgtgtatgtaaacaaactccaaaccaagccgaaacaagaacaggatgtgtataaatttcctgaatggggtagaattctggttatttcctgtgtaattgccaagtatgttcaacgtagcttctcagcaacccatcagctatatgaatcttagcagaaccgaagactagacccgatttcttcagcctttcactgaattctcctcctccgcctgtgatccctatctgggtcaatggtaccccagggccacaagtcactcaagccagaaacctgggtgtcatccttggccccttgcctctggaccttgccccaggcccacctccagcctaacacagcaccgttctatctatcctatgaaaagcatctctcaagtaatgccacttccctccaaaccctcctccactaattttccccacaaactttaaaacccacgagtgagtgagtgcattttctttgggcacaatttctccctatgcccatctattttctgtgattgagactagaggtgtctaaagatggccagtgaatgaataaaattgactggcagggtcacagaaacaagcaaagcccacgttgaccctcactggcatgatctcattacacttcctcatgctggagtcccaggaaagccaagtctctctttgtaatcagtgcagtgaggatgggtcagccttttatgagagtggtcttggagcgtgtgctcccccttgggatggcttaaaggttgagctgcccaccctgtgatgctgcgggcaccactctgggggttccagcgagatgcagctttccccctacaggaaataaaccagatgaatgtgatttgatatgaccaatgtgaggtcccatcactcattagtatgtgtctggaaggcccacggttaggctccatcttctgtaggacaccagcagtcttccgactgttctcaggagtactctggcagtctgtagaattacctcaggtgaccatggggagcactggaggaggggcacgacagatgcagttttttccccattacgtcgcaccatcattttaccagtcaaaacaagtccccagtgggtgcagtgtgggaggagattgggcactgtgtggtgggaactgtctccaagcaccctgttaccggggaaccctgactccatgaatgttttagctttgctgcatgtgggactgcaagtacagtgtccccatcaccaagagcatgggctgtaactcacagttcaataggaccccctagatttgtagttggtgacagtggctcttaggctgcattgctgtaatggaaggatccttgcctcagatcaaccaggcactgtatcatggctccctcttgtgctggcgatgcaacctcagaatggtgatcacaccactcaccttgatccggatggtggaataataaaacaaaaacatgtgacgctcctgtaacacagcaggctgtgtaacatttcatggagctaagtacaaatgttgctgcctctgtaaggctgcccaggattcacgggaacatagcaccagagagattgaggacaggtggggcagaaaaacaagcttaatctcttgctcactcgcacagtccaatggtcttctgttcaccagaagtgctgggtgagcctggagccgtggaatttctgaccccacaccttcttctgaggcactgtcgactttactttaccgacctacctgagacgtctctcaggcacggggattgtgaggtgatgtaaacgcgggtcggggggaggtgtaagcaaaggagaagaactcataactcggtcacggtcatatttcagaaacgaaggtgtaaagctgacgacccatgccttcccctattgctgacctgtctttccccattcctgcatgtgattgccctgcatgctcaaatggttcatcatgcaatgggtaatgggcctgctcttgagatgcatgagcatctgttttgtgtcgctgtaacagaatacatgagactgcgtgatttataaataaaaaaatatttatttagctcatggttctgcaggctgggaagttgaagggcatggccctagcttcaggcgagggcttgtgtgctgtgtcataatgtggtgaggaaggtcaagggggaagtggacacatgcaatgagagaaaacctgaggggcatcctggctgtatagcaacctactatcttgggcactttgtccattcctgcgagcactaatccagtctcgccagagcaagaactcactcactactgtgaggagagcaccaagacacctacaaggacaaaggtggagccctcgtgacccaaacaaccgtgcactaagcctcacctcccagcaccaccaccttggggaccaaatttcaacatgagtggaatctcctgtgtatacggggctggcagaggaaagcattttctgctgtgaggctgcagagtccactggcctgcgcaatggggaaggcagggaagtcctcatggtccatccaacccaagagggcctgaggtggacgatggcaactggaggtcgaatcagcagtggaggtgttcctttcaggagatgatgcgtagtgctgtggctgtgtgtgggagtcagtcagcatctggtgggtagtgggcatatggttctgggcaaagcagacttggacaatgttaggatcagattggagagccctggagagagtgtggtgctggggagaagggctccttgttgctgagtctggctacctttaaatcccatctctgccacttgggtttcaagagtgactgccaagttgtgccctatccaccagatttccccacatcatttcttgtttcaacaagtatttgcatcctaaatacacacatacaagcacaagcatgcccatgcacatgtatgcacagactctccctgacactcccttaccagtgcaatgactgagctcatggttatgacagcagctatgaaggaacgaacacccaacaagcccccagccctagggagttggaacgctgctcctcttttggactaaacatggggtttagggctaaaccccatgatgtcaagtcctagccccttttggagaagcagcaacatggagctgaacttcccccactgagttagggcccagctcaggaggacagagccattgtggggagataggtggtacctgtgccatcgaaaaagctgcagagacatgggatctaaagaactccatcactccataattaacagctctgtctgttcagtacctatgggtctcaccgtggctgttccccaggaatataggaaaagggctgtgggacttccaaatgctgtcgcctacctgaaccttaccccatctggatttcatttgagcttaaaggccctggacctctgaagaaccagagggtgagtaattcacccagcaggccctaagaaagcattttttttttttcctcccctggctttgcacaggggactgcatgagacgggggagggggagagagaattttggtgttcctgtgtcctagttaggcttcttgatgctaaagagcacatccaatatccttgtccatttactttggtgacccctggtgctgcagtttctaacagggcctcctccatggttgttagttaacagggacaattatgctccaaccgcccccctttcagaattctcctgctgatactgtgttgcaacacatatcaaggtcaccttaggaaggcaaaagaaaaaaaataaagtcctcatcttatggaaaggaacaatgcatagttggagacaaggccgtctgttggaaggggtctctgtcttgtggtggagtaggcggggcttgggagctctttgtcagtacaggggttaacgccttttctgaggtccacagattcttcctccacatgaccctctcgcctccgcatataaacaccgcccagttttcctcagatatgaagactgtgtgcattgctgggggtaagagagatgttattccgtcctcattcctgcatgtgagatgttattccgtcctcattcctgcatgtaagtgccccgccagggtcagagctgagagccgtggaaaactcaccgttgattggctacagcccatcgccaccaggacctagtaacaagcagcgctgcctcgaggaggagggcagacagcctaacagggctaaggaagatgctagctctctcccttcacaaccccaccaccaccaaagctgaccacccccagttcagccgacgtgttgaaagttacatcaaatgccacaaagcaaaaacagtcaagcgtgccagcatttatttcaggcccggtgaccgggacactggggcgagcaggggcatggagcatcagagggggctcggtcaccgttcacgcctgtgtctgtggctccggtggtctcagattccgagtgcccggtatcctcccctagggaggaaagcgagtgacaagtggaccctcgggagccctggggatttctgacttggcctgaggttctcttggtggaacaggaaggggaggcggatgggcttggtggcgagccagtgagacaggcagaggctggctccgaaggagctctcgcctgaagcacttgatgaaacatgccagggccctctggaaccggctcctccaagaccctcgcagaagagcaggttccctgggcaagcctgtgccactggatgggtcctccgcggtgtcagatacagcaaccaattcctcagggtctttttgcggccctttcacattctgaaagacagactaaataactggatcctaatgatccctcccatccctggcttccgttacgcaactgttgtgtgcatctccggccctcttccatgggtgagggatgcagcagtgacctgcgcagaccaaagcccagcctcctaggggacattccaggacaacggagggaagccagactcaccaggtcagcaggtggaaggaagggagtgaagatcatgcttccaggagtgtgtgatgtgccggtagggaccaacaggacttcaatgaagacaccggcgaagctcgtcactctgcccggtgcaaagaggccgagggcctgccccctccacgccccattcagcccctctgcccctgccccatcgtccctccccccctacagcctggtgctccagcaggggatacatttctggcatgtcgcattccatttgtttctgtatctcttactcccagtcctccaatctttctttcctttgctgctgcttcctggccctctcagcaggctcgagccacgtttctccttgccgagcagaaaaagcagaggtcttcaagctggtgatgagtcatcatttggtggggatgccacagacccgagtgtccatgtgggtgctctcctgcctttgattcacaggattatgtacatggatgccctgggcaggtgtatgagtccaaatgagtcgtcacagcaaggagcgtgagctgggtaatggtatccagagtccaaatcaacagcagttttcttttcagaggtttacgtgagactccacgtctatgtaccagtcagtatcaggtggtttagggcctggagggcttggaaaatgtgagagagagggagaggtgaagggcctgggctggggtgagttgaaagtagaacagccgaccagcctgggcagcatagggagaccccacccccacagaaaatttcaaaagtagcctggcatggtggcacacacctctagccccacctactcaggaggctgaggggggaggattgcttgagcctgggaggcggaggctgcaatgagccgtgatggcaccactccactgcactccaggctgggagacagaaggagactctgtctcaaaaacaaactgacaaatcaaacaaacaaacaaaagaaagtagaagagcagaggtgaaagctccttgttgcctagtcttgctatgtcaaaatcaggctttgacatttgagttacaagcaatgctgccaagttatgccccccgtttgctaaccaggtctgtgcggtccgcaccgctgacttcacaggagctccctgcaaacagtatcctgaagggaaagtggaagtaggtggcctcagagtctttctttggcttttgaaacaatagtgctgtttaggaaagcatctcttacataatcctgaggctacagagttgatctctgtgagcctatcatgggccgtgccctgaatgaggctctgcttcaagctcttctgtgagggagaaaccgagagaggcatgaatgtaacagagagtgatggagggacgtttatggggctacgggaggactgaggaggcgggcagtcactcagccttgggaattggaacggagtcagtgaagagttcccagaggaggcgtgcctgaaaggagggacaaaagaaattggccaagaaatagagaaaagggagagcatcacaagtagaagcccaagacaataccgtgaggttttgcaactgaaaatatgtaggcctggttttctgttctagggtttaatagaagtcaaagtcagtcacgaggttccagtacaggaacctgaaaagctgtgcctcacagagacactgaaccctggtttttgagaacccaaagggtatatttttaatagaattttgatatatattgatttaatagaatttgataatagaattttgatcaatagcagtccattgatcatttttccagtgtgattcatgctttcatgtgtcctaccctaagatatcgttgcctagcctcacaacagagattttctcttctgatgtttgtaggttttaatattttgcaatttacacttagatctaggatttattttgaattaatgcctgcatgaagtgtgaataatgtcgggatgaatggtgagatattgaagttgtttgggtcttccgtaaagagatctactttttccagcactattagttaattgtcagctaatttaattatctttgagcctttattagaaatcaacttactatatatatgtaagtctatttctagcccttcttctatttcatccaatgatccctatgtgaattcttaaggtcataccaggctgtcatgattaccatgtctttatattaagtcagagactttggtgatgtgagtccttcatgcttgttcttttccaaatggctttggatcttctatgtcatttgcatttatatataacttttgagaaacagttcttcactttaattatgattatggtgagcctatagatccattacttgagaattggcatcttaacctgagtcttctgatcaacgaacattatatatctctgtttatttaggtctccactttctctcgccagtattttatagtggtctgcatacaggtctttcacatattacattaaaattctcaatagatacctcatttattttgctgtaattataaatgacattttaaataatgtcatctccaattatttgttcccagtatgttgaaacacagtgggtttttgtatgttgagtttctgtcttgtaactttgttatgtgacttgttaggtctaggagatgtttatccccacattccttagtattttgtatgtagactatcatgctatttgtaaatggagaggttttttttattccttcctattcaatctgtatgccttttacttattttccttggctcattgcactagctgggacctcaaggataattgtatacgcatagtaagagtctgccttatttttaatcttatgggagaagcattcagtatttcaccattaggcatggtgccagctgcaggttttttgtaggagtactttattaggttgaggacgttgctttatgtacttatcaagtggtttgggttttttggtcatgaatgggtgttttatgttatcaaattacttttctgttatatatctggataataaatgctcttttcttttattccattaatatggtgaaatatagtcacggatttttaatggtaaaatgaccttacattcccaggacagactgtgcttggtaatagattatttttttttcatatattattggattcaagttgctaaaattttatcaaggagttttgtaactatgttcattaggaacactggtttgtagttcctttttttcttctggtatcttttttctattttttttttttaaataaaagtaatgctgccatcataaaatgaactggaaagtgttccctcctgtattttctaaaagtgttcttttgggactactactatgttttctttaaatgtatgacactgctaaccagtaaatctattgaagactgaagttttctttatgatttacaaatacggttttaaaaagtctccacataaccattcttttaaccttaacaaggtctttagggatgattaccaattaattatatgtagttattagaagagtgtgcttaaaaaattttcctcagcttttaaatgtcttattttctttcttcttttctttaatttttatttttctttatttcttctaaaacaattaacgggatacatgtgcagaacgtgcgggtttgttacataagtatacgtgtgccatggtggtttgctgcacctattgacccatcctctaagttgcctcccctcatcccctaccccccaacagctcctggtgtgtgtccttcccctctctgtgtccatgtattctcattgttcaactcccacttctgagtgagaacgtgcggtgtttggttttctgttcctgtgttagtttgctgagaatgatggtttccagcttcatccatgtccctgcaaaggacatgatcccattcctttttatggctacgtagtattccatggtgtatatgtaccacattttctttatccagtttatcattgatggacatttgggttggttccaagtctttgctattgtaaatagtgcctgcaataaacgtacatgtgcatgtatctttatagtagaatgatttatattcctttgggtatatacccattaatgggattgctgggtcaaatggtatttctggttctagatccttgaggaatcaccacactggcttccacgatggttgaactaatttacgttcccaccgacagcgtaaaagcgttcccatttctccacagccttgccagcatctatcgtttcttgacatttttaataatcgccattctgactggcataagttggtatctcattgtggttttgatttgcatttctctgatgatgagtgatgttgagctttttttcatatgtttgttggccatgtaaatgtcttcttttgagaagtgtctgttcatatcctttgtccactttttgatgggattgtttgtttttttttttcttgtaaatttgtttaagtgtcctgtaaattctggatattagccctttgttagatgggtagattgcaatgattttctcccgttctgtaggttgcctgttcattctgatgcttgtttcttttgctgtgcagaagctctttagtttaattagattccatttgtcaattttggtttttgttgcaattgcttttggcgttttcgtcatgaagtctttgcccattcctatgtcccgaatagtattgcctaggttttcttctagggtttttatggttttgggttttacatttaagtctttaatccaccttgagttaatttttgtataaggtctgaggaaggggtccagtttctgttttctgcgtatggctagccagttttcccagcaccatttatttaataggagatcctttccccttgtttttgtcaggtttttcgaagatcagatggttgtagatgtgtggtgttatttctgcggtctctattctgttccattggtccatatgtctgttttggtaccagtaccatgctgttttggttactgtagacttgtagtatagtttgaagtcaggtagcgtgatgcccccagttttgttcttcttgcttaggattgtcttcgctatatggggtcttctttgattccatatgaaacttaaagtagtttttcttctagttctgtgaagaaagtcaatggtcttgatgggaatagcattgaatctataaattactttgggcagtatggccattttcacgatattgattcttcctattcatgagcatggaatgttcttccatttgtgtcctctcttatttccttgagcagtggtttgtagttctccttgaagaggtccttcacatcccttgtgagttgtattcctaggtattttattttctttgtagcaaagaagaaatcatgggaattcactcatgatttggctctctgcttgtctattattggtgtataggaatgcttgcgatttttgcacattgatctttgtatcctgagactttgctgaagttgcttaccagctgaaggagattttgggctgagacgatggagttgtctatatatactgtcatgacatctgcaaacagagacaatttgagttactctcttcttatttgaatacgctttatttctttcccttgcctgattgtcccggccagaacttccaattctatgttgaataggagtgatgagagagggcatccttgtcttgtgccggttttcaaagggaatgtttccgtgtttgtcataaatagctcttattattttgagatatgttccatcaatacctagtttatcgagggtttttagcatgaaggggtgttgaattttattggaggtcttttctgcgactattgagataatcatgtggtttttgtcattggttctgtctatgtgatggattacggttactgatttgcgtatgttgaagtagccttgcatcccagggatgaggccgacttgatcgtggtggatgagctttctgatgtgctgcgggattcggtttggcagtattttattgagggcttttgtgtggacgttcatcagggatattggcctgaaattttctttatttgttgtgtctcttccaagttttggaatcaggatgatgctggcctcataaaatgagttagggaggagtccctctttttctatcgtttgaaatactttcagaaggaatggtaccagctcctctttgtacctctggtagaatttggctgtgaatccgtctggtcctgggcttttgttggtcagtaggctattagttactgcctcaattgtaattttccttttaatgtggtgcatcacattaattaatttgcacgtgttgaaccatccttgcttgcttcccagaaatagatcctgcttagtcatggtgaacgatccttttaatgtgctcctgagtttggtttgctcgtattttgttgagaatttctgcctctatgttcatcagagatattgtcctcctgcttccttttcttgaagtgttttcatcaggctttggtatcagggtgaccctggcctcatagaacgaacttgacagcattctctcttcttcaagctttgggaagcgtttgagaaggtttggggttaattttctttaaatgcttggtagaactcaccagggaagccatctggtccttagcttttctttaatgggaagtttttgattactgatccaatctccttactccttattgttctgtacagattttctgttttttttaatgatgcaggcttggttggttgtatgcatctatgaatttatccacttctgggctgacccatttattgctgcgtaattgttcacagttgtctcttatggttctttttatatttctggcatcaattgtaaagtctcttctttcatttctgattttatttccctgattcttctctcttttcttctcatttagtctggctaaaggtttgttaattttgtttatcttttcaaaaaaccaactcttattttcactgattattttcctgtggtcttctattccctatttttttttatttctgctctaattttttattatttcattctttctgctaactttggagttagtttgttcttcttttcctagttcctggagataaaaagtaaatttagtccaggcgccgtgactcacgcctgtaattccagcactctgggaggccgaggcgggtggatcacgaggtgaggagattgagaccatcctggccagcatggtgaaaccccgtctctactaaaatacaaaaaattagccgggcgtgggcgcctgcagtcccagctactcgggaggctgaggcaggagaatggcttgaacccaggaggcagaggttgcagtaagctgagattgcgccactgcactccagcctggaaacagagcgagactccgtctcagaataaaataataaataaataaataaaataaaaattaaaataaaaaataaatttaatggacatcaatatattttgtttaaatctatgtacttgctgtttgttttctattttcccatttgttctttactcctctcgtccattttttttcatctcatcacattttggttgggcgttttaggattccatttgtcttcactactgtcttattagctgtatctatttcaatttatttaaatggttgctcaacttaccacactctatcttcaagtaatactatagcatttcacatacagtgcttcaatctcactggagtataccttatttttctcctctttttttttttttttgcagtgctattgttacgcattttatttctacatatgctataacatatgtatgttataaacatcattccgctttcaagttagttataaactgtcagttgtcatttatatatatatttttttaaatgaggaaaaaagctatctttcatatatagccataggtttcattcattcctcttggtcaatcctagtttccacgtggtatcattttacttctgcctatatttacttctgcctgtatttttttggggggagaaatggctgttcacatcttttgcccatttctcaatgaggttatatgttttattattaatttctaaaactaatttctgtaatctagatacaagtcacttataagttatatgatttgcaaatactttctcccattctggggcttcttttttcacattcttgatggtattattaattgcagcaaaaagtttttaattttaatgaaagtcctgtttatcctatcccattgtagttttggtttgcatttctctgatgatcaatgatgttgagtacctttccgtatgtctgtttgccatatatgtgtcttcttttgagacgtgtctattcagatcctttgcctattttttaatcggattattacattttttccctatagagttgtttgagctccttatgtattgtggttattaatctcttgtcagacaggtagtttgcaaatattttctcccattctgtgggtttgcctctttactttgttgatgaacaaaggattccacttgagactcctagtttcattgattttgcccccatggttttctattctctattttgttttcaatgttgacggtttcctttgctgtggcagaagcttttcaacttgatgtgatcccattggtctatttttttttcttgctttggttgcctgtgtgtgcggggtattactcaagaaatctttgcccagtgcaatatactggagagtttcccctaatgttttcttttagtagtttcatagtttgaagtcttagatttaagtctgtaatctattttaatttgatttttgtgtaagttgaaagatagaggtccagtttcatgcttctgcatgtgaatatccagttttcccagcaccatttattgaagagactcttttctctagtgcatgtttttggcacctttgtggaaaatgagttcactgcaggtgtgtggatttgtttctgggctctctattctgttccattgatctatgtgtctgtttctatgccagtaccgtgcctttttggttactatagctctgtagtataatttgaagtcaggtaatatgattcctccagttttgttctttttgctcaggatagcctttgctcttcttttggcaatctgtagattgttttggatagtatgaatattttaacaataataattcttccaatcaatgaacatggaatagcttttcatatttttgcaatccccttcaatttctttcatcagtgttttacagcgttccttgtagagattttcacttcctttgttaattcctaggtattttattttattgatagctattgtaaatgggattactttattgatttcttttccagattgttcacagttggtagtgattttcgtatgttgattttgtatcctgggactttactgaattcgtttatcagtgctaatagttttttggtggggtctttaggtttttccaaacataagattatgtcatatgcaaacaaggataatttggctttttcctctgtaattttgacaccctttatttctttctcttgtctgactgctctagctagaacttcctgtactatgttgaataacagtggtgaaagtgggcatccttgtcatgttccagatcttagaggaaaggctttcagtttttgcccattcagtatgatactagctgtgggtgtgtcatatatgacttttattatgctgaggtttgttccttctatactcagtttctgcagagtttttataatgaagggatgttgaattttatcaaatgctttctcagcatcctttgaaattatcatatgtttttgtccctcattctgttaatatgatacatcacattgactgatttgcatatgtcgaatcatccttccatctctgggataaatcccatttggtcatgatgaattatctttttaatgtgttggtgaattcggtttgtgagtgagtattttgttgaggatttttgcatcaatgttcatcagggatattggcctatagttttctgcgtgtgtgtatgtgtgtgtgtgtgtgtgtgtgtgtgtgtgtgtgtgtgtgtctttgtctggttttggtatcaggaaaacactcatagaatgagttcagaagtattccctcctcctctaccttttgaagtactttgagtaggattggtatttgttcttctttaaatgtttggcgcaattcagcagtgaagccattgggtaccaggctttactttgctgggagactttaattatggcttccatctcattacttgttattgttctgttcaggttttaaatttcctcatggttccatctttgtaggttgtatgtgtgtatgaacttatccatttcttcaaggttttcaaatctacaggcatatagttgctcacagtagcctctaacgatcctttgaatttctgcactatcagttgtaatgtctcccttatcatccctgattttatttatttggttcttttcttttatttctcatttattctggctaaaagtgggtccatttggtttctcttttgaaaaaaccaacttttcatttcattgatcttgtgcattgttttcttcgtttagattttatgtatttctgctctgatctttattatttcttttcttctattaattttgagattggtttgctcttgcttttctagtttcttaagatgcactgttaggttgttaggttgtttacctgaagtttttctacttttttgatataggggcttataactgttaagcttcccgcttagtattgcttttgctgcaacccacaggttttggcagtttgtgtttccactatcatttgttttaagacatttttcaatttccttcttaattttttcattgacccactgctcattcaggaacacattctttaaattgcacatttttgtatagttcccaaaatttcccttgttattggtttcaagttttattccattttggtcacagaagatacttgatattatttcaattttttgaatgttttaagatttgtcttgtggcctaacatgcggcatatccttgagaacttatccacgtgctgaggagaatgatgtgtattctacagctgttggaggaaatgttctgtaaatacctgttaggtccatttggtgtatcgtgcagagcaagtccgatatttctttgttgagtttctgtctggatgatctgttcaacgctcaaaatggggtgttgacgtctccaactattgtttgtctttcaacactgtaagtcttttagtttgtttccacgatgcttcgtggttttgcagagtataagttttgcactttctgttaggtttattcccatgtattttattatttctgctgctattgcaaatggaattgttttcttaattttgtattcaatgtcctttttgctactctataggaatagaaattattttcgtgtattgacgttgtattccttcactttgccaaattcagtatttgtctttaaagtcttttagtggattccttaagattctataattacaagatgatgccgtatgctaatagaggtagttttatgtcttcatttcccatctttttgaaaaccaggtaccatggccacaaccctcaatacattgttgagtagtagtggctacatcaggcatccttgtgctgtttcagacattaagggtaaaagattcggtcttctgccattaaatatgatgttacctgtgggtgttctttatcataggtgctctttatcagtttgaggaaaattcccttctattcccagttttttttttcttgagtgtatttcttatgacaggctgttgaactttttcaaatgcttcttctgcataaattgagatgaatacgtgttttttgaatgattatctgttcatatgataaaatccatttattgatgtgtagctgttaaagcaaccttatgtgcctgagataaatgccacttggtcaccgagtataaatatttttgtatgttgctggatttggtttgctaatattttgttggggattttttctgtcctattcatagttttgcttttgagtctatatatgattttgttgccaggcttatgagttatgaagttttccctcctcttctatttttttggaagaactgttgaagaattgctattaattcttatttacatatttagtagaattaaccattgaagccatctgagcctgatctttttttctgggtagtttttttgctttttgttttttgtttttaattactatttcattctgtttcattttcatagatctatttaacttgtgtatttctcctccagccagtttgcatggtatatgtatacctagaaattcatccatttcatctaagccatcaaatctattggcatacaattgttcatattatttctttataattctttatttttccataatgtagatagcagtgtctcctctttctttcttgatttcagcgaatagaacctcctcacttttctcttgatcaatctggcttacagtttgtcaattttgttgacttcttcaaggaatcagatttttgtttcattggtttatctctgttatttttccactcttcatttcattaattcatgctctaatcagtgtccacttttctcttcgatttgcttaggtttagtttgctctttttcccagggtctcaatgcggagggtaaggttattgacccgagatatttcttttttttttttttttttttttgagacggagtctcgctgtcgcccaggctggagtgcagtggcgcaatctcggcccactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccacccgcctcggcctcccaaccgagatgtttcttatttttttttagtatcagcatttagagctatacattttcttctaagcactgcttaactgcatcccaaaagtttgacatgctgagtcttcattttcatatatctcaaaaagtattttctagtttcccttttgatttcttctctgacccttgattatttaggagtttgttgatttctttatgctcatgtatttcccactaatgtatgttttattgatgtataacttcattccattgtggtttgggggcctactttatattatttctgtccttttacatttattaaggtgttttatagcccaccgtatggtctatcctggagaacatttcaggtgtacttgagaagaacatatattctgatgttgttgggtgtagtgttctataaatgtctgttaggaccatttgatttattgctttttcaaatctagtatatccttgttggtattctgactagcttttctattcattattgaaagcaaggtattgaagtctcaaacaatgattgctgaattatctattccccttttcatttctgtcagcatttacttcaggtattttggtgttctgttgtgcagtgcaaatatatttataatttatatatcttcctcttcacacttttataattgtagaatgttcatgttttatctctagtcatagtttgtgttttaaactctattttttctggggttgacaaaactactccagctctcttgcggttgctgttttcagtgtatttattttctcaaccttttacattctaactatttgtgcctttgaatccgaagtgtgtgtcttgtagacagcatctagttcaaccatgtttttattacatcctgccaatatctgctttaaaatacatttgtattgttcagtctattcacactgaacttaatgtaattacttaatgtaattactgttggggtagaatttatgcctgccgttttttgtattttctttctcatgtcttactgttcctctgtccctgcactgacgtattcttttctgctaaacagatattttctcatatactctattcatttacctgttgtttctttattgtatttttgggttgttttcttagtggttgccccacagattacagatcacattttaactcaaaagaatctagttcagattgataccaccttaatttcaatattacacaaaactgtgaccctataaagctcaagagtctcttctcctttgtgctactattgtcataaaattacttctttatacctgtgatgcccatctagatagttctataatgattgctttatgcaacaattgtcctttaaatcaggtaaaagaagggaagagttacaaacaacaatacattcgtacagtcttttatcaatgctgttgtagttagttacctttaatggtgttcttatttattcatcgggatttgagttactgtctactgtcttttccagatttccctttaatatttttttgtaagggaagtctgctgatgatacattgactcagcttttctttatcaggggatagctttacttcatcatcatttttgagggagagtatttctggatggaacattcttggttaactgtttgttgttgttgttgttgttttcattaacccctttgactgtgacttctcactaccttttggtccccttggtttctgataagaactcggttgttaatcttactggggatcccttgtgtgtggtgagctgtttttctttgctgctttccacattctctcattgtctttgattttcaacagtttggctaagatgtgcctcggtgaagattttcttgaattcatcctctttggagtttctgtggttctcatttgtgtccattaataatttgaatcaaacttggggagtttgggccattattgtttcaaatgttctctctttctcgagttcccatttctgttgagcccctctagtgagtttttcgctgtagttattgtacatttccacttcagaatttctgcttgggtgttttaaaaacactaatttatattctgtgatgatttctctatttgttgagacatcattctcatacttctctttaattcttttcacatggtttcctttagttgtttgaacatattcacaatagctgatttgaagtctttttctagtaagtccaatgtctgagcttctctctgcgtgttccatactctcctgtttctttgcacgtctcgtaagttttttgttgaaaactggacactttaactaatagaacgtggcaacgctgaaattcagactctcccttctttcaaggtattgttgttgttgtttggtgctattaatcctgctgtcacttgtttgtttagtgacttttctgaactacttctgtaaagtctgtatcctctgttatgtgtggctactgaatgccctgcttggttggcttagtggtgacctggtgattggacagagatgtctttatatgcctggaaaaggtaagtttcccagtcattgccatggggctctgtggatatgttggacatgccttcaactcgcagccaggcaattgacaactctttcacagagcctcaaaataaaccagagttggccgtttaggcaccttttgggtctttgcagaccatgtcatagtcctaggtgagtgtctggccttctagattcccaggaataggtaatcgcttttaaaagtcccaatggacacctcgttacctagatttccttttaaggtatcggttagcctattgtgtgccccaagtgttatccattgcctgaggcagctgcaatattgagcaattgcctccaaatatttttcacaaatgcatccagggaaaaaggcgtttcaaactgggcacactctgagtcagtccaaataaagacagccatgtaagtagggccttcccgggaactaccagacagatcaaataatgacaattctcgggaatgcggctttgcaggagctccaaccctgttctgttccctctggtggctgccaggctgctggttttcaccatgattgcaggctgttggtattcaaggctaccatggagctgcataaagggccatgaggatagggctagttgaaatgtcacatagttcactgttcctaaaaagattctgctgtttttcttgaataaacacgcccaaggttgcccctcagctttaggtgaatttgcaggtttccgaaaacattcattttgacaatttttgccagttttctcattgcatttacgaaggggagaatttttagaggtccttacgttgctgatgttgctgactctctgcacgagttttcattatacctatccatgagggtgtctgttgttaggtggtccctctgtgctcggaacttacgtatctctcaataatcactttacgggttaccgaccatgtgaaagggaccacaaccggagctctagaagcaaagatgtatagctcaccacctttgatctcaaagttgtcattctcaagtagattccatttaaccaaaacatttaaagccttatgatcaccaagcctgcatctggtcaccaaattatttcttaattcagtaagatgggggcagggatggaggatcaaggatgtgggctgtttttggccaccgtgtcttaaatataaccaggcttttacctgcatatttggcagcagcctggctagtatctcttgtcacaacaggttttattcctagccacttcagaagtggctgggagcctcagggagtaagagtgcagatgaggtgctgcagagatgtcccatatgaagagctagaaactgaaatttatttcaacaactgggcttggttttgaataactccttagcaccaatctaggatttcccactgaaatggcttgatttatatcgatgcagcccaccacctgggcagttattaataggcctttaggtagaaagcagcagggacccaagagactgctctttacaccacagcgtggaaacataactccatccctctccttttgaatcaacctctgcatatcaacaaacatcacatggtcattgatcgaggatcccgttagtaacctaagacttgagtttacatagaataacctgtctctgaaaccctttgaactgaagctgctaacttactcacaacctgtttgttgagggcgtgacttctcaaagtattctggtgccttggataaatatgtctgtaaagttgccaagagccttcaaatgacagtataatgtttaagagtcagacaaattttactctgaatccaggctctgccactttctttcccgtgaccatggataaatgacttagcttccctcaacctcagattcctaacttgcaaaactgaggataagactaaagggattgtaggaattaaagatgacaatacgtgtaaagcatgtggtgcactatccggcagccagctaatgcttcaaaaaatattaggtttagttactattgagcaacgtctttttttattttcatttttatttttatttttatttttattatactttaagttctggggtacatgtacagaacgtgcaggtttgttacataggtatacatgtgccatggtggttttatgcacccatcaacccgtcatctacattaggtatttctcctaatgctatccctcccccagccccccacccccggacaggacccggtgtgttatgttcccctccctgtgtccatgtgttctcattgttcaactcccacttatcagtgagaacatgtggtgtttgattctccgctcttgtgttagtttgctgagaatgatggcttccagcttcatccatgtccctgcaaaggacattaactcacccttttttacggctgcatagtattccacggtgtacgtgtgccacattttcttctttatccagtctatcattgatgggcatttgggttggttccaagtctttgctattgtgaacagtgccgcaataaacatacgtgtacatgtgtctttatagtggaatgacttataatccttcgggtgtacacccagtaatggcattgctgggccaaatggtatttctagttctaaatccttgaggcatcaccacactttcttccgtttgaactaattcacactcccaccaacagtgtaaaagcgttcctgtttctccacatcctctccagcatctgacgtttcctgactttttaatgactgccgttctaactggtgtcagatggtatctcactgtggttttgatttgcatttctctaatgatcggtgatgatgagcatttttttcatatgtttgttggctgcataaatgttttcttttgagaagtgtctgttcatatcctttgcccactttttgatggggaagtttgtttttttccttgtgaatttgtttaacttatttgtagatcctggatattagccctttgtcagatggatagagtgcaaaaattttctccctttctgtaggttgcctgttccctctgatgatagttccttttgctgtgcagaagctctttcatttaattagatcccatttgtcaattttggcttttgttgccattgcttttgctgttttagtcgtgagatctttgcccatgcctatgtcctgaatggtattgcctaggttttcttctaggatttttatggttttaggtcttatgtttaactttttaatccatcttgagttaatttttgtataaggtgtaaggaagggatccagtttcagctttctgcatatggctagccaattttcccaacaccatttattaaatagggaatcttttctccattgcttgtttttgtcagggttgtcagagatcaggtggttgtagatgcgtggtgttattttggaggcctctgttctgttccattgttctatatatctgttttgctaccagtacctcgctgttttggttactgtagccttgtaatgtagtttgaagtcaggtagcctgatgcctccagctttgttcttttggcttaggattgtcttggctatgtggcctcttttttggttccacatgagctttaaagtagttttttccaattctgtgaagaaagtcaatggggatagcattgaatctataaattactttgggcagtatggccattttcacaatattgattcttcctatccatgaacatggaatgctcttccatgtgtttgtgtcctcttttaatgccttgagcagtggtttgtagttctccttgaagaggtccttcgtatcccttgtcagttgtattcctgggtattttattctcttagtagcagttgtgaatgggagttcactcatgatttggctctctgtttgtctgttacgggtgtgtaggaatgcttgtgattttttgaccttgatttcgtatcctgagattttgctgaagttgcttatcagctgaaggagattttgggctgagacgatggggttttctaaatatacagtcatgtcatctgcaagcagagacaatttgacttcctcttttcctaattgaataccctttatttctttctcttgcctgatttccctggccagatcttccaatactatgttgaataggagtggtgagagagggcatccttgtcattcaaagggaatgcttccagtttttgcccattcagtatgatattggctgtgggtttctcataaataactcttattattttgagatacgttccatgaatacctagtttattgagagtttttagcatgaagggctgttgaattttgttgaagaccttttctgcatctgttgagataatcatgtggtttttgtcattggttctgcttatgtgacggattacgtttattgatttgtgtatgttgaagcagccttccatcccagggatggagccgacttgatcgtgatggataagctttttgatgtgctgctgtatttggtttagccagtattttgttgaggattttcgcatcgattttcgtcagggatattggcctgaaatttcctttttttgttgtgtctctgccaggttttggtatcaggatgatgctggcctcataaaatgagttcaggaggtttccctctttttctattgtttggattcgtttcagaaggaatggtaccagctcctctttgtacctctggtagaattcggctgtgaatccgtctggtcctggacatgttttggttggtaggctattaattactgcctcaatttcagaacttgttattggtctattcagggatttgacttcttcctgatttagtcttgggagggtgtatgtgtccaggaatttatcgatttcttcgagattttctagtttatttgcatagaggtgtctatagtattctctggtggtagtttgtatttctgtgggatcggtggtgacgtcccctttatcattttttattgcgtctgtttgattcttctctcttttcttctttattagtctggctagcggtctacctattttgttgatcttttcaaaaaaccagctcctggattcattgattttttgaagggttttttgtgtctctctctctccttcagttctgctttgatcttagttatttcttatcttctgctagcttttgaatttgtttgctcttgcttctctagttcttttaattgtgacgttacagtgtcgattttagatctttcctgctttctcttgtgggcatttagtgctatgaatttccctctacacactgctttgaatgcgtcccagagattctggtacgtggtgtctttgttctcatcggtttcaaagaacatctttatttctgccttcatttcgttatttagccagtagtcattcgggaacaggttgttcagtttccatgtagttgtgcggttttgagtgagtttcttaattctgagttcaatttcattgcactgcggtctgagagacagtttgttatgatttccattttttcgtttgcatttgctgaggagtgttttacttccaattgtgtggtcagttttagaataagtgcgatggggtgctgagaggaatgtatattccgttgacttggggtggagagttctgtagatgtccgttaggtctgcttcacccactattattgtgtgcgagtctaagtctctttgtaggtctctaaggacttgccttatgaggctgggtgctccggtattgggtgcatatgcatttaggatagttagctcttcctgttgcattgatccctttaccattatgtaatgcccttctttgtctcttttgatcctcgttgatttaaagtctgcttcatcagagactaggattgcaacccctgcttttctttgctttccatttgcttggtaaatcttcctccatccctttgttttgagcctatgtgtgtctttgcccgtgagatgggtctcctgaatacagcacaccgatgggtcctgactctttatccaatttgccagtctgtgtcttttaagtggggcacttagcccgtttacatttaaggttaatgttgttatgtgtgaattcgttcctgtcaatatgatgctagctggttattttgcctgttacttgatgcagtttcttcatagcgtcgatggtctttacaatttggcatgtttttgcagtggctgataccggttgttcctttccgtattgagtgcttccctcaggagctcttgtaaggcaggcctggtggtgaccaaatctctcagcatttgcttgtctgtaaaggattttatttctccttcacttatgaagcttagtttggctggatatgaaattctgggttgaaaatccttttctgtaagaatgttgaatattgagccccactctcttctggcttgtaggatttcttcagagagatccgctgttagtctgatgggattccctttgtgggtaacccggcctttctctctggctgtgctttaacatttttttccttcatttcaaccttggtgaatctgacgattatgtgtcttgggtttgctcttcttgaggaatatctttgtggtgttctctgtatttcccgaatttgaatgttggcctgtcttgctaggttggggaagttctcttggataatatcctgaagagtgtcttccaacttggttccattctccccgtcaccttcaggtacaccaatcaaacgtaggtttggtcttttcacatagtcccatatttcttggagactttgttcgtttcttttcacccttttttctctaatcttgtcttctcgctttatttcattgagttgatcttcaatctctgatatcctttcttccacttgattgattcggctattgatacttgtgtatgcttcacgaagttctcgtgctgtttttttcagctccatcaggtcatccatgttcttctctaaactggttatcctagttagcaattcatcgaaccctttttcaaggtccttagcttccttgcgttgggttagaacgtgctcctttagcttggaggagtttgttattacccaccttctgaagcctacttcggtcaattagtcaaactcattctccgtccagttttgttcccttgatggtgaggagttgtgatcctttggaggagaagaggtgttctggtttttggaattttcagcctttttgcgctggtttctccacatcttcgtggatttatctacctttggtctttgatgttggtgaccttcggatggggtctctgagtggacgtcctttttgttgatgttgataccgttcctttctgtttgttagttttccttctaacagtcaggcctctctgctgcaggtctgctggagtttgctggaggtccactacagaccctgtttgcctgggtatcaccaacggaagctgcagaacagcaaagattgctgcctggtccttcctctggaagcttcgtcccagaggggcaccccccacatgccagccagagctctcctgtatgaggtgtctgttggaccctactgggaggtgtctcccagtcaggatacatgggggtcagggacccacttgaggaggcagtccttcccttatcacagcctgaacactgtgctggaagaactgctgctctcttcaaagctgtcaggcagggacgtttaagtctgctgaagctgtgcccacagccgccccttcccccaggtgctctgtcccagggagatgggggttttatctgaaagtccctgcctggggatgctgcctttttttcagagatgccctgcttagagaggaggaatctagagaggcagtcatccttgctgagctgcggtggactccgcccagttcaaacttcccagaggctttgtttacacagtgagggtaaaaccgcctactcaagcctcggcagtggcggatgctcctccccccaccaagctcgagcatcccaggtcgacctcagactgctgtgctagcagcgagaatttcaagccagtggatcttagcttgcggggctccgtgggggtgggacccgctgagccaggcgctggagagaatctcctggtctgccggttgtgaagaccatgcgaaaagtgcagtatctgggctggaatgtactgttcctcccggtacagtctatcacagcttcccttggctaggaaagggaaatcccctgaccccttgtgcttcctgggtgaggcgacaccccaccctgctctggcttgccctccgtgggctgcacgcactgtccatccagtaccaacgagatgaactggatacttcagttagaaatgcagaaatcgcccgccttctgcgtcgatctcactgggagctgcagaccggagctgttcctatttggccattttgccagctctacctgtgagcaacctcttaatgccataaacacccagtctgttttagtgacccaaattaagagatttggaatccagttgcctcacctgaccaacagtgagctgcttttcccctgtgtttccacggacgtaaagtggccagggagagagatccttcatgttcatgactctccctgatatgcttagtgatgctaggtgacaacacaatcaattctcctcaaattaatgcacttacataatggccaatttgccacatttactgaatttcctgattgtcattttaacagctttcacaggagtactaatttttggttattaaagatgaaatatacctttctgaatattaactcagtggaggtggacataccttaggaactggggaaaaatccagaattaaagactgaaaattttctgaattattattttttcaatccaaaatctggcagtttgcatatgatagagttccttaaatattcttgatatacgtgggagtctttcaaataccattaaaaaaaatctattcaacatacgtgctttttttttttcttagtgttctcttgcatttttttcaatggctttatcagacagaattgcttattttgattgggaataaagatggttgaccaaatgcagctgggatgtgcctcttccccagagaggaagcaaaatattaagtaaatctgcacacttcaaacacatcttttgagagaaaacatgggaattcaataaaggggcaatggaagacactgtggtggaagagggaggaagcaggactgcctgtttggtattgctgggtgccacgactggcccctggacacagactggacccgaggaagtggtgagtgaaggaaccctaaggcaccacattcctgctgtggacctctgagatcctagacacaggagttccctttgggctggcaggcagagctacagggagaagatgcagaggcactgcttgaacctgtgtggagcccaaaaggcttcagtgtgctgggcagctgcagcaaaacatggctctaggtgcccacccccaaggctccgtgtcctgccctaagcagctgcagctcctactgtctgctgggccgggagatagcggagtccaggcgtgctcatgtgcccaacacaggccccgctgccattgccctgggaccaaggtgcatctgagccacatgcccccgtgtttgcccctccttcccaagactgcctgcctggctatttctgtggtggtgggggttggggagggcaggaggggagggggagggggagggggtgggggaagaggaggaaattcttcctaattcattctataaggccagcattaccctgatgcccagaccagacaaagacacagtgaaaaagaggaagctgccggccagtgtccctgatgaacacaggtgcaaaaatcttcaacaaaatactaacaaactgaatccaacagcacatcaaaaagataatacaccacgatcaattgggatctatcccagaaatgcaaggatggttcaacacacacgaatcaataatctgtctcatcaacagaacaaagattgaaaatgatatgatcagctcagtagatgcagaaaaagtgttggacaaaatgcagcgtcacttcatgataaaagctctcaacaaattaggtacaaatggaatatacctcaacataataaaaggctgtatatataactaacccacatcatactgaatggagaaaagctgaaagccttttctctaagaacaggaacaagagaaggaggcccactctcaccactcttatttaacatagtactgaacgtcctaccagagcaattaggcaccagaaggaaataaatgacatacaaatggaaagaaaggacgtcaaattgcaccccttcacagatgacatgatcggatagatggaaaaacctaaagactccccgaaaactcttagaactgataaacaaattcaatagagttgcaggatacaaaatctacgtacgaaaatcagtagtgcttctatgcaccaataatgaactagcagaaaaggaaatcaagagagtaacccctgcagccataagaaagaatgagttcatgtcctttgcggggacatggatgaagctggaagccatcattctcagcaaactaacacaggaacagaaaaccaaacgccgcatgttctcactcataggtgggagctgaacgatgagaacacatggacgcagggaggggaacatcacacactggggcctgttgggggtggggggcaaggggaaggagggcattaggacaaatacctaatgcatgcggggcttaaaacctagatgacgggttgataggtgcagcaaaccaccatggcacatgtatacttatgtaacaaacctgcacgttctgcacatgtatctctgaacttaaagtaaaattaaaaaaaaaaaaaaaagggcaaccccatttacagtagctacaaaaaaaaaaaaagtatctaggaataaatgtgaccaaggatgtgatagatctccacaatgaaaacttcaagacactgataaaaaaaattgaagaccacacaaaataatggcaaggcattccatgcctatggattagaagaatgaaaattgcttaaatgaccatattacccaaaacaatctacagattcaatgcaatcccacccaaaataccaacgatattttttacggaaatagaaaaaaatatcctaaaattcatatgggaccccaagagacctcaaataaacgaagaaatcctgaggggttgggggaagcaaacaaacaaagctggaggcatcactctgcctgacttcaaaatatactataaggctatagtaaccaagacaccgtgatattgttatagaaacttaaaggcttaaatggaagacttgaaactataaaaataacaaaggagaaaagcttcagggcattgttctagtagggcaaatattttatgggtaagactacaaaagcacaggcagcaaaagcaaaaatacgcaaatgggaccatataaaactaaaaagcttctgtacagcaaaggaaacaatcaatagagtgaggagacaacctgtagaatgggagaaaatacttacaaactaatcgtccgataagagactgatatccagaatacactagacgttcaaagaactcaacagcaaaactcccccaaataacactattaaaaatgagcgaaggatcggaatagacatttctcaaaagaagacatacaagtcgccaagaagtttatggaagattgctcaacctcactaatcatcagggaaatgcaagtccaaactaccgtgagatatcctctcaccccagttagaatggccattatgaaaaggacaaaaagataagttttggcgaggatgtgaagaaaggggagttcttacacattgttggtctgagtgtaaattagtgcagacatcatggaaaacagtacggaggtttctcaaaaaactaaaaacagagctaccatatgatccaacagtccctcaactgagtatttatccaaaagaaaggaagtcggtatatcaaagaaagatttgcttccccacgtttattgcagcactattcacaatagctaagatacggaatcaacctaagtgtccgtcgacatgaatggataaagaaaatgtggtatctatgcacaatagaacattattcggctaccagaaagaatgaagtcctgtcattcgaggcaacatgaatgaacctggaggattttatgttaagtgacacaaggtaggcacagaaagacacaaataccacacgttctcactcatatgtggaagctgaaggaaactgggctcatagaagtagagagtagaattgtggttactagaggctgggaagtatagaggggaggggaggatagagagaggttggctaatggatacaatattacagatcgataggaggaataagttctagtgttctatagcactgtaggttgaatacagttaacagtatcgtatagtatatgctaagaaaaagctggaagaggggattttgaatgtttccagcacaaaggaatgataaatgtttgaggtgatggataccctaattactctggtatagtcattacacattgaatggatgtatcaaaatatcactctgtacctcgtaaatatgcacaactactatgtgtcaactaaaaaataaaagaaaaaaaaggaagacaaataccacatgatctcactcatgtggaatcttaaaaagttgatctaatagaagcagagagtagaatgatggttgccagaggctgggggtgacggggcttgggggggatacggcaagggaagatgttggtcaaagagtacaaagttccagttagacaggagcaagaagctttagtgatctattgcacagcatttctagttaaaaataatgtattacgtattttgaaactgctaaaagagtagattgtaaatgttctcgccacaaaagaatgataggtaggtgaggagatggatatgctaattagcttagtttaatcattccgcattgtatacatatatcaaaacatcgtattgtaccccacaaatatatataattattttttgcttttttaaataaaataaatttatagagaccgctgcttctggaaagatggaaagatggtgtagttgtacatttccctattcttcccactaagtacaacttaaaattctagacactatatataaaacaaacataaggctggaagtggagagaagaaagtagaccaactggggacctcagaacgacatggtggtgagttccttgggttttgtttttgcctgatatatcccaaacttggagctgaagaaaccagctactagggaatgccaaaatgcacaggcaaaacgaaacaaaactaaacaaaacaggtgaagaaacaaagaaataaacctacaaaagcctgttctgcctagcctaaggatcagaaaagaggcagccaaacaagacagaaaatatttttcacaataactgctctactccagtcgaacacctcagaaaactctgtggccccttccccactcatgccagcaaagatctagtggggagcgtagacttccacattcatttccatgggcagagacgagggcccctttgcgctatcatatcaccaggattatgtggagatctccaacatatactcccaccaggccataaggagacacccctctttgtccctgctgggatgatgtcaggattttcaccaccactcagtgttaaggatgccactcaatccatgggctaaagagaaaatcttccagatgtaaactaggagagccattatggaaaacagtgtgaaggttcctcataaagttaaaatagaactaccatatgacctagcctccccacttctgggactatattcaaaagctatgaaatcagcatgtcagagagatatctgcactcccatcttcactgcatcactattcacaatagccaagacttacaatgaacctaagtgttcatcagcggattaacgaataaagaaaagtgtggtctatatacacaatggaatactgttctgccatgtaaaagaaggaaatcatggcgtttccaacaacacgtggcatttccatgtgtggaaggtgaaaaagtcgatcttttagaggtagcgagtggaatggtggttaccagaggctggagtttgggggagtgggggagatgttgaccaaagggtacaaactttcagctagacaggaggaataatttcaaaagatctattctacaccgtggtgactatggttaataacaatatgctgtatacttgaaatttgctgagagtagtttttaggtgttctcaccacacacaaaaaatggtaagtatgtgaggtaatgcatatgataattaccttgatttagccatttcacagtgtatacttattatcaaaacatcatgttgtacaccacaaatatatacaatttttattggccaatttaaataaaaagaatactgaagactaaatcttccaggacttcagaaagtgaattgaactgaatggaaatgattataaaacatgtcaacatctgtggtgcaaagctaaagcattgttgaaaggaaaatttatgccattaagtgcttccattagacaaatggaaaattatcaaagcagtaatctatgatgtcactacactaaactagaaaaagaggagcaaaagaagcagaaggaaggaaatgtgaaagataggtaaaataatcaatgaaatggaaacctgaaaaataatagagaaaatcaataaataaaaaccgaggtctttaagaagaccaacaaaacatacaaaactcaacaaagactgacaaaataagcctatgatgattcactgcctctgtgcatatttactgaatgactttaataactatagttatgaaacttttcatatagttgactttaggaagctaagcccttatgttttcaatatgaatcatacaatggaaagaagaaataaaagaaacatcagactcttgacttaaatcacaacaaaatttgatttttgaactaacagccagatccctgcctttcaccatagaaactagtttctgcgatgtctttcacaattaactcgatttcctttctaagaggtagacatgatacccaaataactgcactatgagttcaatttttcatgctacgagcgtgtctttgcaaattggaaagttcttggagacaaaatttcccatgattcatgtaatgctaaaagtaaggtagttgaaatttttcagactttgaatcaattattcttccatactgttagaaaggtcttgtattacatggacatttgagtggcgacttaggtgaaggccttctgcgttctgtaaaatattatatatgtggtctcataattttctattatgcgttatgtaactgaaataacaatacctttttatgaggtctccaccaaaaatgtgtgtgtgtgtgtgtctgtgtgtgtgtattctacaagatccgagccattttttagttggccaaattaataacctcagatcctcttaataattatcataaactgccttttttgctattgctgaccaattaattctaatttcaggcaacgaattttgtcaatctgattagactgttagagggaaaattcttatcaaattcatcatgtatttgcttacatttctcttaatattgtccagtttattctctttacatttctttcaacaaaacgaataaacagcttgtgctctgtctctgccacagcaaatgcaacatcgacaacaacgaggtgggggagggggtgagatgagcttttttacatcaaaatgcccatccataaaagcagaaatgaattatagaattagagaaatcaccactttttaaccaacaaagtaataatcaaatcgggcaggagccctgaatgaatactaaggccaagaggtaaaattctgttggagagcagaatatccgcatgtcatcgaaatatcctgacagactacttattaatcacaaagggagagaagtaccttcccagtgtagtactctgtctgaaaaataccttagttaaagtgataaaactgatgaatacaaacagcatcaccgataactagagaaactggcgttaggagcctccagatgtgacataatgtgaactgctcatcaccttcttaatattcgtacccaaagtgtcaaacataaatataaacaagaggcaaatatcaggccagcccgtattgtgggacactttacgagacaacaggcctcggctctggaaaaaatgtcatcgtcatggaaggtttaaaaaattgtttgggggtactgtttgcaattagaggacactaaagagacatgacaactgtgtgcagtgtaccatgcttgactggattgttgatcccccaaaacgtctttcaaaaggatattattgggacatttggtgaaatttaaatatgaactgtatgtgaacttggatagtattaccccttcattgttacatttcttcaatgtgataatggcactgcggtttcataggagtacattctagtgtttaggaggtgcatgctgaagtaactgggtgaagtgtttggaactgctacgtggttaggcaagaaaaaaaattactgagagataaagcaatgagacaacgtgaatctaggcatcagattgttcactgtattaccccctcagctttgtgtattttcaaaataaaacgttgaggaaaatagattcctcatatttagagttacgcactgaaatgtttacaaatcaaataagatacattaagatatccacgtatgatttttgtacttttttgatttctgatatttgcttgaaaataatctggaggagggggagaggagaggatatgtatgaaatgtgattggccatgagtcgttaatggttgcagttgggagatggatatttggaggttccttatgttatcctctcttgtgctgtcgttctcaaaatgtggtcccctaccagcagtgttagcatcaccagggaacttgtttgctaagcaaactcggccgagcctggtggctcacgcctgtaatcccagcactttgggaggcccaggcgggtggatcacctgaggtcaggagttcgagaccagcctgaccaacacggagaaaccccgtctctactgaaaatacaaaattaaccgggcgtggtggtgaatgcctgtaatcccagctactcgggaggctgaggcaggagaatgtcttgaacccgggtggcggagtttgcggtgagccgagatcgcgccattgcactgaaacctgggcaacaagagcgaaactccgtcaaaaaaaaaaaaaaaaagaaagaaagaaaagagaaaaagcaaagcaaagcaaagagaaaaagcaaagcaaagcaaagcaaagcaaagcaaagcaaagcaaagcaaagcaaagcaaagcaaactctgggtcccaccccagatcttgtcgtctgagaatacagatacggagctcagaaatctttgttttatcaagccctctgggtgattctgatgcaagctagtgttttaggaccactgctctaatgtaccatacacaaaaaaattaatacaccatagctaagttacatttactatgggagaggaaagctggtttgacattagcaaagctgtaactggaaggggacccgagagaggtttgtgtgttgctcatatattttgttgcctgttctagatactaattgcatgcgtatatttaatttttgaaaactcattaagaggcctggcttggtggctcacacctgtaatcccagcacttttgtcgggcggactgcttgggcccaggagttcacgatagcctgggcaacatggagaaaccccgtctctacaaaatatacgaaaattagctggggatggtcgtgtgcctgtagtcccaggagttcacgatagcctgggcaacatggagaaaccccgtctctacaaaatatacgaaaattagctggggatggtcgtgtgcctgtagtcccaggtacttgagaggctgaggcaggaggattgcttgagcccaggaggtggaggttgcagtgagccaagatcacgacactgcacttcagcagcctgggtgacagagtgaggggctgcttttttgtttcttctttgtttacaaatcaaataaagaaagcagcccaaggaaggaaggaaggaaggaaggaaggaagggtgggagggagggaaggagggagggaggaaggaaggaaggagaaagagaaagagagagagaaagggagaaagaaagggtaagaaagaaagaaaggaaaagaaagaaagagatagaaaactgattaagatatacatttatgattttttaaccttttggattataagttaaacttggctgaaggttttggaaaaaacctgggaagttacctaggctgggtattctagagataatggattctcccataactgatccatagattcagtgaaaatgcagtccaaatctgttacaaccgagtttttgggaaacttgaaattgcatgctaatttatgcagaaggacaaaaggcctaagacattcgggggtggaggtggtgtggtgtagggagagaggaagaagaaaggaaggaaggaaggaggaaaggaaagaacggaaaggaaaggaagggaagggaagggaagggaagggaagggaaaggaaagcaaagaaaaggaaacgaaaagttaaggaaaacacaaggaaacaatattaatatggaaatgctggcagcattccttttaaaatccggaacaacccaaagaagcccaattttgctgtcgctattagatctggtactaaatttcctagccagcgctgttaaaaaacaaacagccaaccaaccaaaaaaaaaaaaaaaaaaacaaacaaacaaaaaacccccataacttcaattctatttctactatgcataaactcacagataatcccagaacgcctactatagagtttagcatgttgacagactttaagatcaagtcacgtttttaaaagttaaaggcatttctgtaaattcgatccaaatagaaattgtccttttaaacagacatcaagtacaagaacagcaacaatctacagtatcttggaataaatacaataaatgatgtgcaagatctaaatatacaaaagatgaaactaaaaactgaactgaaagattaaaacattaaggacgcacataagtggagacatcccaagttggtgaacaggaaggctgagtattctacagatagtagattctccccctaactgatccatagattcagtgaaaatgcaatccaaagctgttacgactgagtctggggagacttgacattgcatactaattcgtgcggaaggacaagaaggcaaagaatggcaaagaatagcaaagatgtgtttggagatgatgaacaccatgcagggacttgccctagcagatgtcaagatgtattgcgaagtgaaaaaatttaagacaatttagtagtggtacaggaatagacacatttatctgtggaacataacagggagttcataaacagagacacacaaatatggacgaaagtgtctccaagcattgttccctgggggttgcaaagtcaccactgattgggaatccgcggcatggaaatatggatggatctttaatcacatgctgaatttttaaaaggtaaattacaaaataccaagtacatgagttataaatgcatgcacaccaaatatttcacacccaaagggagactaatctgggaaacaagccctggggagcataaagctcaacgatcacttcacgatttcttgactgacctagtacagggagcgggagaagctacggggaggtgatgggggcgtggcctcagaacgtgagcgtcaagagatctcgaggttcattggtcgccagccacagcggcgggaggtcgaaggcagcgcaagagctcattggcctttgtggcaagagcgggaagggaagcagaagctggatcttccctcagaccgtctgactggttctgacttgccggaggctgaggcaaccacaggctgacatcagaattaggtcctcgttctccacgcctcttatttcctcccaccctcctgagccagattcccaaccccttcccctctctgctacctcagcagggaacccccaactgctcctgatgtcccatcgcgccctcagctctcccggaatccctttcgggaggactccttgctccagccccctgagccctggcctttggccaatgaggcagggctcatgggattgcttttgattcggaggtccgggagggagtggatgattgggcttcctgaggaagtggtgcgctccagggtggtgggactgcgtgtgtggggtggggtgggggtggggggaaatggtgtgctcaagcacaattgttgaagtgtggagaggattatggaagattttggggaggctgtggagggaatgtgtgggttttcatgaaagcagaaaaggtgtgtgagtccaagagaaacactactgcactgaggagttccctactggctagatcagaacctgacacttcataggaggctcaacaggtacctgctgaatgaagaatcaagggaatcggccgggcccggtggctcacgcctgtaatcccagcaccttgggaggccgaggcaggtggatcagcctggccaacatgtgaaaccccgtctctattaaaaaatacaaaaaatggcggggcgcggtggctcacgcctgtaatcccagcactttgggaggccgaggcgggcggatcacgaggtcaggagatcgagaccatcctggctaacacggcgaaaccccgtctctactaaaagtacaaaaaaattagccgggcgtgatggcgggcgcctgtagtcccagctacgcgggaggctgaggcaggagaatggcgtgaacccgggaggcggagcttgcagtgagccgagattgcgccactgcactcccgcctgggcgacagagcgagactccgtctaaaaaaaaaaaaaatacaaaaaattagccaggcgtggtggcaggcacctgtaatcccagctactcgtgaggatgaggcaggagaatcacttgaacccgggaggcagaggttgcagtgagccgagatcacaccattgccctccagcctgggtaacgagtgaaactccgtctcaaaaaaaaaaaaaaaaaaaaaggccgggggggatgcatgaagggatgaatgaaattagtaactgaaagagggccagggatccaggagaacaatatgatttcatgggatacaagagggaaatcagctcaaagggggagcaagggaataattaagtgtaaggtggagtacaagaaaaaaatcagcatgaaccagcatgaaatgtgaggggaaaattgaatatagggcatagaagagactgacaatggaattgagtgctggtggcacaaaatcctgtgcggggagtgaatgaatgcaggaggttctgaagagaattggtgaagtggatgccaggaataatacttgggtttggcagagtgcaggatgatacacaagaagggcgtgtagtaatggtggaagagggcaggggagtgcatgtgcatgcctgaaagtggggtctatggtgaagtgacggtaagcaaggagaataatgactgcattgaatgggtatgggatccattccaagagtttcttgggagggggctatgtgtgagtggggcttctgggaaggaggcaacatcagcaagggggttgcagtgaaggttggcgaaaaccatgggagaagaaggggagggaaggcaatctgattccagcggtgagaaggatggagaaggagcattgagccacctcagatagggttttccaagggcagaggaagtacgttgggggtaggggatcacgtggccattctgacctccgctcctgaccctagaagcatggatcccgtgtgtctgaacctccatttccctatggatgtactgaggacaaataaatacccgctgcaccctgctgcccctctgactctgaatgcaccacagggcgtcagactggagccccatgggggactgaacttggccccagaagagctataggttgctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcagtgagtgtttctggcaagggagggagccagagtttgggtggaggaagcatgagtggttctgtcaccagtcctgtcacagaattgcagtgcgacctggggcaaattgctccctggaccttagtgtgcccaggtgcaaaatgtcaccaatgttgtctaccaagtgtttgtaggaaggagagagctgggggacagggcaatcgaagagctccatggtgagatgagacctgcgactggaggtggggtgaagtggggtggggttgggggaaagactcaccaaagctgttcctggtctttcacagctgggaaggagaacaacatgctgcagcccgagacccacatcttcacagcccccgaggaggtaaggagagtcggtgaccagtcgggcaggctcccacccagccactgtccagacatctttcaccgtgtcccaaggacatgggtttcatctccaatcctatcaccagctcaccatgtgaccttgggaaatatcacttctcctccctgggcctcaatttccccagttgcaaaatgaaaggcaagactggctggtcttcaaggtcttcggagctctgacattctaggctcctatcctcatcctaaaacatgtccacacctcctctctccatggctggcctggtacctgactgcaacctgtgctctctgcccctgcaggggagctcccaaggggctctgctgcttggccaggccccagaacctttgtctctgccctgtactccagtgaccttggagcagcaactggtttctccttctggggatccccacagggcccctgccctgcccagcatgtgagtagcgtgaggaccatggagcaggttgtgtcttgtgtgcctaaccttgtccttgatgccgtgggagatggaggaggaagagggggaggaggaggaggaggtggtggagggggaggaggagcaggaggaggaggaggaggaggagggagaggaggaggaggagaagaaggaggagggcaaggcagcatctaatactaacgggcgaggacagggctctcctagctttgctattttctatttgtgagactttggacaagtgactttatgtgtctgaacctccatttccctatggatgtactgaggacaatattctatacccatagcattgaaaagggaacgggcacaaggcctgccacatagtagggcttcaacaaatgggggttgttatgccacatgaaacaggtggatgggatagaaggtcctgctgaaaggtggggtccgtgctggcgagggccacagaggcccagggcaaagcccagaggccattagagaaagcttcctggagacccttcaagacccatggggactgggcaatatggaagtgagaaccagtccctgaagagggacagtaatcacatctctccaggtgttttgcaaattaaagcacggacacctgtaatttcccatgattttcaccattgccctgggaggaaagagctggtaggaataagcgtccctgtcaggaaaaagaggtatggaaaagaaacctggccaagcaggagaagggacttgccccagccacaatgactaatggtccagcaggcattgggattctcacatccagatactgcaaaatcctgcccctctttctgtctactggtagtatgtgtccgccagcggatttaatcccctggcctctcctttccttgtttctagatgctcaactctgatcctccagccctgtgccacccttgaccctcttctactgcagccacaggtcctgggaaagtagtggggtccagaaccctgggaggggcggagtttagtggatgggaagagcagaaggccttggtgggggtgggggaggaggttgagggaacagggggctgaaggggcacttgtcgtattgggaagaggtgtagtttcccagtgcctattctctcatgcactttcctttccaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccaggtagcctgctccctgaaaggagaatacagggtgggaatagctggggaatgggggtcgttgtggtaagcaggttctaactgaaaaatcagagtcagtaagttgaatctccttggggccaggcacccaagctcctcagtatgactcccgagatggtagttgagggctgtttattgaatcttcggtttattgagctttgtgtgcaacagcaagcgttcagtgccctgatgtcaagaaagaaggaagctgaggccctgagagtggcagggacttgccctctctgatatgcatgcagcatatcaagtggaagaaccggccctcttgactttcagcccagggtctatgctcagccgcctgtggcctactgtggtctggggaggacatacagaggtgataaagggcttggtctggaaggaggtctggtctctgccttccgggagcttccagtctagatgtggagcctggatgcccttgcaagctgtgttttgtggccaaattttaacgatgtgcccagagaggaggggctggaggagctccgaggggggataaacaactggggaggctgggagggaaggctaggcattcccagatccaaatggtgaatggagcatggtgtgtcagtgaagaaacacccctggagggactgctggaacagaaagggatgaggctggagaggataccaatcacagaggtctgacaggtcaggcttaggaggctggaccagcaactgtgggtagtgaggagccagggaacgttttctgagctagggagaacaatttcagagaccctgagcttgacaaaaagagttgtggtggctttgatggaaggattgggggaggcaagatgggagatggggaaatcagagaggaagaggtctatgcaacagtccaggtgacaaatctttggttgggtgggacgcataaaaacagtagatctggaaggggatgtggatgtgacctggctctggccccttcctttctgtccacagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggca

SEQ ID NO: 4734 - DNA, 71660 bp, human
ctgtcctctcggcctggcacacagcgctccggccgccgaatgcccgtggacgcgcatctcttcccagagttcctgcttcctgggccagccaaagccgcaggtgagaacgtccgcggtagaggtgacacccagggcctgcgggtctcagaggcccggtggcctgctcctctcctccttgcccaagaaacccccacgggggcgcctgcagcggggacaccaagtgctccccggagccctgggagcacttcttctgaggcatggagcccctgctcaggtgcttctgaaagttcctttgtggaccccagaaacccctaggcaactgtctgccccgccccgcgcccccgccgccccccgcccccgcagtacccctccggcccccgacatccctgatgcgcatgcccaggggccctgtgagctagaaagtagctgagctggtgcagtacctgctggttaagaaccggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgcatactgcaaagttttgtttgccttaattaactttcttttataatgatgatcattttacaggaaataaactggttaaaactacatgatgacagaattatatcagagttgaaacaaacgccatacctaagcatttttttcaaaatcctttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattagacaccttgctcatcgactcatttattcaacatacatttactgactacctactatatgtgaggcactgtgccgggcgctggagatagaggaatgcaccagactcagcctctgccccacatctgagagtctagatggggctgtcatgtaagtaaatcagccagatgtggcagtttgatgtattaattgccgggatgaggataaggaccaggtggtatgggagcccggaggagagacacttaaccctgggtggtggatgtctgggaacaaggaaggcttccttgtagtgagatgccatctgagatctgaagcactgaaggagtagtaagtgcagtgtgtccccgaggcagggtattgtgggcatcgggagcattccatgttcttcagtggaactggaaggttagaatttggggagactggggagagatgatctgggggtggggacctgtacaggagccaggatcctcagttggtggacttcacagctgagagattaaaaaataatagtaataaagtaaacgtgtagtggaaagtgactctttggaaagcagctgctcttggctcttggatgagccagagaaaagactccacctgtggcatgcctagaagctgtcctggcctcctgtccctgtgcagtttctacagtgcacacagcaggtgctttacattcagcatccgtaaggagtgatgggcaagggggtaagtgttgcactcaccggagctgattcccagaagctactgagcagatgttcgcccctgaagcctgggagagacagagctcagtgggttatatgactacggttagttgttgttgttgttttaagaaacaaaggcctagatgttagaatggataagttatcctgtttatacagagggaaaactgtttgtaggggtgagagataagtctagactagcctggagcgaagccaggaagagccttgatggctcaaacctgatttggctggcccaggaagctatggaggtttcctgagcagggaaggatctgatgaaggccaaaccctaccaaaattacagtggccagcaccagcgtggttttcaaaggaccagtattctccatgccttagaatggtcctggtgggtatagtgatcataataactagcctaaaattatcttcagttcttagagattgacatgcatgttttacatccctgcccgttggccttgcaaagcctttttgtgcccttcgtcacaaacactgtgggatcctggcaccagttctctcagggcctaccctaggatatgtaggatccagagaatattacactgtaacccctcacttgcattcctctgctggcgtcagggaaaggctggaggtggtggtggtggtggggtggtgcagtgggggtgggggtatcataatgtgaaaacatgcaatctgaggtgaatggggaaagggttttggaagggctctgtcttagtttggggtggggatagttggagctgattatgtgtacctcaatctgaggcctttcctcaaaatcccgagccgcctgctctccatttgaagccaataaacattgtcagttatgaagggtatatgcatttgggcagggagagatgatattttttctgcattgttacactgaattgccctcctcaaggccatagcaagatacctgtggaaaaagcattgtctataggtcacagtcctaacaggtacttaggaagaagcaatgctgtcccatgactataaccacatacatgagtccagatacgtatgtatgtcttaagctcctctccatctccaacagccaaccctatcccgattaaatatctttctcaagaggtgtaaaaagatattgacccataaaaccaccaaacacttccagatttatttcagtcttaatgagagagaagcaagagaatgtgccagcagggaggatgggtcagcctcctgtgggagtgggtcctcgagagtgttgctgtcccctgggcatgctgagacactagagctgcccagcctgcaaagctgaggaccccactctgggagcacccgtgggactcagctcctcattcagaaagtgaacagatcaatgtaatttgacgtgggcctctgtgaggtcctcccacccattactgtgtgtctgaaaggcccgccgtctctccattgaccttggtgattgcttgtgttgcaatttctaacaggttaaaggaacaagtatgctccaaccccctttgtagaattctcctgctgatactgtgttgcagcacatatcaaggtcacctcaggaaggcaaaagaaagaaaaaatgaagccctcctcttatgaaaacgagcaacgcgtaggtggagacgaggtcgtctgttggaagggctctctctcttgcggtggggtaggggggcctgggggctctttgtcagtttaggggttaatgccttttctgagatccacagattcttcctccacatgaccctcccgcctctgcatataaacactgcccagttttcctccgatatgaagaccgtgcgcattgctgggggaagagagatgttattccgtcgtcattcctgcatgtaagtgcctcaccagggtccgagctgccagctgtggaaaactcaccattgattggccacagcccatcgccaccaggacccaggaacaagcagcgctgcctcgaggaggagggcggacagcctaacagggctcaggaagatgctagctctctccctccacaaccccaccaccaccaaagctgaccacccccacttcacccgacgtgttgaaagttacatcaaatgccacaaagcaaaaacagtcaagcgtgccagcatttatttcaggcctggtgactgggacactgcggcgagcaggggcatggagcagcagaaggggcttggtcaccgttcatggctctgtgtctgtggctccggtggtctcagattccgagtgcccggtatcctcccctagggaggaaagcagagtgacaagtggaccctcgggagccctggggatttctggcttggcctgaggttctcttggtggaacaggaaggggaggcggatgggcttggtggcgagcagtgagagaggcagaggcgtgctccgaaggagctctcacctgaaacacttggtgaaacatgccagggctctctggaaccggctcctccaagaccctcgcagaagagcaggttccctgggcaagcctgtgccaccggatgggtcctccgtggcgtcagacacagccacccattcctcagggtcgttttgcagccctttcacattctgaaagacagactaaatagccagatcctaatgctccctcccatccctggcttccttcaccccacccagcaactgttgtgtgtgtctctggccctcttgcaggggctggggatgcagcagtgacctgcacagaccaaagcccaacctcctaggggacattccaggacaatggagggaagccagactcaccaggtcagcaggtggaaggaagggagtgaagatcatgcttccaggagtgtgtgatgtgccggtagggaccgacaggacttcgttgaagacaccggcgaagctcgtcactctgccgggtgcaaagaggccgagggcctgccccctccacgccccattcagcccctctgcccctgccccatcgtccctccctcctacagccttgtgctccagcaggggatacatttctggtatgtcacattccgtctgttcctgtgtttcttactcccactcctccaatctttctttcctttgtttcttcctcctggccctcccagcaggctcgagtcacgcttctgcttgctgagcagaacagccccgagggtcctcctcgagagaacatgatgtgtagaggtcttctacaggtagctcattttatttggccatgaatggttcattgcatgccaaggtcacacatggtcctagtttgccatgagtgggaccattccggttttaaaacttaaaggcccctgtcccgggaaagctctcagtcccagggaaactggaactacttcattcatgtggacactattgtcacattactgtgcactgtttttctcacatttaacagttggaccttgtagatgaaattgtaagagtgatcctgatacctaagaagtagacatttatgagtaatcgatgtgtattgaaggctctgtatatcttcatagtgtggaggtaaatgcagcattatgtgtttgcccctgaatacatatccactaaaagcctatgattggacctcagccatcacatctgctcttggggtgtcacaccagagttctagatggacccagaattgcagagagacaaggtcaggggaaggagccgggaaagaggttaacaagaccacagatgctgcagatgggactcacacgaagatgtccttcccaccagccaggccatcgctggctttgtaaggtaatgagattagcaacattagaggtgctgaaacacagcctgagcggtcacttgtaccgtatgctgcagagaggagggttcaaatggtttcagacagccctgtgattcataggattcgtgtgcaaatcagaggtaaagagcccttagctttcatgtaaatacgtaattccctctgacgtgtacaaaaattctcctcaaaatcttgtgaatttccaggcaagtgttgtgaaatacttagaaactcctccaagaagtgagcaggtctcattgtctgtcctatctcccttttctctccttgaatctactccagttaggctttctcctacaccactccactgaaacttaggagttaattgaacatgaaccaatgaacaagtgaaagtaatgtttcttatagttgtatatgactagctatgtgattaaaatgaccaaaccggcaagttgtatttaaatgcttaataaaagctaggtttaaattgttaacttaaaaaatgaatagaaatgaagacccaagtaactacactgtcatctcccagcacaactttcattctcatataaagaaactcattttctaagtaggaaggttgttccaaactgctggaaattcccaggaagaaaggcccaggttttatggagcttccacctgtttccttgtagacgcagccaactgccaccaggtggcagaacaagatgagaaaaccgtgccccacggagtccctgagcccctgctgctgcagtttttgagtgagttttctcaggggctggaatcactcctggggaaccatcccaaggttctgccctcttaagctattccagggtgcacccagggcctggtccagggtttctgacgtctatgatgacgcttaaggcagtgacatcgatcagccgggcctctgggctaggagacccagttcacctcctcattagtaaccctgggatgtggtagtaggtggctttaggcaggatgaggggccagttgtatctgtcagtatgtcagggtagtgacatctgtgattctgcagggacatttgaacagcagggaatcagaaacgccagaaagtgagggtccgcaacacaaaaccttgccaactgctgtggactgaattgcgttcccccgccctgcaattaatatattgaagccccgacccctaatgggactgtatctggagctagaggctttaggaggcaattaaggttaaatgaggtcataagggtggagccctgctcctacaggattagtgtccttatgagaagagacgccacagagctcattgtatctgtcagtatctcgaggtagtgacaactgtgcttctgcagggacatttgggtagcagggaggtctcttcttctctgcactgcatgcacccaggaaaggccatgtgacgtcttagcaagaaggaggcaaaccatgaggagagccttcagcagaaaccaaatcggccagcaccttgatcttggacttcccagctggcagaactgtgagaaaataaatgtctgttgtttaagtcacccagcctgtggtattttgttatggcagcccgagcggactaatacaccaacctagcggtttttcaaagaaaggagtcccgggctggcccaggaggccaggctgctcagtccccgaagcctgatggcaggtgaggtggacaaccctgttgtcccgcccagtaacatttccttttttttttctgaatctcctttgagaaaataagctgcctctgtgcaactgccttgaatggacccagagttctgcaaagagtcagggaagggctgtgagtgatggtgataagacccgccccgcaccaccctgtggatggatgggatttatatcgagaaaggctacgaggtcagcccctcgtagctttataccatgtctccctcagctgagattaaacaagtgtgtagggattcaagaaaaagttgattttttaatttggagtggttgttacagggagtaggggtcaactggattttgccagccctgagattgaactggataaattacaggtaaattatatgtgtgaaagcactgggtacatgagaggatctcaatacaatttcgttgacttgcacgcaagtttcgcagaagctcctgcaagaggcgaagtgattcttattatgacaaataataacagtttctttttattaaagacctagtaagtacaggtatatcacctgtttacaatactgtcttatttatgcaaataatcctcgtgtatgaaaacaatacagacaaaacaatagtctcccttgtccacccctctccgtcaccagccccctcagcaatggtttaatgtgtttcctcaaaaattcctcaatcgatgcatttacatacacatacatgcactaatagaaacatacgcttgtcttttatggggccataagatacagactggctcaggatgcacgtattgtgtggcacttgatttttgcattttacagcaagtctgggtgaacttctcctgtcagttcatggagaactgtctcatcatttttaacttctgcatagtgttctaagtgatatgccataattctttaactacttccatacacaaggaccttcacatttttttcctcaacttttaaagttctcaaaagtttttccaatatctttgtttgcagaggatgtgtcgctctagaagagatacacataaatagaattttggcacaaaaccctacaaatatttcaacactgagtagccgttgataaatggatctgaaaagaggtggcagcaatttattctctcaggagcagtgtaggatagtgttcattgtccttcaccgtcgctcttgatgttattcatccctttaactatttgctaatctggtggttgatatataaaaggttttgagacaaagccttccttacagaatctgtgaaggtccagggctggtcatgcctgcaagcccatactcagatgtcgcctccagtgggctgggtggggagaggctgagaaaggcacaacagagtacaacagagagtgacaggaggaagtttcggggtccatgagaaggctcagacagggcacccactcagccttggggatgttaatggagtcagtggaggtttcccagaggattaggtgcctgaaaggcgtgaggaaagaaattagacagggaaagggagaggaggaacagcacttgaagcacaaagaccaggccactgaggtgattttggaaactgcaaataagcagacccagtttctattctgtgcacttgtagcagtcaaggttggctaccatgaaacggtgctggatcagaaacgtgtgtcccagtggagactctgagttcctctgctgcagttctctagaatgagggtgctcaatcaggggctagcctgagttccaaggtccagcccttgaggatcttctgggttgcatccaggccctggcctagagtttctgaagtctgtcatgggacataagatagtgatacatatatatatagtctcctaaggacctagcctgggagactctagtcagctgcccacccattctgtagctctggggtatgaaaagaagcaattttaggcagggtgagatgccaatggtgtcatgcagtatcttagggggtagtgagggtatccttagaggatactgaaaatacttgcaatggggctcatgggaggcataatagcccccagggcagcagtgccatcaggggacttgcaactaggcagctggctgacacagcaggtagctgtgaatgtagtagtcccctaagccacggggtcactaaatgtgtgagaagaacaagaatttggaggtcatttagccaaagatttcagtatgtcaatagggcaatggaagctcaagaaggtatagcaacttgctcaacacagagagaaaatgtatcactatggtgagacagtgaagggaggacactgtgactaacactgacagatgaaacctgtcttcccctgaacctgagaggttctagaaatcaagagcctgtgcaaatgggtcatcacagcaaacagcttgaggaggttcatggcagccaggtcccaatcagcagcagtgttgtgcctctgaggatataatgtgtgaggctgtgttggtgtgtgaatcagcctctggtgggtggtgaacagggggctccaggctggcgttcgctctctctctctctctctttctctctctctctctctctctctgtctctctctctctctctctctctctgtgtgtgtgtgtgtgtgtgtgtgtgtgtgtgtgtgttttagaggtgaggtccccttgacaccaagccctgctctattaaatcccctatgactacttgggttttgactgctgttttccaagttatggcccctcgtaacccactggattggttggacggtggtatcgttgcagacaagggtcctccctctgagcccaagggaaggaaggagggaacaaggtggcctcaaatcttgtcccctgggcctgagcctcttaagctacagtggcagcttcatccatatctgtgtcccacacagtctcatatcccttgccctacccacattcagccagcccagattcatttctggactggagaaaaggcctcagcacctccaggaagacagctctgagtccagacattgaaaacatctggttcctgctgagcaggaggctctgggctccaagctagaggaaataaaaggaatacttctcacccttatcccagatcagagagtccaggcacagcaaagctctggtggacacatgctcattgatttgttttcttcaataaaggtttattggtgccgtgctgtaggtaaagccctgtgtccaggtactggctgttccaggactaacaaggcagagctcatgctccagagatgagaacctgggtgaggacagtcatgcaaattaagctgccagagggggcagtctagcatgagaaatgctatgatagagaagagtacacagtatgtttgtgtgttagtcaaatatttcatcatatagatagggaaatggaagcccagaaaggtatagcaacttcctcaaggtaacacagagagaaaatgtatcactatggtgagacagtcaagtgaggagactgtgattgggactggcatggtggaggggagacatgttaccaagggaagaaggacgtgttctttttgagggtaggaacatcagagatcaaaaggacaagtgacaggctgagcaaggaaatggtggctccagaggagagccataatgcaaaggccctgaggcagggcagaattaacagctattttcgggggtactgaaggcaaattttagccacgctgtggagagagacgaggctgtaggagaggagcagagttgagatgtccagatggaaagtctgagggatgagagacaatgtcctggatagaaaggggctctcacagaatcatctcatttggatctggatggtatagaaggaagtctccattgctggtccaggatgagtcctgggctcccgtccctgtgcagttttctacagtgcatacactgggccttctaaacacaccaactctaaagcgcaatggtgaggtcagagtgatgcccacccaagctgttccctagaagccagtgatcggataccatcctgtgtggctggggaagctggcaaacagtgcataatgaggacattgatatgggttcatctagaataaaaccaggatgacataaagaagggctgggtttctagtaggggtcaaatgagtgtgaagaggcagaattgtggggtaaagatattggaatcaggcctcggcgagaggggaaggcagagagagagagaaagtgaggagagggagaggaagggagtgacggagggagggagggaggaagggatggatgggggcagggaggaagagaggaatctagggagggagggagggaggagagcatttggtcctttgcataagggatatggcctatgagctgcagcctgctggggctgcctccctcacaccagaatttttggaaaagtatccactgtgatgggcctctcttcctggagaacagacgcctttgtcctacttgctaggaagatatttttcctgcactgtttttgggttttggtttttgttttttggcactggaatgacccggagtcacccgggagctcccaagaggaggatgcagggtcccaggtcaactatattactactcatggctgccacttactgagggcctaatacacatcagacactctgtcgtgtggattacataagctgacacttatctttccaacggtcctgcaagttcaatgtcagtcaaattttacagggtgtaatctggagccggagacttcaagatacttgtccaaggtcacacagatatttactgacaaagctgggacttgaccccaggtctgactaaaacgtgggcgcaccatgcaccaccctggcacctgagaacccctcccagccttaatggagccttctgtgtcttgcacccagtccctagcccccagatattcctgctgtcttaattgttattgattgctgcataaaaaactaccccaagcatatcaagttaaaatgataagcagtttttctctgagagttctgtagatcagggatccgggtatggcttaactggatcctctacttcccagtctctcacaaggctgccagcccagggacaacagtctcatctgtaggcctgactggggaaggattgacttccaagctcactcatgcggctgttggcaggatccagttcctcatctgtaggctcagctggggaaagatagacttccaagctcactcatgtgattgttggcaggctctagtgggtcgctggcctgagggcctcagttcctctatggctgttggccagagactttcatcagctcctcgccagctggccttctccatctgggcaaacacgcgtgcaggaagagcctgagggagagaatgaatgccagcaggtcagaagtcacagtcttgttatagcctaagcatggaaatgacacgccatcacctttgccaaattttgttggttagaagcaagccactaggtccagcccaccctcaaggggagggaattccataggagcatgggtgccaggaagggggatccttggaagccattctggaaggctgcccaccacacctgctcctgcacccacctcagtatagtgagcccctttgggtatcaaccaccttgacggagcaaatggttgatgggccaccttggactgtgctatgtggcctgcatctatctgatcccacctctcttccagcaggcccaggactcgagtctgcctggccttgccttcctccccaaacctaccagctactcctggccactgagcccatgagatgtcacagcagctgaaaagggacctgctccctgtgactgaagcacacacccatcactcgggtgggactgggacccaggatggtgctccaggcctctcctggtaaaacagaggtgaagggctcagctctcccactgagacagggcccacctcaggagaacacgggtacaggtgggagagggctgggtccagagttatctgtgaaagctgcagagatgttcttgcttttaccctctgggttgggattctgggtagaatccccccaagttctccagcaggcatcacagaaacatctctaaggcaacgtgggagcacccatgccagagaaggagctgctctgaagctgcgtggagacccagaagtgttcagacgcctaagatgggggacctactctagggaggagaggagtgagtatagattggggatggtttgtgtgtctccaaaatgtatttaactcaaaagcagagagagatgtgaagcacatatagcaaagcatttttaagtagggatggtggctgctgtattcttctctctgtttttctgtaggtttgaaatatttcagtagtacaatactctaaaagtagaaaacagaagagaaggagggggctctcaggacccctggactccacatttcccaggcgtgtctcagagccaaatgcgtcaagctggggggtggcattgtgaacttgtgagtttcctaggaacccagtggttccattaggctgtggggatcgggactgcaggtggctggactcccatggcagaaccttagccaggagcagagccatcccggagaagcctgggctttttccagttctgggaagcatccaccagactcagctcttcccactgctgctattttcttgcaatatatatcaggggcagcttacaaagagacacggtgtcataataagagacaaacaacctgaggtgatggatatgaggccatgtgctggaggggctctctccaaggttgaggtgggggttgttgtggtcagattataacttaatgcctctgaagcctttcctgtggattctgtgacatcttctctccttctgacctcacctccctgtccctcaacctacagccctcctctccggcccaagggctatcactcagtcagtgcccatcagccaccctatatgaagtgtttgaaaccagtagcatgtttactgtccatcaaccattgtgctattgcaaaagtgactgggggacatgcagtactgctccaaggtacgaggacagtaacccatttggctaggtaccccgtgcctaactctctctccacagcgacccccttccctgccaccttcaccgaaagaggcaaaccataaatcacaggaggtggatattcatgtggagagggacatcaaatatcataacaccaaaagagtcaagtgtgccagtatgtatttcaggcccactggggtgagcaggggcatggagcagccgaaggggcgtggtcaccgttcacggctctgtgtctgcggcccccgtggtctcagtttccgagtgtccggtatcctcccctagggaggaaaacagagtgacaattggacccttgggagccctggggattctggcctggcctgaggttctcttggtgggcttggcggtgagcagtgagagaggcagaggctctcacctgaagcacttggtgaaacatgtcagggctccctggaaccagctcctccaacaccctctcagaagagcaggttccctgggcaagcctggtcctctatggtgttggcaaaataaaccaagggcatagtgtctttagctgagccagttccgttcaggaaaatagggaaaaatcattctagccagcactaacattgcttccttcattcgtcgggtgttcgctgggggcctgttttgtgtacaccaggatcagttgcaggtactggggatacagcaatgaactctagagatctagatcccagctctcctggggctgactatctgccacgctggagggaaatcaggctcaccaggtcctcaagagtttgctcttccttgggaaggctaaaaactgcagctgcccaccttgcaaagctgagagcaccagtctgggggatgcggctttctccatacagtcagatcaggactcagcagcagcaggaatgccagtgaagttcatgttttctgagaagtgcgatgtacatgtggtgtctgaaaggacttattgtcagaggccggcagaactcttcattgtgctgggcctctggctcagggcctgtccccccctgtgaaaatccatccccgtgtccctggcctggatcttcaccctcccctcctgtagatgagtatgctcttttcaagcagttgatgatacattctcgtaaactcccgcacgtgctgagatgcctcattgactagtatcatcgcttccctttcctctctcccgactcccccttgaacccactctaatcagcttccagccccacaacgcgactctcatgtagatgattaaatgacgaattgaaagtgatggtttctgattttcacattactctacttatataagcctaaagacttaagggaagatctatttctgcattgttatctttaaggtttactgaaattcaaaccggggtacttgccaattatatttttccccccaccagctccatcttcatgtcaagaaactcagtgagtagacaaccctgaaactacccctaaattcccagtgagccgaaccccagcattgctggggatccacaatcaaactccaggtttctcttctgtgcattagtggaagccaacgtagggtgcttgagggaagcatggatgtagaaaactgtgtctcacggagccctgagatttttagctataatttttgagtcaggctgctcagtcaaggctcaggctcagcctacgggagccttccaaggtcctggccttgaggatgcccaggggtctgtcaagggcttgacagaacccttttaggaccctgtgatgggccttgagacagtggcatctgagcccccagggctctggtctaggaagcatcagttttcccaccctacttctagttatgattggtgtcaggaggaagaaagaatttggggatgcaccatagggtaaatatattaaaactgtttaatccctgacaaatggcactccaaatgtggagtgcacatttggcgcgtagcgtgaatctgtgccaattcacactaccagcgtcagaacctcagtatatgatacccgattggtatcattataattttaaatgtttgtcaggttgcagtttgaaaagtggaatctcactgttatcttaattccattatgacttgtgatgtggagctcctattcctttcatagtggccatttgtatttctataaatggcctgctcagattgtttgttagctcttctattgttgtttgttctcgcatgtgtttcttgagttgtctcatcagagctctctgtatattgcaaatgtgattatttagtctgttataattgaagaagatgtttgctccctgtctctcacttgtgtttgcattttgtttcctgtgtcttcttgcatggacacttttcatttggggtgttcatacagactgctttattcaggcctcaccacaaccatgtgaggttgttcgtatttacctcagttttctttttgtttggttggttttatttacatttaataaatgctcattgagttaggtgtcagaggtactctgcacactggggatagaatcaccatagttccatgcgccaagatcacactgagggctggcggcacagtaatgagctgtacccttacagagctttccacctgtaagagtttcgggcacactcttaagcttctttttcttttcattcatgatttaaaaatgcattacttacacataattgtacatatttatggggtaccgtgtgatgtttcaacccctgtatacattgtataatcttcaagtcagggtaattaccatattcatcactttaaacatttatcatctctttgcagtgttaacatttaaaatcttctagatttaaaatcttgaagtatacactacattggtattttctatactcgctctactgtgtaatagaacaccagaactcgttctttatgtctaactgtaactttttacatttttgccaacctctcccgttgccccacacccccttccctccccagcttctggtaaccactactctagtttctgcttctgtgaaatcaactttttaagattccacatctgagtgaggtgatgtggtgtttgtctttctgtgcctggcttatttcacttaacataatgtcctccaggttcacccatgttgcctcaaatgacaggatttcattttgttttatggctggatggtattccattgtatatacaagccacatttttctttatccattcatctgtagatgggcatttaggttgattccatatcttggctattgtgaatattgctgcaacgaacacgggagtgcagatgtctcgtcaacgtgatgatttccttttctttcgctatatacccagtaacgagattgctgaatcacacagcagttctattttcaattttttgaggaatcttcatactgttttccataatgactgtagtaattttcattcccaccaacagtgcataagtgttcctctttctcaacatcctctccagcatttgctactttttgtctttttgataatagccattctaactggggcgaagtgatatcacatcgcggtttagatttgcatttcaccgatgattggtgatgttgactgttttcatatatccgttggccatttgcacatcttcttttgagaaaggtctattcaggcatttttcccaatttttaattgaattattatgaattttgctattgtttgggctccttatatattctggatattaaccccttgtcagatgcatagtttgaaaatactatttctctcattctgtaagctgtctctttactctactgattgtttcttttgctgtgcagatgctttatagtctgatataatcctattggtctatttgtgtttttgttgcctatgctttcgaggccttactgaagaaaagaatcgttgcccagttcaatttcgtgaaacgtttcccctatgttttcttctagaagtttcacagtttcaggtctgacattgcagtctttaagtcattttgatttgacttttgtatatggtgagagataggggtctggtttcattcttctgattgtgaacgtacagtttgtccagcaccatttattggggagactgtcttatcctccatgtatgttcttggctcctttgtagaaaatcagttggctgttaatgcttggatttatatctgggttccctataatgttttattggtctatgtatctgattttatgtcagtgccctgttgtattggttgcttttgtatatttcgaggtcaggtagtgtgttgtctccagctttgttcttcctgcttgggattggtttggctatcagcatcttttgtggctccatacaaatctaggattttttttttctatccggactgtcattggtattttgacagggatgtcaaatgtcgaacatggagatcactttggttaatatggacattgtaacaatattaattcgtccatgaatgtgggatctctttccatttatttgtgtgctcttcagtttcttttatcagtgttctacagttttcactgtagagatctttcatctcctagcttaagtttattgctaggattttattttttatttttttgtggctattgtaaatggaattactttcttgatttctttttcagatagtttgctattggcaaacagacatgctactgattcctgtatgctgattttatattctgcaactttaccgaattcacttattagttctaatagttacttggtgcagtctttagggttttctctatataagaccatgtcgtctgtaaacagggacaatttgacttcctcctttcaggttggatgctgttatggtttggctgtgtccccgcccagatctcatcttgaattgttgcccccataattgccacgtgttgtgggagggacctggtgggagataataaaatcttgggggcggtttcccccatactgttctcgcggtagtgaataagtctcacgagacctgttggttttataaggtgtttccccgtttgtttggctctcattttctctcttgcctgccgacatgtaagatgtgccttttgccttccatcatgattgtgaggactccctagccacgtgcaactgtgagtccattaagcctctttttaaaaaataaattacccactctcgggtatgtctttatcagcagcgtgagaacagactaatacaggcgctctttatttctttctcttgcctaattgctccggctagaactttcaatactaagttgaatttaagcagtgaaagtgagcattcttttcttgttacaaatcttagagaaaaagcgtccaactttttcctattcagtatgatattagctttcggtttatcatatgcggcctttattttgttgaggtatgttttttacctctttgcccactttgctgggagtttctatcatgaagggatgttgacattttttgaatgcttctcagcatctatcgaaatgagcatatggattttgtcctttgttctgttgatgtgaggcatcacttttattacattgcacatatattgaaccaaccttgcatccctgggatgaatcccacttgatcatgatggatgatgtttttaatgtgttgctggtgtttggttgagggttttcgcatccatgcttactagggatattggtctttagctttgttgttttgtcgtgtcctcgtctggctttggaattacagtaatgctggcctcgtaaaatgtgtttgaagctattccctcctcttcatttatttgcttgtttgtttgtttgtttgtttgtttttaagcctttgagaagaattggtaccagttctttacatgtttggtagaattcaccagcaaatccatcaggtcctggacttttctttgatgggagagtgtttactcctgcttcaatgtcattattccttattgtttctgttcaggttttctatttctttgtgatgcaatcttggtagcttgtatgtgttcaggaacttatctgtttcttctagattttgaatttcttggcagatggttgttcatgatagtctcttatcatcatctccaccgctgttgtgccagttgtaatgtttcctttttttatctctgtttttatttgaatcttctctctgttttccttagttagtctagctaaagatttgtcaatttctttatcttttaaaaggctaactctttgttttttgatttttaagttgtttttaaaaaatctctattttgtttatttctgccctgatctttgttatttcttttcttctgccaactttgggttttttttttttttgttgttgttgttctttttctagtttcttggggcgtaacattaggttgtttatttgagatatttccacttctgttacacaggcatttattgctataaactttcctcttagaactgcatttgctgtatcccataggatttggtatgttgtgtttccattttcatctgtctcaaggaatctttaaatttcctttttcctttttaattccttcattgacccatccattgttcaggagcatgttgtttcatttccacgactttgcccagttttcaatattccctctgttattgattacttcattgtggtcagaaagtactcaatgtgattttgatttttaaaagtttgttaagacttgctttgtgaactaacgtatggtctattctgaggaatgtttcatgtgctgttgagaaaaaatatgtattctgtggcttttggatggaatgatctgtaaatatctgttaggtccatggggtctagagtgcagtttaatgccgacattaattttctgtttggttaattttctgtttggatgatctgtccactgctgaaagtggggtattaaagtccctcactattattgtattatggtcaatctctcctttcaggtcttttaatatttgctttacatatttggatgccctggtgttgggtgcatatatttataacaattataagtatttatatatatttactatatatatatttacaaaatatgtatatttacaatggttagaatatacgtatttaacaattaaatatatattacaatatatattacagttgttaaaatatatatattttgtaatatatattactatatatacaattgttacaaaaacatatgtatatatatacacacacatatatttacaattgttatatccttttgctttattgacctgtttaacatcatataatggccttctttgtctttttctttttatggttcttgacataaagtctattttatctgatctaagtagaggtactcccactctgttttgggttccatttgcatggaatgtctgtttccaaccctttgctttcagtctgtgtgtgtctttgtcggtgaagtgagtttcttctagacagtatttagttggggcttgtgtttttagccactctatgtcttttaattggagaacttagtccatttacattcaagtttatcattgacaggtaaaagtttaacactaccattttgttacctgttttctgttttttgttttttgtttttttttttggtagatctgttcttcctttgttttgctcttactgtcttcttttgctgttatgtatttttctctagtagtaaatcttgattccttcctatttatattttagtgtccctattataggtttttgcttcgtggttaccatgatgagatgtataaaatatgtcttataattacaacaggttattttaaacagatagcagtttaactttaatcacaggaaaaacgaacaaaaacaaactctacactttaactcatccctccctccacactttgactttctgatgttttaagttacatctttttgtattcttatctcttaaccaattgttgtagttattactgttttgaacagttttgtcttttaggtttcatacttaagatatatttggcaacccgcgatgacaatattatagcattgtaaatctgtctgctttcttactattacctgtgagttttataccttcggatatttttttgttacatgttagtgttcttttctttcagactgaagaaaccccgttagcatctcttgtaagacaggtgttgtgttgatgatttttctcacgttttttcttttctttcttttctttttgtttcagcaagtctttttctttcttttttgctggaaggatagctttgctgaatatggtattcttgactgacagtttttttcctcttcatcacgttgaatgtatcattcctcccttccctggcctgcagggtctctggtgagaaatccactgaaagctgtattggtgacccattgagtgtgatatgttgtttttgttgtttttctcttgatgctttgagcatttttctttgcctctgatttgtttaaataatttgaatatggtgtgccttggggaatttgtctttgggttgaattttatttgtcacctctgagcttcctgtgcctgaatgctatgatctttctccagatttgggaaatttcagccgttatttttctaaatatgctttctagaccttgtatttttttttgtcttcttcagcaatttctattatgcagagtctaattttcttgatgatgtcttataattcttaaaggccttcttccctcttttaaaatgcttttgtctttttcctcctctatatatgttctgtcttggagcttacagattctttcccctgtttggtcaactctgctgttaaacctttctaatgaggttttcagttcagtcactgtattctctattttaggacttctggttttttttttttttttttttaattgtttttatttctttgtcaaattttttgttttgttcctggattgttattcaaattttatttagtttgttatccatattgtcatgtaattccccaaacttctttaggattattctgaattgtctgtcagacattccatagatcttcagtttttctgggtctgttactggagtttggttggtttcttttggcgtgtcacattttgtgagttttcacaatccttgtctctttatgttgatgtctgtgtgtttaaggagatgctcacctcttccaggttttgcagctgctccttggtggtgtcaaacctttactacttaatattggaacttaatccctggccagctgttgctttcagtctggaaaagacttactgtgagcaccagaacttaaatgctccacttaactatgttgctgccctgccactgtttcttggtctggggaagacttaagcgaacactggcccattattgccaaccttttagttctttccaggtcaagggaaggctccatgtgatcacatgggcttagtgagaaatctggccagggatctgggccttcctgtgtgttgcgcccccagcagtgctgtggttctggccagtctcctcagcattggcatgcccactgatcgtggcacagagcagctgccaagatccacgtgagagttgctgtgatcagtgcacccactttctgttcccaattcaccccaggtgtttcagctctcttctggaactctgaagggtacccgtgggatagggctggaggggacttcccatgaagattcccagactgatggggaggtcacatgtccacttccagttccctccttccacctcagaaattgtgggtctagagaaattctctgtgagtagcattatgctggtttgggggaggaggtggcacagtctaacgtgactgttgttcctcttactggttgtggcttttctcagttttgtcatcccaggaagtttccttgcttctcccccaagttctagtgaaaccagggtggtattcttgcctttgattaatttgtagttgtacttttgtggggagagtggtactgtgggatcatctgttcagccttcttgctgacgtcgctcctcctatttaccccagcgctcaaatgcagaaagcgaggctaagaaaaggtgcagggatttgtccctagattctaatccaagatcccgacctatgtgtgcctaactggaaagctatgcagtgacgtgggcccatggcaggctataggccaacattaaagccccattcatactggcctcctcctagacacagagggaacacagcatgtagcagaagaagccctcttttgtcctcagaggtgtgtgcctacttcaaagcacacaagacaaggaatggcagaagaaggggcataataatgggcctgctggacaggacacttgtagtgagggttgggagatctgggggccaggacaagacccaccactaactgtgactttgtctaagcaactggctctctcctggccacttctctaataaccagataacagttctgagccaccattgcaagtgtcggaaaggtgggttttttgaccccagctgggataaaaggaaagggggtgagacatacctccagcaatcatttcagcagcccatagctcttatcaatgcaacctctcaggcttagcagctattgctagtatcatcatgatttgcatgtaaatgactgctgctggatgatgatctggggacaaatggcatccagagcttatcccaaagggcctgatctcaaggaacctgatggatgttgcctctaggcctggtacaacaccagctgctctgtggagggggcatcccaagtaatcttcacaacccctctgtgagacgctttctttcccgctcccacaaagagtaatagcgtcggtccttctcaaccacccaggactgctgtgaggagtaatgagaaagctcccaacagccctggaagatattagaaagtgagatacacctgctatgtacccacaacaacagcaacaacaaaaaaacaagaacatgaggaacatgatgcaagtccaacagattactcatccaggcaattgcagaaaacataccagagctgtgtattatgagacaaatggtcaccgacattactactaatcattaaatgcccactgatgatactattcccagtggagttacaaatgccacccaaagaatccatagctcctgtcctctcggtagatatgggaagtcactgttactggggaccaggttttgcctggcatgcccccacacgttttaccccatctagttctcacagcaagtaaataagacaagtctagctcctacctctgggaggaggctgttcaccctcccctcacaatccccagaggacgctgatggataagtaaaccaagaccaaagcctcctaacccatgctccatggtgtgtgccaatggtttatgatgtctctgcactacaggtcttgtccacccttaagtggccaattagggcctgggacagcctgcaaatattacccaacatggttgagcaccaccagttttgagcctcacctttacaccatacaccaaaacatacatgtgttatcgtgtatgtaaacaaactccaaaccaagccgaaacaagaacaggatgtgtataaatttcctgaatggggtagaattctggttatttcctgtgtaattgccaagtatgttcaacgtagcttctcagcaacccatcagctatatgaatcttagcagaaccgaagactagacccgatttcttcagcctttcactgaattctcctcctccgcctgtgatccctatctgggtcaatggtaccccagggccacaagtcactcaagccagaaacctgggtgtcatccttggccccttgcctctggaccttgccccaggcccacctccagcctaacacagcaccgttctatctatcctatgaaaagcatctctcaagtaatgccacttccctccaaaccctcctccactaattttccccacaaactttaaaacccacgagtgagtgagtgcattttctttgggcacaatttctccctatgcccatctattttctgtgattgagactagaggtgtctaaagatggccagtgaatgaataaaattgactggcagggtcacagaaacaagcaaagcccacgttgaccctcactggcatgatctcattacacttcctcatgctggagtcccaggaaagccaagtctctctttgtaatcagtgcagtgaggatgggtcagccttttatgagagtggtcttggagcgtgtgctcccccttgggatggcttaaaggttgagctgcccaccctgtgatgctgcgggcaccactctgggggttccagcgagatgcagctttccccctacaggaaataaaccagatgaatgtgatttgatatgaccaatgtgaggtcccatcactcattagtatgtgtctggaaggcccacggttaggctccatcttctgtaggacaccagcagtcttccgactgttctcaggagtactctggcagtctgtagaattacctcaggtgaccatggggagcactggaggaggggcacgacagatgcagttttttccccattacgtcgcaccatcattttaccagtcaaaacaagtccccagtgggtgcagtgtgggaggagattgggcactgtgtggtgggaactgtctccaagcaccctgttaccggggaaccctgactccatgaatgttttagctttgctgcatgtgggactgcaagtacagtgtccccatcaccaagagcatgggctgtaactcacagttcaataggaccccctagatttgtagttggtgacagtggctcttaggctgcattgctgtaatggaaggatccttgcctcagatcaaccaggcactgtatcatggctccctcttgtgctggcgatgcaacctcagaatggtgatcacaccactcaccttgatccggatggtggaataataaaacaaaaacatgtgacgctcctgtaacacagcaggctgtgtaacatttcatggagctaagtacaaatgttgctgcctctgtaaggctgcccaggattcacgggaacatagcaccagagagattgaggacaggtggggcagaaaaacaagcttaatctcttgctcactcgcacagtccaatggtcttctgttcaccagaagtgctgggtgagcctggagccgtggaatttctgaccccacaccttcttctgaggcactgtcgactttactttaccgacctacctgagacgtctctcaggcacggggattgtgaggtgatgtaaacgcgggtcggggggaggtgtaagcaaaggagaagaactcataactcggtcacggtcatatttcagaaacgaaggtgtaaagctgacgacccatgccttcccctattgctgacctgtctttccccattcctgcatgtgattgccctgcatgctcaaatggttcatcatgcaatgggtaatgggcctgctcttgagatgcatgagcatctgttttgtgtcgctgtaacagaatacatgagactgcgtgatttataaataaaaaaatatttatttagctcatggttctgcaggctgggaagttgaagggcatggccctagcttcaggcgagggcttgtgtgctgtgtcataatgtggtgaggaaggtcaagggggaagtggacacatgcaatgagagaaaacctgaggggcatcctggctgtatagcaacctactatcttgggcactttgtccattcctgcgagcactaatccagtctcgccagagcaagaactcactcactactgtgaggagagcaccaagacacctacaaggacaaaggtggagccctcgtgacccaaacaaccgtgcactaagcctcacctcccagcaccaccaccttggggaccaaatttcaacatgagtggaatctcctgtgtatacggggctggcagaggaaagcattttctgctgtgaggctgcagagtccactggcctgcgcaatggggaaggcagggaagtcctcatggtccatccaacccaagagggcctgaggtggacgatggcaactggaggtcgaatcagcagtggaggtgttcctttcaggagatgatgcgtagtgctgtggctgtgtgtgggagtcagtcagcatctggtgggtagtgggcatatggttctgggcaaagcagacttggacaatgttaggatcagattggagagccctggagagagtgtggtgctggggagaagggctccttgttgctgagtctggctacctttaaatcccatctctgccacttgggtttcaagagtgactgccaagttgtgccctatccaccagatttccccacatcatttcttgtttcaacaagtatttgcatcctaaatacacacatacaagcacaagcatgcccatgcacatgtatgcacagactctccctgacactcccttaccagtgcaatgactgagctcatggttatgacagcagctatgaaggaacgaacacccaacaagcccccagccctagggagttggaacgctgctcctcttttggactaaacatggggtttagggctaaaccccatgatgtcaagtcctagccccttttggagaagcagcaacatggagctgaacttcccccactgagttagggcccagctcaggaggacagagccattgtggggagataggtggtacctgtgccatcgaaaaagctgcagagacatgggatctaaagaactccatcactccataattaacagctctgtctgttcagtacctatgggtctcaccgtggctgttccccaggaatataggaaaagggctgtgggacttccaaatgctgtcgcctacctgaaccttaccccatctggatttcatttgagcttaaaggccctggacctctgaagaaccagagggtgagtaattcacccagcaggccctaagaaagcattttttttttttcctcccctggctttgcacaggggactgcatgagacgggggagggggagagagaattttggtgttcctgtgtcctagttaggcttcttgatgctaaagagcacatccaatatccttgtccatttactttggtgacccctggtgctgcagtttctaacagggcctcctccatggttgttagttaacagggacaattatgctccaaccgcccccctttcagaattctcctgctgatactgtgttgcaacacatatcaaggtcaccttaggaaggcaaaagaaaaaaaataaagtcctcatcttatggaaaggaacaatgcatagttggagacaaggccgtctgttggaaggggtctctgtcttgtggtggagtaggcggggcttgggagctctttgtcagtacaggggttaacgccttttctgaggtccacagattcttcctccacatgaccctctcgcctccgcatataaacaccgcccagttttcctcagatatgaagactgtgtgcattgctgggggtaagagagatgttattccgtcctcattcctgcatgtgagatgttattccgtcctcattcctgcatgtaagtgccccgccagggtcagagctgagagccgtggaaaactcaccgttgattggctacagcccatcgccaccaggacctagtaacaagcagcgctgcctcgaggaggagggcagacagcctaacagggctaaggaagatgctagctctctcccttcacaaccccaccaccaccaaagctgaccacccccagttcagccgacgtgttgaaagttacatcaaatgccacaaagcaaaaacagtcaagcgtgccagcatttatttcaggcccggtgaccgggacactggggcgagcaggggcatggagcatcagagggggctcggtcaccgttcacgcctgtgtctgtggctccggtggtctcagattccgagtgcccggtatcctcccctagggaggaaagcgagtgacaagtggaccctcgggagccctggggatttctgacttggcctgaggttctcttggtggaacaggaaggggaggcggatgggcttggtggcgagccagtgagacaggcagaggctggctccgaaggagctctcgcctgaagcacttgatgaaacatgccagggccctctggaaccggctcctccaagaccctcgcagaagagcaggttccctgggcaagcctgtgccactggatgggtcctccgcggtgtcagatacagcaaccaattcctcagggtctttttgcggccctttcacattctgaaagacagactaaataactggatcctaatgatccctcccatccctggcttccgttacgcaactgttgtgtgcatctccggccctcttccatgggtgagggatgcagcagtgacctgcgcagaccaaagcccagcctcctaggggacattccaggacaacggagggaagccagactcaccaggtcagcaggtggaaggaagggagtgaagatcatgcttccaggagtgtgtgatgtgccggtagggaccaacaggacttcaatgaagacaccggcgaagctcgtcactctgcccggtgcaaagaggccgagggcctgccccctccacgccccattcagcccctctgcccctgccccatcgtccctccccccctacagcctggtgctccagcaggggatacatttctggcatgtcgcattccatttgtttctgtatctcttactcccagtcctccaatctttctttcctttgctgctgcttcctggccctctcagcaggctcgagccacgtttctccttgccgagcagaaaaagcagaggtcttcaagctggtgatgagtcatcatttggtggggatgccacagacccgagtgtccatgtgggtgctctcctgcctttgattcacaggattatgtacatggatgccctgggcaggtgtatgagtccaaatgagtcgtcacagcaaggagcgtgagctgggtaatggtatccagagtccaaatcaacagcagttttcttttcagaggtttacgtgagactccacgtctatgtaccagtcagtatcaggtggtttagggcctggagggcttggaaaatgtgagagagagggagaggtgaagggcctgggctggggtgagttgaaagtagaacagccgaccagcctgggcagcatagggagaccccacccccacagaaaatttcaaaagtagcctggcatggtggcacacacctctagccccacctactcaggaggctgaggggggaggattgcttgagcctgggaggcggaggctgcaatgagccgtgatggcaccactccactgcactccaggctgggagacagaaggagactctgtctcaaaaacaaactgacaaatcaaacaaacaaacaaaagaaagtagaagagcagaggtgaaagctccttgttgcctagtcttgctatgtcaaaatcaggctttgacatttgagttacaagcaatgctgccaagttatgccccccgtttgctaaccaggtctgtgcggtccgcaccgctgacttcacaggagctccctgcaaacagtatcctgaagggaaagtggaagtaggtggcctcagagtctttctttggcttttgaaacaatagtgctgtttaggaaagcatctcttacataatcctgaggctacagagttgatctctgtgagcctatcatgggccgtgccctgaatgaggctctgcttcaagctcttctgtgagggagaaaccgagagaggcatgaatgtaacagagagtgatggagggacgtttatggggctacgggaggactgaggaggcgggcagtcactcagccttgggaattggaacggagtcagtgaagagttcccagaggaggcgtgcctgaaaggagggacaaaagaaattggccaagaaatagagaaaagggagagcatcacaagtagaagcccaagacaataccgtgaggttttgcaactgaaaatatgtaggcctggttttctgttctagggtttaatagaagtcaaagtcagtcacgaggttccagtacaggaacctgaaaagctgtgcctcacagagacactgaaccctggtttttgagaacccaaagggtatatttttaatagaattttgatatatattgatttaatagaatttgataatagaattttgatcaatagcagtccattgatcatttttccagtgtgattcatgctttcatgtgtcctaccctaagatatcgttgcctagcctcacaacagagattttctcttctgatgtttgtaggttttaatattttgcaatttacacttagatctaggatttattttgaattaatgcctgcatgaagtgtgaataatgtcgggatgaatggtgagatattgaagttgtttgggtcttccgtaaagagatctactttttccagcactattagttaattgtcagctaatttaattatctttgagcctttattagaaatcaacttactatatatatgtaagtctatttctagcccttcttctatttcatccaatgatccctatgtgaattcttaaggtcataccaggctgtcatgattaccatgtctttatattaagtcagagactttggtgatgtgagtccttcatgcttgttcttttccaaatggctttggatcttctatgtcatttgcatttatatataacttttgagaaacagttcttcactttaattatgattatggtgagcctatagatccattacttgagaattggcatcttaacctgagtcttctgatcaacgaacattatatatctctgtttatttaggtctccactttctctcgccagtattttatagtggtctgcatacaggtctttcacatattacattaaaattctcaatagatacctcatttattttgctgtaattataaatgacattttaaataatgtcatctccaattatttgttcccagtatgttgaaacacagtgggtttttgtatgttgagtttctgtcttgtaactttgttatgtgacttgttaggtctaggagatgtttatccccacattccttagtattttgtatgtagactatcatgctatttgtaaatggagaggttttttttattccttcctattcaatctgtatgccttttacttattttccttggctcattgcactagctgggacctcaaggataattgtatacgcatagtaagagtctgccttatttttaatcttatgggagaagcattcagtatttcaccattaggcatggtgccagctgcaggttttttgtaggagtactttattaggttgaggacgttgctttatgtacttatcaagtggtttgggttttttggtcatgaatgggtgttttatgttatcaaattacttttctgttatatatctggataataaatgctcttttcttttattccattaatatggtgaaatatagtcacggatttttaatggtaaaatgaccttacattcccaggacagactgtgcttggtaatagattatttttttttcatatattattggattcaagttgctaaaattttatcaaggagttttgtaactatgttcattaggaacactggtttgtagttcctttttttcttctggtatcttttttctattttttttttttaaataaaagtaatgctgccatcataaaatgaactggaaagtgttccctcctgtattttctaaaagtgttcttttgggactactactatgttttctttaaatgtatgacactgctaaccagtaaatctattgaagactgaagttttctttatgatttacaaatacggttttaaaaagtctccacataaccattcttttaaccttaacaaggtctttagggatgattaccaattaattatatgtagttattagaagagtgtgcttaaaaaattttcctcagcttttaaatgtcttattttctttcttcttttctttaatttttatttttctttatttcttctaaaacaattaacgggatacatgtgcagaacgtgcgggtttgttacataagtatacgtgtgccatggtggtttgctgcacctattgacccatcctctaagttgcctcccctcatcccctaccccccaacagctcctggtgtgtgtccttcccctctctgtgtccatgtattctcattgttcaactcccacttctgagtgagaacgtgcggtgtttggttttctgttcctgtgttagtttgctgagaatgatggtttccagcttcatccatgtccctgcaaaggacatgatcccattcctttttatggctacgtagtattccatggtgtatatgtaccacattttctttatccagtttatcattgatggacatttgggttggttccaagtctttgctattgtaaatagtgcctgcaataaacgtacatgtgcatgtatctttatagtagaatgatttatattcctttgggtatatacccattaatgggattgctgggtcaaatggtatttctggttctagatccttgaggaatcaccacactggcttccacgatggttgaactaatttacgttcccaccgacagcgtaaaagcgttcccatttctccacagccttgccagcatctatcgtttcttgacatttttaataatcgccattctgactggcataagttggtatctcattgtggttttgatttgcatttctctgatgatgagtgatgttgagctttttttcatatgtttgttggccatgtaaatgtcttcttttgagaagtgtctgttcatatcctttgtccactttttgatgggattgtttgtttttttttttcttgtaaatttgtttaagtgtcctgtaaattctggatattagccctttgttagatgggtagattgcaatgattttctcccgttctgtaggttgcctgttcattctgatgcttgtttcttttgctgtgcagaagctctttagtttaattagattccatttgtcaattttggtttttgttgcaattgcttttggcgttttcgtcatgaagtctttgcccattcctatgtcccgaatagtattgcctaggttttcttctagggtttttatggttttgggttttacatttaagtctttaatccaccttgagttaatttttgtataaggtctgaggaaggggtccagtttctgttttctgcgtatggctagccagttttcccagcaccatttatttaataggagatcctttccccttgtttttgtcaggtttttcgaagatcagatggttgtagatgtgtggtgttatttctgcggtctctattctgttccattggtccatatgtctgttttggtaccagtaccatgctgttttggttactgtagacttgtagtatagtttgaagtcaggtagcgtgatgcccccagttttgttcttcttgcttaggattgtcttcgctatatggggtcttctttgattccatatgaaacttaaagtagtttttcttctagttctgtgaagaaagtcaatggtcttgatgggaatagcattgaatctataaattactttgggcagtatggccattttcacgatattgattcttcctattcatgagcatggaatgttcttccatttgtgtcctctcttatttccttgagcagtggtttgtagttctccttgaagaggtccttcacatcccttgtgagttgtattcctaggtattttattttctttgtagcaaagaagaaatcatgggaattcactcatgatttggctctctgcttgtctattattggtgtataggaatgcttgcgatttttgcacattgatctttgtatcctgagactttgctgaagttgcttaccagctgaaggagattttgggctgagacgatggagttgtctatatatactgtcatgacatctgcaaacagagacaatttgagttactctcttcttatttgaatacgctttatttctttcccttgcctgattgtcccggccagaacttccaattctatgttgaataggagtgatgagagagggcatccttgtcttgtgccggttttcaaagggaatgtttccgtgtttgtcataaatagctcttattattttgagatatgttccatcaatacctagtttatcgagggtttttagcatgaaggggtgttgaattttattggaggtcttttctgcgactattgagataatcatgtggtttttgtcattggttctgtctatgtgatggattacggttactgatttgcgtatgttgaagtagccttgcatcccagggatgaggccgacttgatcgtggtggatgagctttctgatgtgctgcgggattcggtttggcagtattttattgagggcttttgtgtggacgttcatcagggatattggcctgaaattttctttatttgttgtgtctcttccaagttttggaatcaggatgatgctggcctcataaaatgagttagggaggagtccctctttttctatcgtttgaaatactttcagaaggaatggtaccagctcctctttgtacctctggtagaatttggctgtgaatccgtctggtcctgggcttttgttggtcagtaggctattagttactgcctcaattgtaattttccttttaatgtggtgcatcacattaattaatttgcacgtgttgaaccatccttgcttgcttcccagaaatagatcctgcttagtcatggtgaacgatccttttaatgtgctcctgagtttggtttgctcgtattttgttgagaatttctgcctctatgttcatcagagatattgtcctcctgcttccttttcttgaagtgttttcatcaggctttggtatcagggtgaccctggcctcatagaacgaacttgacagcattctctcttcttcaagctttgggaagcgtttgagaaggtttggggttaattttctttaaatgcttggtagaactcaccagggaagccatctggtccttagcttttctttaatgggaagtttttgattactgatccaatctccttactccttattgttctgtacagattttctgttttttttaatgatgcaggcttggttggttgtatgcatctatgaatttatccacttctgggctgacccatttattgctgcgtaattgttcacagttgtctcttatggttctttttatatttctggcatcaattgtaaagtctcttctttcatttctgattttatttccctgattcttctctcttttcttctcatttagtctggctaaaggtttgttaattttgtttatcttttcaaaaaaccaactcttattttcactgattattttcctgtggtcttctattccctatttttttttatttctgctctaattttttattatttcattctttctgctaactttggagttagtttgttcttcttttcctagttcctggagataaaaagtaaatttagtccaggcgccgtgactcacgcctgtaattccagcactctgggaggccgaggcgggtggatcacgaggtgaggagattgagaccatcctggccagcatggtgaaaccccgtctctactaaaatacaaaaaattagccgggcgtgggcgcctgcagtcccagctactcgggaggctgaggcaggagaatggcttgaacccaggaggcagaggttgcagtaagctgagattgcgccactgcactccagcctggaaacagagcgagactccgtctcagaataaaataataaataaataaataaaataaaaattaaaataaaaaataaatttaatggacatcaatatattttgtttaaatctatgtacttgctgtttgttttctattttcccatttgttctttactcctctcgtccattttttttcatctcatcacattttggttgggcgttttaggattccatttgtcttcactactgtcttattagctgtatctatttcaatttatttaaatggttgctcaacttaccacactctatcttcaagtaatactatagcatttcacatacagtgcttcaatctcactggagtataccttatttttctcctctttttttttttttttgcagtgctattgttacgcattttatttctacatatgctataacatatgtatgttataaacatcattccgctttcaagttagttataaactgtcagttgtcatttatatatatatttttttaaatgaggaaaaaagctatctttcatatatagccataggtttcattcattcctcttggtcaatcctagtttccacgtggtatcattttacttctgcctatatttacttctgcctgtatttttttggggggagaaatggctgttcacatcttttgcccatttctcaatgaggttatatgttttattattaatttctaaaactaatttctgtaatctagatacaagtcacttataagttatatgatttgcaaatactttctcccattctggggcttcttttttcacattcttgatggtattattaattgcagcaaaaagtttttaattttaatgaaagtcctgtttatcctatcccattgtagttttggtttgcatttctctgatgatcaatgatgttgagtacctttccgtatgtctgtttgccatatatgtgtcttcttttgagacgtgtctattcagatcctttgcctattttttaatcggattattacattttttccctatagagttgtttgagctccttatgtattgtggttattaatctcttgtcagacaggtagtttgcaaatattttctcccattctgtgggtttgcctctttactttgttgatgaacaaaggattccacttgagactcctagtttcattgattttgcccccatggttttctattctctattttgttttcaatgttgacggtttcctttgctgtggcagaagcttttcaacttgatgtgatcccattggtctatttttttttcttgctttggttgcctgtgtgtgcggggtattactcaagaaatctttgcccagtgcaatatactggagagtttcccctaatgttttcttttagtagtttcatagtttgaagtcttagatttaagtctgtaatctattttaatttgatttttgtgtaagttgaaagatagaggtccagtttcatgcttctgcatgtgaatatccagttttcccagcaccatttattgaagagactcttttctctagtgcatgtttttggcacctttgtggaaaatgagttcactgcaggtgtgtggatttgtttctgggctctctattctgttccattgatctatgtgtctgtttctatgccagtaccgtgcctttttggttactatagctctgtagtataatttgaagtcaggtaatatgattcctccagttttgttctttttgctcaggatagcctttgctcttcttttggcaatctgtagattgttttggatagtatgaatattttaacaataataattcttccaatcaatgaacatggaatagcttttcatatttttgcaatccccttcaatttctttcatcagtgttttacagcgttccttgtagagattttcacttcctttgttaattcctaggtattttattttattgatagctattgtaaatgggattactttattgatttcttttccagattgttcacagttggtagtgattttcgtatgttgattttgtatcctgggactttactgaattcgtttatcagtgctaatagttttttggtggggtctttaggtttttccaaacataagattatgtcatatgcaaacaaggataatttggctttttcctctgtaattttgacaccctttatttctttctcttgtctgactgctctagctagaacttcctgtactatgttgaataacagtggtgaaagtgggcatccttgtcatgttccagatcttagaggaaaggctttcagtttttgcccattcagtatgatactagctgtgggtgtgtcatatatgacttttattatgctgaggtttgttccttctatactcagtttctgcagagtttttataatgaagggatgttgaattttatcaaatgctttctcagcatcctttgaaattatcatatgtttttgtccctcattctgttaatatgatacatcacattgactgatttgcatatgtcgaatcatccttccatctctgggataaatcccatttggtcatgatgaattatctttttaatgtgttggtgaattcggtttgtgagtgagtattttgttgaggatttttgcatcaatgttcatcagggatattggcctatagttttctgcgtgtgtgtatgtgtgtgtgtgtgtgtgtgtgtgtgtgtgtgtgtgtgtgtctttgtctggttttggtatcaggaaaacactcatagaatgagttcagaagtattccctcctcctctaccttttgaagtactttgagtaggattggtatttgttcttctttaaatgtttggcgcaattcagcagtgaagccattgggtaccaggctttactttgctgggagactttaattatggcttccatctcattacttgttattgttctgttcaggttttaaatttcctcatggttccatctttgtaggttgtatgtgtgtatgaacttatccatttcttcaaggttttcaaatctacaggcatatagttgctcacagtagcctctaacgatcctttgaatttctgcactatcagttgtaatgtctcccttatcatccctgattttatttatttggttcttttcttttatttctcatttattctggctaaaagtgggtccatttggtttctcttttgaaaaaaccaacttttcatttcattgatcttgtgcattgttttcttcgtttagattttatgtatttctgctctgatctttattatttcttttcttctattaattttgagattggtttgctcttgcttttctagtttcttaagatgcactgttaggttgttaggttgtttacctgaagtttttctacttttttgatataggggcttataactgttaagcttcccgcttagtattgcttttgctgcaacccacaggttttggcagtttgtgtttccactatcatttgttttaagacatttttcaatttccttcttaattttttcattgacccactgctcattcaggaacacattctttaaattgcacatttttgtatagttcccaaaatttcccttgttattggtttcaagttttattccattttggtcacagaagatacttgatattatttcaattttttgaatgttttaagatttgtcttgtggcctaacatgcggcatatccttgagaacttatccacgtgctgaggagaatgatgtgtattctacagctgttggaggaaatgttctgtaaatacctgttaggtccatttggtgtatcgtgcagagcaagtccgatatttctttgttgagtttctgtctggatgatctgttcaacgctcaaaatggggtgttgacgtctccaactattgtttgtctttcaacactgtaagtcttttagtttgtttccacgatgcttcgtggttttgcagagtataagttttgcactttctgttaggtttattcccatgtattttattatttctgctgctattgcaaatggaattgttttcttaattttgtattcaatgtcctttttgctactctataggaatagaaattattttcgtgtattgacgttgtattccttcactttgccaaattcagtatttgtctttaaagtcttttagtggattccttaagattctataattacaagatgatgccgtatgctaatagaggtagttttatgtcttcatttcccatctttttgaaaaccaggtaccatggccacaaccctcaatacattgttgagtagtagtggctacatcaggcatccttgtgctgtttcagacattaagggtaaaagattcggtcttctgccattaaatatgatgttacctgtgggtgttctttatcataggtgctctttatcagtttgaggaaaattcccttctattcccagttttttttttcttgagtgtatttcttatgacaggctgttgaactttttcaaatgcttcttctgcataaattgagatgaatacgtgttttttgaatgattatctgttcatatgataaaatccatttattgatgtgtagctgttaaagcaaccttatgtgcctgagataaatgccacttggtcaccgagtataaatatttttgtatgttgctggatttggtttgctaatattttgttggggattttttctgtcctattcatagttttgcttttgagtctatatatgattttgttgccaggcttatgagttatgaagttttccctcctcttctatttttttggaagaactgttgaagaattgctattaattcttatttacatatttagtagaattaaccattgaagccatctgagcctgatctttttttctgggtagtttttttgctttttgttttttgtttttaattactatttcattctgtttcattttcatagatctatttaacttgtgtatttctcctccagccagtttgcatggtatatgtatacctagaaattcatccatttcatctaagccatcaaatctattggcatacaattgttcatattatttctttataattctttatttttccataatgtagatagcagtgtctcctctttctttcttgatttcagcgaatagaacctcctcacttttctcttgatcaatctggcttacagtttgtcaattttgttgacttcttcaaggaatcagatttttgtttcattggtttatctctgttatttttccactcttcatttcattaattcatgctctaatcagtgtccacttttctcttcgatttgcttaggtttagtttgctctttttcccagggtctcaatgcggagggtaaggttattgacccgagatatttcttttttttttttttttttttttgagacggagtctcgctgtcgcccaggctggagtgcagtggcgcaatctcggcccactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccacccgcctcggcctcccaaccgagatgtttcttatttttttttagtatcagcatttagagctatacattttcttctaagcactgcttaactgcatcccaaaagtttgacatgctgagtcttcattttcatatatctcaaaaagtattttctagtttcccttttgatttcttctctgacccttgattatttaggagtttgttgatttctttatgctcatgtatttcccactaatgtatgttttattgatgtataacttcattccattgtggtttgggggcctactttatattatttctgtccttttacatttattaaggtgttttatagcccaccgtatggtctatcctggagaacatttcaggtgtacttgagaagaacatatattctgatgttgttgggtgtagtgttctataaatgtctgttaggaccatttgatttattgctttttcaaatctagtatatccttgttggtattctgactagcttttctattcattattgaaagcaaggtattgaagtctcaaacaatgattgctgaattatctattccccttttcatttctgtcagcatttacttcaggtattttggtgttctgttgtgcagtgcaaatatatttataatttatatatcttcctcttcacacttttataattgtagaatgttcatgttttatctctagtcatagtttgtgttttaaactctattttttctggggttgacaaaactactccagctctcttgcggttgctgttttcagtgtatttattttctcaaccttttacattctaactatttgtgcctttgaatccgaagtgtgtgtcttgtagacagcatctagttcaaccatgtttttattacatcctgccaatatctgctttaaaatacatttgtattgttcagtctattcacactgaacttaatgtaattacttaatgtaattactgttggggtagaatttatgcctgccgttttttgtattttctttctcatgtcttactgttcctctgtccctgcactgacgtattcttttctgctaaacagatattttctcatatactctattcatttacctgttgtttctttattgtatttttgggttgttttcttagtggttgccccacagattacagatcacattttaactcaaaagaatctagttcagattgataccaccttaatttcaatattacacaaaactgtgaccctataaagctcaagagtctcttctcctttgtgctactattgtcataaaattacttctttatacctgtgatgcccatctagatagttctataatgattgctttatgcaacaattgtcctttaaatcaggtaaaagaagggaagagttacaaacaacaatacattcgtacagtcttttatcaatgctgttgtagttagttacctttaatggtgttcttatttattcatcgggatttgagttactgtctactgtcttttccagatttccctttaatatttttttgtaagggaagtctgctgatgatacattgactcagcttttctttatcaggggatagctttacttcatcatcatttttgagggagagtatttctggatggaacattcttggttaactgtttgttgttgttgttgttgttttcattaacccctttgactgtgacttctcactaccttttggtccccttggtttctgataagaactcggttgttaatcttactggggatcccttgtgtgtggtgagctgtttttctttgctgctttccacattctctcattgtctttgattttcaacagtttggctaagatgtgcctcggtgaagattttcttgaattcatcctctttggagtttctgtggttctcatttgtgtccattaataatttgaatcaaacttggggagtttgggccattattgtttcaaatgttctctctttctcgagttcccatttctgttgagcccctctagtgagtttttcgctgtagttattgtacatttccacttcagaatttctgcttgggtgttttaaaaacactaatttatattctgtgatgatttctctatttgttgagacatcattctcatacttctctttaattcttttcacatggtttcctttagttgtttgaacatattcacaatagctgatttgaagtctttttctagtaagtccaatgtctgagcttctctctgcgtgttccatactctcctgtttctttgcacgtctcgtaagttttttgttgaaaactggacactttaactaatagaacgtggcaacgctgaaattcagactctcccttctttcaaggtattgttgttgttgtttggtgctattaatcctgctgtcacttgtttgtttagtgacttttctgaactacttctgtaaagtctgtatcctctgttatgtgtggctactgaatgccctgcttggttggcttagtggtgacctggtgattggacagagatgtctttatatgcctggaaaaggtaagtttcccagtcattgccatggggctctgtggatatgttggacatgccttcaactcgcagccaggcaattgacaactctttcacagagcctcaaaataaaccagagttggccgtttaggcaccttttgggtctttgcagaccatgtcatagtcctaggtgagtgtctggccttctagattcccaggaataggtaatcgcttttaaaagtcccaatggacacctcgttacctagatttccttttaaggtatcggttagcctattgtgtgccccaagtgttatccattgcctgaggcagctgcaatattgagcaattgcctccaaatatttttcacaaatgcatccagggaaaaaggcgtttcaaactgggcacactctgagtcagtccaaataaagacagccatgtaagtagggccttcccgggaactaccagacagatcaaataatgacaattctcgggaatgcggctttgcaggagctccaaccctgttctgttccctctggtggctgccaggctgctggttttcaccatgattgcaggctgttggtattcaaggctaccatggagctgcataaagggccatgaggatagggctagttgaaatgtcacatagttcactgttcctaaaaagattctgctgtttttcttgaataaacacgcccaaggttgcccctcagctttaggtgaatttgcaggtttccgaaaacattcattttgacaatttttgccagttttctcattgcatttacgaaggggagaatttttagaggtccttacgttgctgatgttgctgactctctgcacgagttttcattatacctatccatgagggtgtctgttgttaggtggtccctctgtgctcggaacttacgtatctctcaataatcactttacgggttaccgaccatgtgaaagggaccacaaccggagctctagaagcaaagatgtatagctcaccacctttgatctcaaagttgtcattctcaagtagattccatttaaccaaaacatttaaagccttatgatcaccaagcctgcatctggtcaccaaattatttcttaattcagtaagatgggggcagggatggaggatcaaggatgtgggctgtttttggccaccgtgtcttaaatataaccaggcttttacctgcatatttggcagcagcctggctagtatctcttgtcacaacaggttttattcctagccacttcagaagtggctgggagcctcagggagtaagagtgcagatgaggtgctgcagagatgtcccatatgaagagctagaaactgaaatttatttcaacaactgggcttggttttgaataactccttagcaccaatctaggatttcccactgaaatggcttgatttatatcgatgcagcccaccacctgggcagttattaataggcctttaggtagaaagcagcagggacccaagagactgctctttacaccacagcgtggaaacataactccatccctctccttttgaatcaacctctgcatatcaacaaacatcacatggtcattgatcgaggatcccgttagtaacctaagacttgagtttacatagaataacctgtctctgaaaccctttgaactgaagctgctaacttactcacaacctgtttgttgagggcgtgacttctcaaagtattctggtgccttggataaatatgtctgtaaagttgccaagagccttcaaatgacagtataatgtttaagagtcagacaaattttactctgaatccaggctctgccactttctttcccgtgaccatggataaatgacttagcttccctcaacctcagattcctaacttgcaaaactgaggataagactaaagggattgtaggaattaaagatgacaatacgtgtaaagcatgtggtgcactatccggcagccagctaatgcttcaaaaaatattaggtttagttactattgagcaacgtctttttttattttcatttttatttttatttttatttttattatactttaagttctggggtacatgtacagaacgtgcaggtttgttacataggtatacatgtgccatggtggttttatgcacccatcaacccgtcatctacattaggtatttctcctaatgctatccctcccccagccccccacccccggacaggacccggtgtgttatgttcccctccctgtgtccatgtgttctcattgttcaactcccacttatcagtgagaacatgtggtgtttgattctccgctcttgtgttagtttgctgagaatgatggcttccagcttcatccatgtccctgcaaaggacattaactcacccttttttacggctgcatagtattccacggtgtacgtgtgccacattttcttctttatccagtctatcattgatgggcatttgggttggttccaagtctttgctattgtgaacagtgccgcaataaacatacgtgtacatgtgtctttatagtggaatgacttataatccttcgggtgtacacccagtaatggcattgctgggccaaatggtatttctagttctaaatccttgaggcatcaccacactttcttccgtttgaactaattcacactcccaccaacagtgtaaaagcgttcctgtttctccacatcctctccagcatctgacgtttcctgactttttaatgactgccgttctaactggtgtcagatggtatctcactgtggttttgatttgcatttctctaatgatcggtgatgatgagcatttttttcatatgtttgttggctgcataaatgttttcttttgagaagtgtctgttcatatcctttgcccactttttgatggggaagtttgtttttttccttgtgaatttgtttaacttatttgtagatcctggatattagccctttgtcagatggatagagtgcaaaaattttctccctttctgtaggttgcctgttccctctgatgatagttccttttgctgtgcagaagctctttcatttaattagatcccatttgtcaattttggcttttgttgccattgcttttgctgttttagtcgtgagatctttgcccatgcctatgtcctgaatggtattgcctaggttttcttctaggatttttatggttttaggtcttatgtttaactttttaatccatcttgagttaatttttgtataaggtgtaaggaagggatccagtttcagctttctgcatatggctagccaattttcccaacaccatttattaaatagggaatcttttctccattgcttgtttttgtcagggttgtcagagatcaggtggttgtagatgcgtggtgttattttggaggcctctgttctgttccattgttctatatatctgttttgctaccagtacctcgctgttttggttactgtagccttgtaatgtagtttgaagtcaggtagcctgatgcctccagctttgttcttttggcttaggattgtcttggctatgtggcctcttttttggttccacatgagctttaaagtagttttttccaattctgtgaagaaagtcaatggggatagcattgaatctataaattactttgggcagtatggccattttcacaatattgattcttcctatccatgaacatggaatgctcttccatgtgtttgtgtcctcttttaatgccttgagcagtggtttgtagttctccttgaagaggtccttcgtatcccttgtcagttgtattcctgggtattttattctcttagtagcagttgtgaatgggagttcactcatgatttggctctctgtttgtctgttacgggtgtgtaggaatgcttgtgattttttgaccttgatttcgtatcctgagattttgctgaagttgcttatcagctgaaggagattttgggctgagacgatggggttttctaaatatacagtcatgtcatctgcaagcagagacaatttgacttcctcttttcctaattgaataccctttatttctttctcttgcctgatttccctggccagatcttccaatactatgttgaataggagtggtgagagagggcatccttgtcattcaaagggaatgcttccagtttttgcccattcagtatgatattggctgtgggtttctcataaataactcttattattttgagatacgttccatgaatacctagtttattgagagtttttagcatgaagggctgttgaattttgttgaagaccttttctgcatctgttgagataatcatgtggtttttgtcattggttctgcttatgtgacggattacgtttattgatttgtgtatgttgaagcagccttccatcccagggatggagccgacttgatcgtgatggataagctttttgatgtgctgctgtatttggtttagccagtattttgttgaggattttcgcatcgattttcgtcagggatattggcctgaaatttcctttttttgttgtgtctctgccaggttttggtatcaggatgatgctggcctcataaaatgagttcaggaggtttccctctttttctattgtttggattcgtttcagaaggaatggtaccagctcctctttgtacctctggtagaattcggctgtgaatccgtctggtcctggacatgttttggttggtaggctattaattactgcctcaatttcagaacttgttattggtctattcagggatttgacttcttcctgatttagtcttgggagggtgtatgtgtccaggaatttatcgatttcttcgagattttctagtttatttgcatagaggtgtctatagtattctctggtggtagtttgtatttctgtgggatcggtggtgacgtcccctttatcattttttattgcgtctgtttgattcttctctcttttcttctttattagtctggctagcggtctacctattttgttgatcttttcaaaaaaccagctcctggattcattgattttttgaagggttttttgtgtctctctctctccttcagttctgctttgatcttagttatttcttatcttctgctagcttttgaatttgtttgctcttgcttctctagttcttttaattgtgacgttacagtgtcgattttagatctttcctgctttctcttgtgggcatttagtgctatgaatttccctctacacactgctttgaatgcgtcccagagattctggtacgtggtgtctttgttctcatcggtttcaaagaacatctttatttctgccttcatttcgttatttagccagtagtcattcgggaacaggttgttcagtttccatgtagttgtgcggttttgagtgagtttcttaattctgagttcaatttcattgcactgcggtctgagagacagtttgttatgatttccattttttcgtttgcatttgctgaggagtgttttacttccaattgtgtggtcagttttagaataagtgcgatggggtgctgagaggaatgtatattccgttgacttggggtggagagttctgtagatgtccgttaggtctgcttcacccactattattgtgtgcgagtctaagtctctttgtaggtctctaaggacttgccttatgaggctgggtgctccggtattgggtgcatatgcatttaggatagttagctcttcctgttgcattgatccctttaccattatgtaatgcccttctttgtctcttttgatcctcgttgatttaaagtctgcttcatcagagactaggattgcaacccctgcttttctttgctttccatttgcttggtaaatcttcctccatccctttgttttgagcctatgtgtgtctttgcccgtgagatgggtctcctgaatacagcacaccgatgggtcctgactctttatccaatttgccagtctgtgtcttttaagtggggcacttagcccgtttacatttaaggttaatgttgttatgtgtgaattcgttcctgtcaatatgatgctagctggttattttgcctgttacttgatgcagtttcttcatagcgtcgatggtctttacaatttggcatgtttttgcagtggctgataccggttgttcctttccgtattgagtgcttccctcaggagctcttgtaaggcaggcctggtggtgaccaaatctctcagcatttgcttgtctgtaaaggattttatttctccttcacttatgaagcttagtttggctggatatgaaattctgggttgaaaatccttttctgtaagaatgttgaatattgagccccactctcttctggcttgtaggatttcttcagagagatccgctgttagtctgatgggattccctttgtgggtaacccggcctttctctctggctgtgctttaacatttttttccttcatttcaaccttggtgaatctgacgattatgtgtcttgggtttgctcttcttgaggaatatctttgtggtgttctctgtatttcccgaatttgaatgttggcctgtcttgctaggttggggaagttctcttggataatatcctgaagagtgtcttccaacttggttccattctccccgtcaccttcaggtacaccaatcaaacgtaggtttggtcttttcacatagtcccatatttcttggagactttgttcgtttcttttcacccttttttctctaatcttgtcttctcgctttatttcattgagttgatcttcaatctctgatatcctttcttccacttgattgattcggctattgatacttgtgtatgcttcacgaagttctcgtgctgtttttttcagctccatcaggtcatccatgttcttctctaaactggttatcctagttagcaattcatcgaaccctttttcaaggtccttagcttccttgcgttgggttagaacgtgctcctttagcttggaggagtttgttattacccaccttctgaagcctacttcggtcaattagtcaaactcattctccgtccagttttgttcccttgatggtgaggagttgtgatcctttggaggagaagaggtgttctggtttttggaattttcagcctttttgcgctggtttctccacatcttcgtggatttatctacctttggtctttgatgttggtgaccttcggatggggtctctgagtggacgtcctttttgttgatgttgataccgttcctttctgtttgttagttttccttctaacagtcaggcctctctgctgcaggtctgctggagtttgctggaggtccactacagaccctgtttgcctgggtatcaccaacggaagctgcagaacagcaaagattgctgcctggtccttcctctggaagcttcgtcccagaggggcaccccccacatgccagccagagctctcctgtatgaggtgtctgttggaccctactgggaggtgtctcccagtcaggatacatgggggtcagggacccacttgaggaggcagtccttcccttatcacagcctgaacactgtgctggaagaactgctgctctcttcaaagctgtcaggcagggacgtttaagtctgctgaagctgtgcccacagccgccccttcccccaggtgctctgtcccagggagatgggggttttatctgaaagtccctgcctggggatgctgcctttttttcagagatgccctgcttagagaggaggaatctagagaggcagtcatccttgctgagctgcggtggactccgcccagttcaaacttcccagaggctttgtttacacagtgagggtaaaaccgcctactcaagcctcggcagtggcggatgctcctccccccaccaagctcgagcatcccaggtcgacctcagactgctgtgctagcagcgagaatttcaagccagtggatcttagcttgcggggctccgtgggggtgggacccgctgagccaggcgctggagagaatctcctggtctgccggttgtgaagaccatgcgaaaagtgcagtatctgggctggaatgtactgttcctcccggtacagtctatcacagcttcccttggctaggaaagggaaatcccctgaccccttgtgcttcctgggtgaggcgacaccccaccctgctctggcttgccctccgtgggctgcacgcactgtccatccagtaccaacgagatgaactggatacttcagttagaaatgcagaaatcgcccgccttctgcgtcgatctcactgggagctgcagaccggagctgttcctatttggccattttgccagctctacctgtgagcaacctcttaatgccataaacacccagtctgttttagtgacccaaattaagagatttggaatccagttgcctcacctgaccaacagtgagctgcttttcccctgtgtttccacggacgtaaagtggccagggagagagatccttcatgttcatgactctccctgatatgcttagtgatgctaggtgacaacacaatcaattctcctcaaattaatgcacttacataatggccaatttgccacatttactgaatttcctgattgtcattttaacagctttcacaggagtactaatttttggttattaaagatgaaatatacctttctgaatattaactcagtggaggtggacataccttaggaactggggaaaaatccagaattaaagactgaaaattttctgaattattattttttcaatccaaaatctggcagtttgcatatgatagagttccttaaatattcttgatatacgtgggagtctttcaaataccattaaaaaaaatctattcaacatacgtgctttttttttttcttagtgttctcttgcatttttttcaatggctttatcagacagaattgcttattttgattgggaataaagatggttgaccaaatgcagctgggatgtgcctcttccccagagaggaagcaaaatattaagtaaatctgcacacttcaaacacatcttttgagagaaaacatgggaattcaataaaggggcaatggaagacactgtggtggaagagggaggaagcaggactgcctgtttggtattgctgggtgccacgactggcccctggacacagactggacccgaggaagtggtgagtgaaggaaccctaaggcaccacattcctgctgtggacctctgagatcctagacacaggagttccctttgggctggcaggcagagctacagggagaagatgcagaggcactgcttgaacctgtgtggagcccaaaaggcttcagtgtgctgggcagctgcagcaaaacatggctctaggtgcccacccccaaggctccgtgtcctgccctaagcagctgcagctcctactgtctgctgggccgggagatagcggagtccaggcgtgctcatgtgcccaacacaggccccgctgccattgccctgggaccaaggtgcatctgagccacatgcccccgtgtttgcccctccttcccaagactgcctgcctggctatttctgtggtggtgggggttggggagggcaggaggggagggggagggggagggggtgggggaagaggaggaaattcttcctaattcattctataaggccagcattaccctgatgcccagaccagacaaagacacagtgaaaaagaggaagctgccggccagtgtccctgatgaacacaggtgcaaaaatcttcaacaaaatactaacaaactgaatccaacagcacatcaaaaagataatacaccacgatcaattgggatctatcccagaaatgcaaggatggttcaacacacacgaatcaataatctgtctcatcaacagaacaaagattgaaaatgatatgatcagctcagtagatgcagaaaaagtgttggacaaaatgcagcgtcacttcatgataaaagctctcaacaaattaggtacaaatggaatatacctcaacataataaaaggctgtatatataactaacccacatcatactgaatggagaaaagctgaaagccttttctctaagaacaggaacaagagaaggaggcccactctcaccactcttatttaacatagtactgaacgtcctaccagagcaattaggcaccagaaggaaataaatgacatacaaatggaaagaaaggacgtcaaattgcaccccttcacagatgacatgatcggatagatggaaaaacctaaagactccccgaaaactcttagaactgataaacaaattcaatagagttgcaggatacaaaatctacgtacgaaaatcagtagtgcttctatgcaccaataatgaactagcagaaaaggaaatcaagagagtaacccctgcagccataagaaagaatgagttcatgtcctttgcggggacatggatgaagctggaagccatcattctcagcaaactaacacaggaacagaaaaccaaacgccgcatgttctcactcataggtgggagctgaacgatgagaacacatggacgcagggaggggaacatcacacactggggcctgttgggggtggggggcaaggggaaggagggcattaggacaaatacctaatgcatgcggggcttaaaacctagatgacgggttgataggtgcagcaaaccaccatggcacatgtatacttatgtaacaaacctgcacgttctgcacatgtatctctgaacttaaagtaaaattaaaaaaaaaaaaaaaagggcaaccccatttacagtagctacaaaaaaaaaaaaagtatctaggaataaatgtgaccaaggatgtgatagatctccacaatgaaaacttcaagacactgataaaaaaaattgaagaccacacaaaataatggcaaggcattccatgcctatggattagaagaatgaaaattgcttaaatgaccatattacccaaaacaatctacagattcaatgcaatcccacccaaaataccaacgatattttttacggaaatagaaaaaaatatcctaaaattcatatgggaccccaagagacctcaaataaacgaagaaatcctgaggggttgggggaagcaaacaaacaaagctggaggcatcactctgcctgacttcaaaatatactataaggctatagtaaccaagacaccgtgatattgttatagaaacttaaaggcttaaatggaagacttgaaactataaaaataacaaaggagaaaagcttcagggcattgttctagtagggcaaatattttatgggtaagactacaaaagcacaggcagcaaaagcaaaaatacgcaaatgggaccatataaaactaaaaagcttctgtacagcaaaggaaacaatcaatagagtgaggagacaacctgtagaatgggagaaaatacttacaaactaatcgtccgataagagactgatatccagaatacactagacgttcaaagaactcaacagcaaaactcccccaaataacactattaaaaatgagcgaaggatcggaatagacatttctcaaaagaagacatacaagtcgccaagaagtttatggaagattgctcaacctcactaatcatcagggaaatgcaagtccaaactaccgtgagatatcctctcaccccagttagaatggccattatgaaaaggacaaaaagataagttttggcgaggatgtgaagaaaggggagttcttacacattgttggtctgagtgtaaattagtgcagacatcatggaaaacagtacggaggtttctcaaaaaactaaaaacagagctaccatatgatccaacagtccctcaactgagtatttatccaaaagaaaggaagtcggtatatcaaagaaagatttgcttccccacgtttattgcagcactattcacaatagctaagatacggaatcaacctaagtgtccgtcgacatgaatggataaagaaaatgtggtatctatgcacaatagaacattattcggctaccagaaagaatgaagtcctgtcattcgaggcaacatgaatgaacctggaggattttatgttaagtgacacaaggtaggcacagaaagacacaaataccacacgttctcactcatatgtggaagctgaaggaaactgggctcatagaagtagagagtagaattgtggttactagaggctgggaagtatagaggggaggggaggatagagagaggttggctaatggatacaatattacagatcgataggaggaataagttctagtgttctatagcactgtaggttgaatacagttaacagtatcgtatagtatatgctaagaaaaagctggaagaggggattttgaatgtttccagcacaaaggaatgataaatgtttgaggtgatggataccctaattactctggtatagtcattacacattgaatggatgtatcaaaatatcactctgtacctcgtaaatatgcacaactactatgtgtcaactaaaaaataaaagaaaaaaaaggaagacaaataccacatgatctcactcatgtggaatcttaaaaagttgatctaatagaagcagagagtagaatgatggttgccagaggctgggggtgacggggcttgggggggatacggcaagggaagatgttggtcaaagagtacaaagttccagttagacaggagcaagaagctttagtgatctattgcacagcatttctagttaaaaataatgtattacgtattttgaaactgctaaaagagtagattgtaaatgttctcgccacaaaagaatgataggtaggtgaggagatggatatgctaattagcttagtttaatcattccgcattgtatacatatatcaaaacatcgtattgtaccccacaaatatatataattattttttgcttttttaaataaaataaatttatagagaccgctgcttctggaaagatggaaagatggtgtagttgtacatttccctattcttcccactaagtacaacttaaaattctagacactatatataaaacaaacataaggctggaagtggagagaagaaagtagaccaactggggacctcagaacgacatggtggtgagttccttgggttttgtttttgcctgatatatcccaaacttggagctgaagaaaccagctactagggaatgccaaaatgcacaggcaaaacgaaacaaaactaaacaaaacaggtgaagaaacaaagaaataaacctacaaaagcctgttctgcctagcctaaggatcagaaaagaggcagccaaacaagacagaaaatatttttcacaataactgctctactccagtcgaacacctcagaaaactctgtggccccttccccactcatgccagcaaagatctagtggggagcgtagacttccacattcatttccatgggcagagacgagggcccctttgcgctatcatatcaccaggattatgtggagatctccaacatatactcccaccaggccataaggagacacccctctttgtccctgctgggatgatgtcaggattttcaccaccactcagtgttaaggatgccactcaatccatgggctaaagagaaaatcttccagatgtaaactaggagagccattatggaaaacagtgtgaaggttcctcataaagttaaaatagaactaccatatgacctagcctccccacttctgggactatattcaaaagctatgaaatcagcatgtcagagagatatctgcactcccatcttcactgcatcactattcacaatagccaagacttacaatgaacctaagtgttcatcagcggattaacgaataaagaaaagtgtggtctatatacacaatggaatactgttctgccatgtaaaagaaggaaatcatggcgtttccaacaacacgtggcatttccatgtgtggaaggtgaaaaagtcgatcttttagaggtagcgagtggaatggtggttaccagaggctggagtttgggggagtgggggagatgttgaccaaagggtacaaactttcagctagacaggaggaataatttcaaaagatctattctacaccgtggtgactatggttaataacaatatgctgtatacttgaaatttgctgagagtagtttttaggtgttctcaccacacacaaaaaatggtaagtatgtgaggtaatgcatatgataattaccttgatttagccatttcacagtgtatacttattatcaaaacatcatgttgtacaccacaaatatatacaatttttattggccaatttaaataaaaagaatactgaagactaaatcttccaggacttcagaaagtgaattgaactgaatggaaatgattataaaacatgtcaacatctgtggtgcaaagctaaagcattgttgaaaggaaaatttatgccattaagtgcttccattagacaaatggaaaattatcaaagcagtaatctatgatgtcactacactaaactagaaaaagaggagcaaaagaagcagaaggaaggaaatgtgaaagataggtaaaataatcaatgaaatggaaacctgaaaaataatagagaaaatcaataaataaaaaccgaggtctttaagaagaccaacaaaacatacaaaactcaacaaagactgacaaaataagcctatgatgattcactgcctctgtgcatatttactgaatgactttaataactatagttatgaaacttttcatatagttgactttaggaagctaagcccttatgttttcaatatgaatcatacaatggaaagaagaaataaaagaaacatcagactcttgacttaaatcacaacaaaatttgatttttgaactaacagccagatccctgcctttcaccatagaaactagtttctgcgatgtctttcacaattaactcgatttcctttctaagaggtagacatgatacccaaataactgcactatgagttcaatttttcatgctacgagcgtgtctttgcaaattggaaagttcttggagacaaaatttcccatgattcatgtaatgctaaaagtaaggtagttgaaatttttcagactttgaatcaattattcttccatactgttagaaaggtcttgtattacatggacatttgagtggcgacttaggtgaaggccttctgcgttctgtaaaatattatatatgtggtctcataattttctattatgcgttatgtaactgaaataacaatacctttttatgaggtctccaccaaaaatgtgtgtgtgtgtgtgtctgtgtgtgtgtattctacaagatccgagccattttttagttggccaaattaataacctcagatcctcttaataattatcataaactgccttttttgctattgctgaccaattaattctaatttcaggcaacgaattttgtcaatctgattagactgttagagggaaaattcttatcaaattcatcatgtatttgcttacatttctcttaatattgtccagtttattctctttacatttctttcaacaaaacgaataaacagcttgtgctctgtctctgccacagcaaatgcaacatcgacaacaacgaggtgggggagggggtgagatgagcttttttacatcaaaatgcccatccataaaagcagaaatgaattatagaattagagaaatcaccactttttaaccaacaaagtaataatcaaatcgggcaggagccctgaatgaatactaaggccaagaggtaaaattctgttggagagcagaatatccgcatgtcatcgaaatatcctgacagactacttattaatcacaaagggagagaagtaccttcccagtgtagtactctgtctgaaaaataccttagttaaagtgataaaactgatgaatacaaacagcatcaccgataactagagaaactggcgttaggagcctccagatgtgacataatgtgaactgctcatcaccttcttaatattcgtacccaaagtgtcaaacataaatataaacaagaggcaaatatcaggccagcccgtattgtgggacactttacgagacaacaggcctcggctctggaaaaaatgtcatcgtcatggaaggtttaaaaaattgtttgggggtactgtttgcaattagaggacactaaagagacatgacaactgtgtgcagtgtaccatgcttgactggattgttgatcccccaaaacgtctttcaaaaggatattattgggacatttggtgaaatttaaatatgaactgtatgtgaacttggatagtattaccccttcattgttacatttcttcaatgtgataatggcactgcggtttcataggagtacattctagtgtttaggaggtgcatgctgaagtaactgggtgaagtgtttggaactgctacgtggttaggcaagaaaaaaaattactgagagataaagcaatgagacaacgtgaatctaggcatcagattgttcactgtattaccccctcagctttgtgtattttcaaaataaaacgttgaggaaaatagattcctcatatttagagttacgcactgaaatgtttacaaatcaaataagatacattaagatatccacgtatgatttttgtacttttttgatttctgatatttgcttgaaaataatctggaggagggggagaggagaggatatgtatgaaatgtgattggccatgagtcgttaatggttgcagttgggagatggatatttggaggttccttatgttatcctctcttgtgctgtcgttctcaaaatgtggtcccctaccagcagtgttagcatcaccagggaacttgtttgctaagcaaactcggccgagcctggtggctcacgcctgtaatcccagcactttgggaggcccaggcgggtggatcacctgaggtcaggagttcgagaccagcctgaccaacacggagaaaccccgtctctactgaaaatacaaaattaaccgggcgtggtggtgaatgcctgtaatcccagctactcgggaggctgaggcaggagaatgtcttgaacccgggtggcggagtttgcggtgagccgagatcgcgccattgcactgaaacctgggcaacaagagcgaaactccgtcaaaaaaaaaaaaaaaaagaaagaaagaaaagagaaaaagcaaagcaaagcaaagagaaaaagcaaagcaaagcaaagcaaagcaaagcaaagcaaagcaaagcaaagcaaagcaaagcaaactctgggtcccaccccagatcttgtcgtctgagaatacagatacggagctcagaaatctttgttttatcaagccctctgggtgattctgatgcaagctagtgttttaggaccactgctctaatgtaccatacacaaaaaaattaatacaccatagctaagttacatttactatgggagaggaaagctggtttgacattagcaaagctgtaactggaaggggacccgagagaggtttgtgtgttgctcatatattttgttgcctgttctagatactaattgcatgcgtatatttaatttttgaaaactcattaagaggcctggcttggtggctcacacctgtaatcccagcacttttgtcgggcggactgcttgggcccaggagttcacgatagcctgggcaacatggagaaaccccgtctctacaaaatatacgaaaattagctggggatggtcgtgtgcctgtagtcccaggagttcacgatagcctgggcaacatggagaaaccccgtctctacaaaatatacgaaaattagctggggatggtcgtgtgcctgtagtcccaggtacttgagaggctgaggcaggaggattgcttgagcccaggaggtggaggttgcagtgagccaagatcacgacactgcacttcagcagcctgggtgacagagtgaggggctgcttttttgtttcttctttgtttacaaatcaaataaagaaagcagcccaaggaaggaaggaaggaaggaaggaaggaagggtgggagggagggaaggagggagggaggaaggaaggaaggagaaagagaaagagagagagaaagggagaaagaaagggtaagaaagaaagaaaggaaaagaaagaaagagatagaaaactgattaagatatacatttatgattttttaaccttttggattataagttaaacttggctgaaggttttggaaaaaacctgggaagttacctaggctgggtattctagagataatggattctcccataactgatccatagattcagtgaaaatgcagtccaaatctgttacaaccgagtttttgggaaacttgaaattgcatgctaatttatgcagaaggacaaaaggcctaagacattcgggggtggaggtggtgtggtgtagggagagaggaagaagaaaggaaggaaggaaggaggaaaggaaagaacggaaaggaaaggaagggaagggaagggaagggaagggaagggaaaggaaagcaaagaaaaggaaacgaaaagttaaggaaaacacaaggaaacaatattaatatggaaatgctggcagcattccttttaaaatccggaacaacccaaagaagcccaattttgctgtcgctattagatctggtactaaatttcctagccagcgctgttaaaaaacaaacagccaaccaaccaaaaaaaaaaaaaaaaaaacaaacaaacaaaaaacccccataacttcaattctatttctactatgcataaactcacagataatcccagaacgcctactatagagtttagcatgttgacagactttaagatcaagtcacgtttttaaaagttaaaggcatttctgtaaattcgatccaaatagaaattgtccttttaaacagacatcaagtacaagaacagcaacaatctacagtatcttggaataaatacaataaatgatgtgcaagatctaaatatacaaaagatgaaactaaaaactgaactgaaagattaaaacattaaggacgcacataagtggagacatcccaagttggtgaacaggaaggctgagtattctacagatagtagattctccccctaactgatccatagattcagtgaaaatgcaatccaaagctgttacgactgagtctggggagacttgacattgcatactaattcgtgcggaaggacaagaaggcaaagaatggcaaagaatagcaaagatgtgtttggagatgatgaacaccatgcagggacttgccctagcagatgtcaagatgtattgcgaagtgaaaaaatttaagacaatttagtagtggtacaggaatagacacatttatctgtggaacataacagggagttcataaacagagacacacaaatatggacgaaagtgtctccaagcattgttccctgggggttgcaaagtcaccactgattgggaatccgcggcatggaaatatggatggatctttaatcacatgctgaatttttaaaaggtaaattacaaaataccaagtacatgagttataaatgcatgcacaccaaatatttcacacccaaagggagactaatctgggaaacaagccctggggagcataaagctcaacgatcacttcacgatttcttgactgacctagtacagggagcgggagaagctacggggaggtgatgggggcgtggcctcagaacgtgagcgtcaagagatctcgaggttcattggtcgccagccacagcggcgggaggtcgaaggcagcgcaagagctcattggcctttgtggcaagagcgggaagggaagcagaagctggatcttccctcagaccgtctgactggttctgacttgccggaggctgaggcaaccacaggctgacatcagaattaggtcctcgttctccacgcctcttatttcctcccaccctcctgagccagattcccaaccccttcccctctctgctacctcagcagggaacccccaactgctcctgatgtcccatcgcgccctcagctctcccggaatccctttcgggaggactccttgctccagccccctgagccctggcctttggccaatgaggcagggctcatgggattgcttttgattcggaggtccgggagggagtggatgattgggcttcctgaggaagtggtgcgctccagggtggtgggactgcgtgtgtggggtggggtgggggtggggggaaatggtgtgctcaagcacaattgttgaagtgtggagaggattatggaagattttggggaggctgtggagggaatgtgtgggttttcatgaaagcagaaaaggtgtgtgagtccaagagaaacactactgcactgaggagttccctactggctagatcagaacctgacacttcataggaggctcaacaggtacctgctgaatgaagaatcaagggaatcggccgggcccggtggctcacgcctgtaatcccagcaccttgggaggccgaggcaggtggatcagcctggccaacatgtgaaaccccgtctctattaaaaaatacaaaaaatggcggggcgcggtggctcacgcctgtaatcccagcactttgggaggccgaggcgggcggatcacgaggtcaggagatcgagaccatcctggctaacacggcgaaaccccgtctctactaaaagtacaaaaaaattagccgggcgtgatggcgggcgcctgtagtcccagctacgcgggaggctgaggcaggagaatggcgtgaacccgggaggcggagcttgcagtgagccgagattgcgccactgcactcccgcctgggcgacagagcgagactccgtctaaaaaaaaaaaaaatacaaaaaattagccaggcgtggtggcaggcacctgtaatcccagctactcgtgaggatgaggcaggagaatcacttgaacccgggaggcagaggttgcagtgagccgagatcacaccattgccctccagcctgggtaacgagtgaaactccgtctcaaaaaaaaaaaaaaaaaaaaaggccgggggggatgcatgaagggatgaatgaaattagtaactgaaagagggccagggatccaggagaacaatatgatttcatgggatacaagagggaaatcagctcaaagggggagcaagggaataattaagtgtaaggtggagtacaagaaaaaaatcagcatgaaccagcatgaaatgtgaggggaaaattgaatatagggcatagaagagactgacaatggaattgagtgctggtggcacaaaatcctgtgcggggagtgaatgaatgcaggaggttctgaagagaattggtgaagtggatgccaggaataatacttgggtttggcagagtgcaggatgatacacaagaagggcgtgtagtaatggtggaagagggcaggggagtgcatgtgcatgcctgaaagtggggtctatggtgaagtgacggtaagcaaggagaataatgactgcattgaatgggtatgggatccattccaagagtttcttgggagggggctatgtgtgagtggggcttctgggaaggaggcaacatcagcaagggggttgcagtgaaggttggcgaaaaccatgggagaagaaggggagggaaggcaatctgattccagcggtgagaaggatggagaaggagcattgagccacctcagatagggttttccaagggcagaggaagtacgttgggggtaggggatcacgtggccattctgacctccgctcctgaccctagaagcatggatcccgtgtgtctgaacctccatttccctatggatgtactgaggacaaataaatacccgctgcaccctgctgcccctctgactctgaatgcaccacagggcgtcagactggagccccatgggggactgaacttggccccagaagagctataggttgctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcagtgagtgtttctggcaagggagggagccagagtttgggtggaggaagcatgagtggttctgtcaccagtcctgtcacagaattgcagtgcgacctggggcaaattgctccctggaccttagtgtgcccaggtgcaaaatgtcaccaatgttgtctaccaagtgtttgtaggaaggagagagctgggggacagggcaatcgaagagctccatggtgagatgagacctgcgactggaggtggggtgaagtggggtggggttgggggaaagactcaccaaagctgttcctggtctttcacagctgggaaggagaacaacatgctgcagcccgagacccacatcttcacagcccccgaggaggtaaggagagtcggtgaccagtcgggcaggctcccacccagccactgtccagacatctttcaccgtgtcccaaggacatgggtttcatctccaatcctatcaccagctcaccatgtgaccttgggaaatatcacttctcctccctgggcctcaatttccccagttgcaaaatgaaaggcaagactggctggtcttcaaggtcttcggagctctgacattctaggctcctatcctcatcctaaaacatgtccacacctcctctctccatggctggcctggtacctgactgcaacctgtgctctctgcccctgcaggggagctcccaaggggctctgctgcttggccaggccccagaacctttgtctctgccctgtactccagtgaccttggagcagcaactggtttctccttctggggatccccacagggcccctgccctgcccagcatgtgagtagcgtgaggaccatggagcaggttgtgtcttgtgtgcctaaccttgtccttgatgccgtgggagatggaggaggaagagggggaggaggaggaggaggtggtggagggggaggaggagcaggaggaggaggaggaggaggagggagaggaggaggaggagaagaaggaggagggcaaggcagcatctaatactaacgggcgaggacagggctctcctagctttgctattttctatttgtgagactttggacaagtgactttatgtgtctgaacctccatttccctatggatgtactgaggacaatattctatacccatagcattgaaaagggaacgggcacaaggcctgccacatagtagggcttcaacaaatgggggttgttatgccacatgaaacaggtggatgggatagaaggtcctgctgaaaggtggggtccgtgctggcgagggccacagaggcccagggcaaagcccagaggccattagagaaagcttcctggagacccttcaagacccatggggactgggcaatatggaagtgagaaccagtccctgaagagggacagtaatcacatctctccaggtgttttgcaaattaaagcacggacacctgtaatttcccatgattttcaccattgccctgggaggaaagagctggtaggaataagcgtccctgtcaggaaaaagaggtatggaaaagaaacctggccaagcaggagaagggacttgccccagccacaatgactaatggtccagcaggcattgggattctcacatccagatactgcaaaatcctgcccctctttctgtctactggtagtatgtgtccgccagcggatttaatcccctggcctctcctttccttgtttctagatgctcaactctgatcctccagccctgtgccacccttgaccctcttctactgcagccacaggtcctgggaaagtagtggggtccagaaccctgggaggggcggagtttagtggatgggaagagcagaaggccttggtgggggtgggggaggaggttgagggaacagggggctgaaggggcacttgtcgtattgggaagaggtgtagtttcccagtgcctattctctcatgcactttcctttccaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccaggtagcctgctccctgaaaggagaatacagggtgggaatagctggggaatgggggtcgttgtggtaagcaggttctaactgaaaaatcagagtcagtaagttgaatctccttggggccaggcacccaagctcctcagtatgactcccgagatggtagttgagggctgtttattgaatcttcggtttattgagctttgtgtgcaacagcaagcgttcagtgccctgatgtcaagaaagaaggaagctgaggccctgagagtggcagggacttgccctctctgatatgcatgcagcatatcaagtggaagaaccggccctcttgactttcagcccagggtctatgctcagccgcctgtggcctactgtggtctggggaggacatacagaggtgataaagggcttggtctggaaggaggtctggtctctgccttccgggagcttccagtctagatgtggagcctggatgcccttgcaagctgtgttttgtggccaaattttaacgatgtgcccagagaggaggggctggaggagctccgaggggggataaacaactggggaggctgggagggaaggctaggcattcccagatccaaatggtgaatggagcatggtgtgtcagtgaagaaacacccctggagggactgctggaacagaaagggatgaggctggagaggataccaatcacagaggtctgacaggtcaggcttaggaggctggaccagcaactgtgggtagtgaggagccagggaacgttttctgagctagggagaacaatttcagagaccctgagcttgacaaaaagagttgtggtggctttgatggaaggattgggggaggcaagatgggagatggggaaatcagagaggaagaggtctatgcaacagtccaggtgacaaatctttggttgggtgggacgcataaaaacagtagatctggaaggggatgtggatgtgacctggctctggccccttcctttctgtccacagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 4735 - DNA, 71794 bp, human
cctgctcctcctcctcctcctcctcctcctcctcctcctccttctcctcctcctcccggtctgagggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcaggtgagaacgtccgcggtagaggtgacacccagggcctgcgggtctcagaggcccggtggcctgctcctctcctccttgcccaagaaacccccacgggggcgcctgcagcggggacaccaagtgctccccggagccctgggagcacttcttctgaggcatggagcccctgctcaggtgcttctgaaagttcctttgtggaccccagaaacccctaggcaactgtctgccccgccccgcgcccccgccgccccccgcccccgcagtacccctccggcccccgacatccctgatgcgcatgcccaggggccctgtgagctagaaagtagctgagctggtgcagtacctgctggttaagaaccggaagacggtggcgatcaaaagggcagacatgctgaagtatgtcatcaaaaggtacaggagcttcctccctgagattttcaagaaagcctctgacctccccgagttagtctttgggttctatctgaaggaacttgatccagcagagcactcctatgtcttgatcagaaaaatcgatcctgccctggtttggggcctgacaggcgaccagggcacaccaaagacccggctcctgatgattactctggactcgatcttcatgcaggccagctgtgtccccgaggaggtggtctgggaggtgttgagggtgttggaggcacatttcgtctaaaaagcatttcgtctttggggagtccatgaagctcatcaccaaagctagtgtgcagcaggagtatctggtgcacaaataggtgtcccacagcaatcccacgctctaggtattcttgtgggggctctcaaaggaaacaagacagatggaagtcccggagtttgtggccaaagtgaatgacacccaccccagttcctttccgtggcagtaaatgaggcattgagagaagaggaggagataccccgtgcccgagatggcagctgccgttggtgacgtgacaagtgccagtgttagtgccagttccagttccagggcctatgccatggctgaagcaagcatcagcaccagcaccaatgcaagtgccagttgccagtgccagggctagagccatggctggagcaagtatcagtacctgggacagtgccagtgtggttgcaatctcaggctagtgtcagggactcctcctgccagcagtgaaggctggggctgagtcttcactttgttttgctgtgggtagtcaaaagggccccacagcagtgggtgctggggtcctgacttttcaagagtcgaggggtagagtggggttagggagaacctgccgcccatggtatctgtgttccagttctatttgtctttctcagtgatttagctttcaatttgcatactgcaaagttttgtttgccttaattaacttttttttataatgatgatcattttacaggaaataaactggttaaaactacatgatgacagaattatatcagagttgaaacaaacgccatacctaagcattttttcaaaatcctttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattagacaccttgctcatcgactcatttattcaacatacatttactgactacctactatatgtgaggcactgtgccgggcgctggagatagaggaatgcaccagactcagcctctgccccacatctgagagtctagatggggctgtcatgtaagtaaatcagccagatgtggcagtttgatgtattaattgccgggatgaggataaggaccaggtggtatgggagcccggaggagagacacttaaccctgggtggtggatgtctgggaacaaggaaggcttccttgtagtgagatgccatctgagatctgaagcactgaaggagtagtaagtgcagtgtgtccccgaggcagggtattgtgggcatcgggagcattccatgttcttcagtggaactggaaggttagaatttggggagactggggagagatgatctgggggtggggacctgtacaggagccaggatcctcagttggtggacttcacagctgagagattaaaaaataatagtaataaagtaaacgtgtagtggaaagtgactctttggaaagcagctgctcttggctcttggatgagccagagaaaagactccacctgtggcatgcctagaagctgtcctggactcctgtccctgtgcagtttctacagtgcacacagcaggtgctttacattcagcatccgtaaggagtgatgggcaagggggtaagtgttgcactcaccggagctgattcccagaagctactgagcagatgttcgcccctgaagcctgggagagacagagctcagtgggttatatgactacggttagttgttgttgttgttttaagaaacaaaggcctagatgttagaatggataagttatcctgtttatacagagggaaaactgtttgtaggggtgagagataagtctagactagcctggagcgaagccaggaagagccttgatggctcaaacctgatttggctggcccaggaagctatggaggtttcctgagcagggaaggatctgatgaaggccaaaccctaccaaaattacagtggccagcaccagcgtggttttcaaaggaccagtattctccatgccttagaatggtcctggtgggtatagtgatcataataactagcctaaaattatcttcagttcttagagattgacatgcatgttttacatccctgcccgttggccttgcaaagcctttttgtgcccttcgtcacaaacactgtgggatcctggcaccagttctctcagggcctaccctaggatatgtaggatccagagaatattacactgtaacccctcacttgcattcctctgctggcgtcaaggaaaggctggaggtggtggtggtggtggggtggtgcagtgggggtgggggtatcataatgtgaaaacatgcaatctgaggtgaatggggaaagggttttggaagggctctgtcttagtttggggtggggatagttggagctgattatgtgtacctcaatctgaggcctttcctcaaaatcccgagccgcctgctctccatttgaagccaataaacattgtcagttatgaagggtatatgcatttgggcagggagagatgatattttttctgcattgttacactgaattgccctcctcaaggccatagcaagatacctgtggaaaaagcattgtctataggtcacagtcctaacaggtacttaggaagaagcaatgctgtcccatgactataaccacatacatgagtccagatacgtatgtatgtcttaagctcctctccatctccaacagccaaccctatcccgattaaatatctttctcaagaggtgtaaaaagatattgacccataaaaccaccaaacacttccagatttatttcagtcttaatgagagagaagcaagagaatgtgccagcagggaggatgggtcagcctcctgtgggagtgggtcctcgagagtgttgctgtcccctgggcatgctgagacactagagctgcccagcctgcaaagctgaggaccccactctgggagcacccgtgggactcagctcctcattcagaaagtgaacagatcaatgtaatttgacgtgggcctctgtgaggtcctcccacccattactgtgtgtctgaaaggcccgccgtctctccattgaccttggtgattgcttgtgttgcaatttctaacaggttaaaggaacaagtatgctccaaccccctttgtagaattctcctgctgatactgtgttgcagcacatatcaaggtcacctcaggaaggcaaaagaaagaaaaaatgaagccctcctcttatgaaaacgagcaacgcgtaggtggagacgaggtcgtctgttggaagggctctctctcttgcggtggggtaggggggcctgggagctctttgtcagtttaggggttaatgccttttctgagatccacagattcttcctccacatgaccctcccgcctctgcatataaacactgcccagttttcctccgatatgaagaccgtgcgcattgctgggggaagagagatgttattccgtcgtcattcctgcatgtaagtgcctcaccagggtccgagctgccagctgtggaaaactcaccattgattggccacagcccatcgccaccaggacccaggaacaagcagcgctgcctcgaggaggagggcggacagcctaacagggctcaggaagatgctagctctctccctccacaaccccaccaccaccaaagctgaccacccccacttcacccgacgtgttgaaagttacatcaaatgccacaaagcaaaaacagtcaagcgtgccagcatttatttcaggcctggtgactgggacactgcggcgagcaggggcatggagcagcagaaggggcttggtcaccgttcatggctctgtgtctgtggctccggtggtctcagattccgagtgcccggtatcctcccctagggaggaaagcagagtgacaagtggaccctcgggagccctggggatttctggcttggcctgaggttctcttggtggaacaggaaggggaggcggatgggcttggtggcgagcagtgagagaggcagaggcgtgctccgaaggagctctcacctgaaacacttggtgaaacatgccagggctctctggaaccggctcctccaagaccctcgcagaagagcaggttccctgggcaagcctgtgccaccggatgggtcctccgtggcgtcagacacagccacccattcctcagggtcgttttgcagccctttcacattctgaaagacagactaaatagccagatcctaatgctccctcccatccctggcttccttcaccccacccagcaactgttgtgtgtgtctctggccctcttgcaggggctggggatgcagcagtgacctgcacagaccaaagcccaacctcctaggggacattccaggacaatggagggaagccagactcaccaggtcagcaggtggaaggaagggagtgaagatcatgcttccaggagtgtgtgatgtgccggtagggaccgacaggacttcgttgaagacaccggcgaagctcgtcactctgccgggtgcaaagaggccgagggcctgccccctccacgccccattcagcccctctgcccctgccccatcgtccctccctcctacagccttgtgctccagcaggggatacatttctggtatgtcacattccgtctgttcctgtgtttcttactcccactcctccaatctttctttcctttgtttcttcctcctggccctcccagcaggctcgagtcacgcttctgcttgctgagcagaacagccccgagggtcctcctcgagagaacatgatgtgtagaggtcttctacaggtagctcattttatttggccatgaatggttcattgcatgccaaggtcacacatggtcctagtttgccatgagtgggaccattccggttttaaaacttaaaggcccctgtcccgggaaagctctcagtcccagggaaactggaactacttcattcatgtggacactattgtcacattactgtgcactgtttttctcacatttaacagttggaccttgtagatgaaattgtaagagtgatcctgatacctaagaagtagacatttatgagtaatcgatgtgtattgaaggctctgtatatcttcatagtgtggaggtaaatgcagcattatgtgtttgcccctgaatacatatccactaaaagcctatgattggacctcagccatcacatctgctcttggggtgtcacaccagagttctagatggacccagaattgcagagagacaaggtcaggggaaggagccgggaaagaggttaacaagaccacagatgctgcagatgggactcacacgaagatgtccttcccaccagccaggccatcgctggctttgtaaggtaatgagattagcaacattagaggtgctgaaacacagcctgagcggtcacttgtaccgtatgctgcagagaggagggttcaaatggtttcagacagccctgtgattcataggattcgtgtgcaaatcagaggtaaagagcccttagctttcatgtaaatacgtaattccctctgacgtgtacaaaaattctcctcaaaatcttgtgaatttccaggcaagtgttgtgaaatacttagaaactcctccaagaagtgagcaggtctcattgtctgtcctatctcccttttctctccttgaatctactccagttaggctttctcctacaccactccactgaaacttaggagttaattgaacatgaaccaatgaacaagtgaaagtaatgtttcttatagttgtatatgactagctatgtgattaaaatgaccaaaccggcaagttgtatttaaatgcttaataaaagctaggtttaaattgttaacttaaaaaatgaatagaaatgaagacccaagtaactacactgtcatctcccagcacaactttcattctcatataaagaaactcattttctaagtaggaaggttgttccaaactgctggaaattcccaggaagaaaggcccaggttttatggagcttccacctgtttccttgtagacgcagccaactgccaccaggtggcagaacaagatgagaaaaccgtgccccacggagtccctgagcccctgctgctgcagtttttgagtgagttttctcaggggctggaatcactcctggggaaccatcccaaggttctgccctcttaagctattccagggtgcacccagggcctggtccagggtttctgacgtctatgatgacgcttaaggcagtgacatcgatcagccgggcctctgggctaggagacccagttcacctcctcattagtaaccctgggatgtggtagtaggtggctttaggcaggatgaggggccagttgtatctgtcagtatgtcagggtagtgacatctgtgattctgcagggacatttgaacagcagggaatcagaaacgccagaaagtgagggtccgcaacacaaaaccttgccaactgctgtggactgaattgcgttcccccgccctgcaattaatatattgaagccccgacccctaatgggactgtatctggagctagaggctttaggaggcaattaaggttaaatgaggtcataagggtggagccctgctcctacaggattagtgtctttatgagaagagacgccacagagctcattgtatctgtcagtatctcgaggtagtgacaactgtgcttctgcagggacatttgggtagcagggaggtctcttcttctctgcactgcatgcacccaggaaaggccatgtgacgtcttagcaagaaggaggcaaaccatgaggagagccttcagcagaaaccaaatcggccagcaccttgatcttggacttcccagctggcagaactgtgagaaaataaatgtctgttgtttaagtcacccagcctgtggtattttgttatggcagcccgagcggactaatacaccaacctagcggtttttcaaagaaaggagtcccgggctggcccaggaggccaggctgctcagtccccgaagcctgatggcaggtgaggtggacaaccctgttgtcccgcccagtaacatttccttttttttttctgaatctcctttgagaaaataagctgcctctgtgcaactgccttgaatggacccagagttctgcaaagagtcagggaagggctgtgagtgatggtgataagacccgccccgcaccaccctgtggatggatgggatttatatcgagaaaggctacgaggtcagcccctcgtagctttataccatgtctccctcagctgagattaaacaagtgtgtagggattcaagaaaaagttgattttttaatttggagtggttgttacagggagtaggggtcaactggattttgccagccctgagattgaactggataaattacaggtaaattatatgtgtgaaagcactgggtacatgagaggatctcaatacaatttcgttgacttgcacgcaagtttcgcagaagctcctgcaagaggcgaagtgattcttattatgacaaataataacagtttctttttattaaagacctagtaagtacaggtatatcacctgtttacaatactgtcttatttatgcaaataatcctcgtgtatgaaaacaatacagacaaaacaatagtctcccttgtccacccctctccgtcaccagccccctcagcaatggtttaatgtgtttcctcaaaaattcctcaatcgatgcatttacatacacatacatgcactaatagaaacatacgcttgtcttttatggggccataagatacagactggctcaggatgcacgtattgtgtggcacttgatttttgcattttacagcaagtctgggtgaacttctcctgtcagttcatggagaactgtctcatcatttttaacttctgcatagtgttctaagtgatatgccataattctttaactacttccatacacaaggaccttcacatttttttcctcaacttttaaagttctcaaaagtttttccaatatctttgtttgcagaggatgtgtcgctctagaagagatacacataaatagaattttggcacaaaaccctacaaatatttcaacactgagtaaccgttgataaatggatctgaaaagaggtggcagcaatttattctctcaggagcagtgtaggatagtgttcattgtccttcaccgtcgctcttgatgttattcatccctttaactatttgctaatctggtggttgatatataaaaggttttgagacaaagccttccttacagaatctgtgaaggtccagggctggtcatgcctgcaagcccatactcagatgtcgcctccagtgggctgggtggggagaggctgagaaaggcacaacagagtacaacagagagtgacaggaggaagtttcggggtccatgagaaggctcagacagggcacccactcagccttggggatgttaatggagtcagtggaggtttcccagaggattaggtgcctgaaaggcgtgaggaaagaaattagacagggaaagggagaggaggaacagcacttgaagcacaaagaccaggccactgaggtgattttggaaactgcaaataagcagacccagtttctattctgtgcacttgtagcagtcaaggttggctaccatgaaacagtgctggatcagaaacgtgtgtcccagtggagactctgagttcctctgctgcagttctctagaatgagggtgctcaatcaggggctagcctgagttccaaggtccagcccttgaggatcttctgggttgcatccaggccctggcctagagtttctgaagtctgtcatgggacataagatagtgatacatatatatatagtctcctaaggacctagcctgggagactctagtcagctgcccacccattctgtagctctggggtatgaaaagaagcaattttaggcagggtgagatgccaatggtgtcatgcagtatcttagggggtagtgagggtatccttagaggatactgaaaatacttgcaatggggctcatgggaggcataatagcccccagggcagcagtgccatcaggggacttgcaactaggcagctggctgacacagcaggtagctgtgaatgtagtagtcccctaagccacggggtcactaaatgtgtgagaagaacaagaatttggaggtcatttagccaaagatttcagtatgtcaatagggcaatggaagctcaagaaggtatagcaacttgctcaacacagagagaaaatgtatcactatggtgagacagtgaagggaggacactgtgactaacactgacagatgaaacctgtcttcccctgaacctgagaggttctagaaatcaagagcctgtgcaaatgggtcatcacagcaaacagcttgaggaggttcatggcagccaggtcccaatcagcagcagtgttgtgcctctgaggatataatgtgtgaggctgtgttggtgtgtgaatcagcctctggtgggtggtgaacagggggctccaggctggcgttcgctctctctctctctctctttctctctctctgtctctctctctgtctctctctctctctctctctctctgtgtgtgtgtgtgtgtgtgtgtgtgtgtgtgttttagaggtgaggtccccttgacaccaagccctgctctattaaatcccctatgactacttgggttttgactgctgttttccaagttatggcccctcgtaacccactggattggttggacggtggtatcgttgcagacaagggtcctccctctgagcccaagggaaggaaggagggaacaaggtggcctcaaatcttgtcccctgggcctgagcctcttaagctacagtggcagcttcatccatatctgtgtcccacacagtctcatatcccttgccctacccacattcagccagcccagattcatttctggactggagaaaaggcctcagcacctccaggaagacagctctgagtccagacattgaaaacatctggttcctgctgagcaggaggctctgggctccaagctagaggaaataaaaggaatacttctcacccttatcccagatcagagagtccaggcacagcaaagctctggtggacacatgctcattgatttgttttcttcaataaaggtttattggtgccgtgctgtaggtaaagccctgtgtccaggtactggctgttccaggactaacaaggcagagctcatgctccagagatgagaacctgggtgaggacagtcatgcaaattaagctgccagagggggcagtctagcatgagaaatgctatgatagagaagagtacacagtatgtttgtgtgttagtcaaatatttcatcatatagatagggaaatggaagcccagaaaggtatagcaacttcctcaaggtaacacagagagaaaatgtatcactatggtgagacagtcaagtgaggagactgtgattgggactggcatggtggaggggagacatgttaccaagggaagaaggacgtgttctttttgagggtaggaacatcagagatcaaaaggacaagtgacaggctgagcaaggaaatggtggctccagaggagagccataatgcaaaggccctgaggcagggcagaattaacagctattttcgggggtactgaaggcaaattttagccacgctgtggagagagacgaggctgtaggagaggagcagagttgagatgtccagatggaaagtctgagggatgagagacaatgtcctggatagaaaggggctctcacagaatcatctcatttggatctggatggtatagaaggaagtctccattgctggtccaggatgagtcctgggctcccgtccctgtgcagttttctacagtgcatacactgggccttctaaacacaccaactctaaagcgcaatggtgaggtcagagtgatgcccacccaagctgttccctagaagccagtgatcggataccatcctgtgtggctggggaagctggcaaacagtgcataatgaggacattgatatgggttcatctagaataaaaccaggatgacataaagaagggctgggtttctagtaggggtcaaatgagtgtgaagaggcagaattgtggggtaaagatattggaatcaggcctcggcgagaggggaaggcagagagagagagaaagtgaggagagggagaggaagggagtgacggagggagggagggaggaagggatggatgggggcagggaggaagagaggaatctagggagggagggagggaggagagcatttggtcctttgcataagggatatggcctatgagctgcagcctgctggggctgcctccctcacaccagaatttttggaaaagtatccactgtgatgggcctctcttcctggagaacagacgcctttgtcctacttgctaggaagatatttttcctgcactgtttttgggttttggtttttgttttttggcactggaatgacccggagtcacccgggagctcccaagaggaggatgcagggtcccaggtcaactatattactactcatggctgccacttactgagggcctaatacacatcagacactctgtcgtgtggattacataagctgacacttatctttccaacggtcctgcaagttcaatgtcagtcaaattttacagggtgtaatctggagccggagacttcaagatacttgtccaaggtcacacagatatttactgacaaagctgggacttgaccccaggtctgactaaaacgtgggcgcaccatgcaccaccctggcacctgagaacccctcccagccttaatggagccttctgtgtcttgcacccagtccctagcccccagatattcctgctgtcttaattgttattgattgctgcataaaaaactaccccaagcatatcaagttaaaatgataagcagtttttctctgagagttctgtagatcagggatccgggtatggcttaactggatcctctacttcccagtctctcacaaggctgccagcccagggacaacagtctcatctgtaggcctgactggggaaggattgacttccaagctcactcatgcggctgttggcaggatccagttcctcatctgtaggctcagctggggaaagatagacttccaagctcactcatgtgattgttggcaggctctagtgggtcgctggcctgagggcctcagttcctctatggctgttggccagagactttcatcagctcctcgccagctggccttctccatctgggcaaacacgcgtgcaggaagagcctgagggagagaatgaatgccagcaggtcagaagtcacagtcttgttatagcctaagcatggaaatgacacgccatcacctttgccaaattttgttggttagaagcaagtcactaggtccagcccaccctcaaggggagggaattccataggagcatgggtgccaggaagggggatccttggaagccattctggaaggctgcccaccacacctgctcctgcacccacctcagtatagtgagcccctttgggtatcaaccaccttgacggagcaaatggttgatgggccaccttggactgtgctatgtggcctgcatctatctgatcccacctctcttccagcaggcccaggactcgagtctgcctggccttgccttcctccccaaacctaccagctactcctggccactgagcccatgagatgtcacagcagctgaaaatggacctgctccctgtgactgaagcacacacccatcactcgggtgggactgggacccaggatggtgctccaggcctctcctggtaaaacagaggtgaagggctcagctctcccactgagacagggcccacctcaggagaacacgggtacaggtgggagagggctgggtccagagttatctgtgaaagctgcagagatgttcttgcttttaccctctgggttgggattctgggtagaatccccccaagttctccagcaggcatcacagaaacatctctaaggcaacgtgggagcacccatgccagagaaggagctgctctgaagctgcgtggagacccagaagtgttcagacgcctaagatgggggacctactctagggaggagaggagtgagtatagattggggatggtttgtgtgtctccaaaatgtatttaactcaaaagcagagagagatgtgaagcacatatagcaaagcatttttaagtagggatggtggctgctgtattcttctctctgtttttctgtaggtttgaaatatttcagtagtacaatactctaaaagtagaaaacagaagagaaggagggggctctcaggacccctggactccacatttcccaggcgtgtctcagagccaaatgcgtcaagctggggggtggcattgtgaacttgtgagtttcctaggaacccagtggttccattaggctgtggggatcgggactgcaggtggctggactcccatggcagaaccttagccaggagcagagccatcccggagaagcctgggctttttccagttctgggaagcatccaccagactcagctcttcccactgctgctattttcttgcaatatatatcaggggcagcttacaaagagacacggtgtcataataagagacaaacaacctgaggtgatggatatgaggccatgtgctggaggggctctctccaaggttgaggtgggggttgttgtggtcagattataacttaatgcctctgaagcctttcctgtggattctgtgacatcttctctccttctgacctcacctccctgtccctcaacctacagccctcctctccggcccaagggctatcactcagtcagtgcccatcagccaccctatatgaagtgtttgaaaccagtagcatgtttactgtccatcaaccattgtgctattgcaaaagtgactgggggacatgcagtactgctccaaggtacgaggacagtaacccatttggctaggtaccccgtgcctaactctctctccacagcgacccccttccctgccaccttcaccgaaagaggcaaaccataaatcacaggaggtggatattcatgtggagagggacatcaaatatcataacaccaaaagagtcaagtgtgccagtatgtatttcaggcccactggggtgagcaggggcatggagcagccgaaggggcgtggtcaccgttcacggctctgtgtctgcggcccccgtggtctcagtttccgagtgtccggtatcctcccctagggaggaaaacagagtgacaattggacccttgggagccctggggattctggcctggcctgaggttctcttggtgggcttggcggtgagcagtgagagaggcagaggctctcacctgaagcacttggtgaaacatgtcagggctccctggaaccagctcctccaacaccctctcagaagagcaggttccctgggcaagcctggtcctctatggtgttggcaaaataaaccaagggcatagtgtctttagctgagccagttccgttcaggaaaatagggaaaaatcattctagccagcactaacattgcttccttcattcgtcgggtgttcgctgggggcctgttttgtgtacaccaggatcagttgcaggtactggggatacagcaatgaactctagagatctagatcccagctctcctggggctgactatctgccacgctggagggaaatcaggctcaccaggtcctcaagagtttgctcttccttgggaaggctaaaaactgcagctgcccaccttgcaaagctgagagcaccagtctgggggatgcggctttctccatacagtcagatcaggactcagcagcagcaggaatgccagtgaagttcatgttttctgagaagtgcgatgtacatgtggtgtctgaaaggacttattgtcagaggccggcagaactcttcattgtgctgggcctctggctcagggcctgtccccccctgtgaaaatccatccccgtgtccctggcctggatcttcaccctcccctcctgtagatgagtatgctcttttcaagcagttgatgatacattctcgtaaactccctcacgtgctgagatgcctcattgactagtatcatcgcttccctttcctctctcccgactcccccttgaacccactctaatcagcttccagccccacaacgcgactctcatgtagatgattaaatgacgaattgaaagtgatggtttctgattttcacattactctacttatataagcctaaagacttaagggaagatctatttctgcattgttatctttaaggtttactgaaattcaaaccggggtacttgccaattatatttttccccccaccagctccatcttcatgtcaagaaactcagtgagtagacaaccctgaaactacccctaaattcccagtgagccgaaccccagcattgctggggatccacaatcaaactccaggtttctcttctgtgcattagtggaagccaacgtagggtgcttgagggaagcatggatgtagaaaactgtgtctcacggagccctgagatttttagctataatttttgagtcaggctgctcagtcaaggctcaggctcagcctacgggagccttccaaggtcctggccttgaggatgcccaggggtctgtcaagggcttgacagaacccttttaggaccctgtgatgggccttgagacagtggcatctgagcccccagggctctggtctaggaagcatcagttttcccaccctacttctagttatgattggtgtcaggaggaagaaagaatttggggatgcaccatagggtaaatatattaaaactgtttaatccctgacaaatggcactccaaatgtggagtgcacatttggcgcgtagcgtgaatctgtgccaattcacactaccagcgtcagaacctcagtatatgatacccgattggtatcattataattttaagtgtttgtcaggttgcagtttgaaaagtggaatctcactgttatcttaattccattatgacttgtgatgtggagctcctattcctttcatagtggccatttgtatttctataaatggcctgctcagattgtttgttagctcttctattgttgtttgttctcgcatgtgtttcttgagttgtctcatcagagctctctgtatattgcaaatgtgattatttagtctgttataattgaagaagatgtttgctccctgtctctcacttgtgtttgcattttgtttcctgtgtcttcttgcatggacacttttcatttggggtgttcatacagactgctttattcaggcctcaccacaaccatgtgaggttgttcgtatttacctcagttttctttttgtttggttggttttatttacatttaataaatgctcattgagttaggtgtcagaggtactctgcacactggggatagaatcaccatagttccatgcgccaagatcacactgagggctggcggcacagtaatgagctgtatccttacagagctttccacctgtaagagtttcgggcacactcttaaacttctttttcttttcattcatgatttaaaaatgcattacttacacataattgtacatatttatggggtaccgtgtgatgtttcaacccctgtatacattgtataatcttcaagtcagggtaattaccatattcatcactttaaacatttatcatctctttgcagtgttaacatttaaaatcttctagatttaaaatcttgaagtatacactacattggtattttctatactcgctctactgtgtaatagaacaccagaactcgttctttatgtctaactgtaactttttacatttttgccaacctctcccgttgccccacacccccttccctccccagcttctggtaaccactactctagtttctgcttctgtgaaatcaactttttaagattccacatctgagtgaggtgatgtggtgtttgtctttctgtgcctggcttatttcacttaacataatgtcctccaggttcacccatgttgcctcaaatgacaggatttcattttgttttatggctggatggtattccattgtatatacaagccacatttttctttatccattcatctgtagatgggcatttaggttgattccatatcttggctattgtgaatattgctgcaacgaacacgggagtgcagatgtctcgtcaacgtgatgatttccttttctttcgctatatacccagtaacgagattgctgaatcacacagcagttctattttcaattttttgaggaatcttcatactgttttccataatgactgtagtaattttcattcccaccaacagtgcataagtgttcctctttctcaacatcctctccagcatttgctactttttgtctttttgataatagccattctaactggggcgaagtgatatcacatcgcggtttagatttgcatttcaccgatgattggtgatgttgactgttttcatatatccgttggccatttgcacatcttcttttgagaaaagtctattcaggcatttttcccaatttttaattgaattattatgaattttgctattgtttgggctccttatatattctggatattaaccccttgtcagatgcatagtttgaaaatactatttctctcattctgtaagctgtctctttactctactgattgtttcttttgctgtgcagatgctttatagtctgatataatcctattggtctatttgtgtttttgttgcctatgctttcgaggccttactgaagaaaagaatcgttgcccagttcaatttcgtgaaacgtttcccctatgttttcttctagaagtttcacagtttcaggtctgacattgcagtctttaagtcattttgatttgacttttgtatatggtgagagataggggtctggtttcattcttctgattgtgaacgtacagtttgtccagcaccatttattggggagactgtcctatcctccatgtatgttcttggctcctttgtagaaaatcagttggctgttaatgcttggatttatatctgggttccctataatgttttattggtctatgtatctgattttatgtcagtgccctgttgtattggttgcttttgtatatttcgaggtcaggtagtgtgttgtctccagctttgttcttcctgcttgggattggtttggctatcagcatcttttgtggctccatacaaatctaggattttttttttctatccggactgtcattggtattttgacagggatgtcaaatgtcgaacatggagatcactttggttaatatggacattgtaacaatattaattcgtccatgaatgtgggatctctttccatttatttgtgtgctcttcagtttcttttatcagtgttctacagttttcactgtagagatctttcatctcctagcttaagtttattgctaggattttattttttatttttttgtggctattgtaaatggaattactttcttgatttctttttcagatagtttgctattggcaaacagacatgctactgattcctgtatgctgattttatattctgcaactttaccgaattcacttattagttctaatagttacttggtgcagtctttagggttttctctatataagaccatgtcgtctgtaaacagggacaatttgacttcctcctttcaggttggatgctgttatggtttggctgtgtccccgcccagatctcatcttgaattgttgcccccataattgccacgtgttgtgggagggacctggtgggagataataaaatcttgggggcggtttcccccatactgttctcgcggtagtgaataagtctcacgagacctgttggttttataaggtgtttccccgtttgtttggctctcattttctctcttgcctgccgacatgtaagatgtgccttttgccttccatcatgattgtgaggactccctagccacgtgcaactgtgagtccattaagcctctttttaaaaaataaattacccactctcgggtatgtctttatcagcagcgtgagaacagactaatacaggcgctctttatttctttctcttgcctaattgctccggctagaactttcaatactaagttgaatttaagcagtgaaagtgagcattcttttcttgttacaaatcttagagaaaaagcgtccaactttttcctattcagtatgatattagctttcggtttatcatatgcggcctttattttgttgaggtatgttttttacctctttgcccactttgctgggagtttctatcatgaagggatgttgacattttttgaatgcttctcagcatctatcgaaatgagcatatggattttgtcctttgttctgttgatgtgaggcatcacttttattacattgcacatatattgaaccaaccttgcatccctgggatgaatcccacttgatcatgatggatgatgtttttaatgtgttgctggtgtttggttgagggttttcgcatccatgcttactagggatattggtctttagctttgttgttttgtcgtgtcctcgtctggctttggaattacagtaatgctggcctcgtaaaatgtgtttgaagctattccctcctcttcatttatttgcttgtttgtttgtttgtttgtttttaagcctttgagaagaattggtaccagttctttacatgtttggtagaattcaccagcaaatccatcaggtcctggacttttctttgatgggagagtgtttactcctgcttcaatgtcattattccttattgtttctgttcaggttttctatttctttgtgatgcaatcttggtagcttgtatgtgttcaggaacttatctgtttcttctagattttgaatttcttggcagatggttgttcatgatagtctcttatcatcatctccaccgctgttgtgccagttgtaatgtttcctttttttatctctgtttttatttgaatcttctctctgttttccttagttagtctagctaaagatttgtcaatttctttatcttttaaaaggctaactctttgttttttgatttttaagttgtttttaaaaaatctctattttgtttatttctgccctgatctttgttatttcttttcttctgccaactttgggtttttttttttttgttgttgttgttctttttctagtttcttggggcgtaacattaggttgtttatttgagatatttccacttctgttacacaggcatttattgctataaactttcctcttagaactgcatttgctgtatcccataggatttggtatgttgtgtttccattttcatctgtctcaaggaatctttaaatttcctttttcctttttaattccttcattgacccatccattgttcaggagcatgttgtttcatttccacgactttgcccagttttcaatattccctctgttattgattacttcattgtggtcagaaagtactcaatgtgattttgatttttaaaagtttgttaagacttgctttgtgaactaacgtatggtctattctgaggaatgtttcatgtgctgttgagaaaaaatatgtattctgtggcttttggatggaatgatctgtaaatatctgttaggtccatggggtctagagtgcagtttaatgccgacattaattttctgtttggttaattttctgtttggatgatctgtccactgctgaaagtggggtattaaagtccctcactattattgtattatggtcaatctctcctttcaggtcttttaatatttgctttacatatttggatgccctggtgttgggtgcatatatttataacaattataagtatttatatatatttactatatatatatttacaaaatatgtatatttacaatggttagaatatacgtatttaacaattaaatatatattacaatatatattacagttgttaaaatatatatattttgtaatatatattactatatatacaattgttacaaaaacatatgtatatatatacacacacatatatttacaattgttatatccttttgctttattgacctgtttaacatcatataatggccttctttgtctttttctttttatggttcttgacataaagtctattttatctgatctaagtagaggtactcccactctgttttgggttccatttgcatggaatgtctgtttccaaccctttgctttcagtctgtgtgtgtctttgtcggtgaagtgagtttcttctagacagtatttagttggggcttgtgtttttagccactctatgtcttttaattggagaacttagtccatttacattcaagtttatcattgacaggtaaaagtttaacactaccattttgttacctgttttctgttttttgttttttgttttttttttggtagatctgttcttcctttgttttgctcttactgtcttcttttgctgttatgtatttttctctagtagtaaatcttgattccttcctatttatattttagtgtccctattataggtttttgcttcgtggttaccatgatgagatgtataaaatatgtcttataattacaacaggttattttaaacagatagcagtttaactttaatcacaggaaaaacgaacaaaaacaaactctacactttaactcatccctccctccacactttgactttctgatgttttaagttacatctttttgtattcttatctcttaaccaattgttgtagttattactgttttgaacagttttgtcttttaggtttcatacttaagatatatttggcaacccgcgatgacaatattatagcattgtaaatctgtctgctttcttactattacctgtgagttttataccttcggatatttttttgttacatgttagtgttcttttctttcagactgaagaaaccccgttagcatctcttgtaagacaggtgttgtgttgatgatttttctcacgttttttcttttctttcttttctttttgtttcagcaagtctttttctttcttttttgctggaaggatagctttgctgaatatggtattcttgactgacagtttttttcctcttcatcacgttgaatgtatcattcctcccttccctggcctgcagggtctctggtgagaaatccactgaaagctgtattggtgacccattgagtgtgatatgttgtttttgttgtttttctcttgatgctttgagcatttttctttgcctctgatttgtttaaataatttgaatatggtgtgccttggggaatttgtctttgggttgaattttatttgtcacctctgagcttcctgtgcctgaatgctatgatctttctccagatttgggaaatttcagccgttatttttctaaatatgctttctagaccttgtattttttttttgtcttcttcagcaatttctattatgcagagtctaattttcttgatgatgtcttataattcttaaaggccttcttccctcttttaaaatgcttttgtctttttcctcctctatatatgttctgtcttggagcttacagattctttcccctgtttggtcaactctgctgttaaacctttctaatgaggttttcagttcagtcactgtattctctattttaggacttctggttttttttttttttttttaattgtttttatttctttgtcaaattttttgttttgttcctggattgttattcaaattttatttagtttgttatccatattgtcatgtaattccccaaacttctttaggattattctgaattgtctgtcagacattccatagatcttcagtttttctgggtctgttactggagtttggttggtttcttttggcgtgtcacattttgtgagttttcacaatccttgtctctttatgttgatgtctgtgtgtttaaggagatgctcacctcttccaggttttgcagctgctccttggtggtgtcaaacctttactacttaatattggaacttaatccctggccagctgttgctttcagtctggaaaagacttactgtgagcaccagaacttaaatgctccacttaactatgttgctgccctgccactgtttcttggtctggggaagacttaagcgaacactggcccattattgccaaccttttagttctttccaggtcaagggaaggctccatgtgatcacatgggcttagtgagaaatctggccagggatctgggccttcctgtgtgttgcgcccccagcagtgctgtggttctggccagtctcctcagcattggcatgcccactgatcgtggcacagagcagctgccaagatccacgtgagagttgctgtgatcagtgcacccactttctgttcccaattcaccccaggtgtttcagctctcttctggaactctgaagggtacccgtgggatagggctggaggggacttcccatgaagattcccagactgatggggaggtcacatgtccacttccagttccctccttccacctcagaaattgtgggtctagagaaattctctgtgagtagcattatgctggtttgggggaggaggtggcacagtctaacgtgactgttgttcctcttactggttgtggcttttctcagttttgtcatcccaggaagtttccttgcttctcccccaagttctagtgaaaccagggtggtattcttgcctttgattaatttgtagttgtacttttgtgggaagagtggtactgtgggatcatctgttcagccttcttgctgacgtcgctcctcctatttaccccagcgctcaaatgcagaaagcgaggctaagaaaaggtgcagggatttgtccctagattctaatccaagatcccgacctatgtgtgcctaactggaaagctatgcagtgacgtgggcccatggcaggctataggccaacattaaagccccattcatactggcctcctcctagacacagagggaacacagcatgtagcagaagaagccctcttttgtcctcagaggtgtgtgcctacttcaaagcacacaagacaaggaatggcagaagaaggggcataataatgggcctgctggacaggacacttgtagtgagggttgggagatctgggggccaggacaagacccaccactaactgtgactttgtctaagcaactggctctctcctggccacttctctaataaccagataacagttctgagccaccattgcaagtgtcggaaaggtgggttttttgaccccagctgggataaaaggaaagggggtgagacatacctccagcaatcatttcagcagcccatagctcttatcaatgcaacctctcaggcttagcagctattgctagtatcatcatgatttgcatgtaaatgactgctgctggatgatgatctggggacaaatggcatccagagcttatcccaaagggcctgatctcaaggaacctgatggatgttgcctctaggcctggtacaacaccagctgctctgtggagggggcatcccaagtaatcttcacaacccctctgtgagacgctttctttcccgctcccacaaagagtaatagcatcggtccttctcaaccacccaggactgctgtgaggagtaatgagaaagctcccaacagccctggaagatattagaaagtgagatacacctgctatgtacccacaacaacagcaacaacaaaaaaacaagaacatgaggaacatgatgcaagtccaacagattactcatccaggcaattgcagaaaacataccagagctgtgtattatgagacaaatggtcaccgacattactactaatcattaaatgcccactgatgatactattcccagtggagttacaaatgccacccaaagaatccatagctcctgtcctctcggtagatatgggaagtcactgttactggggaccaggttttgcctggcatgcccccacacgttttaccccatctagttctcacagcaagtaaataagacaagtctagctcctacctctgggaggaggctgttcaccctcccctcacaatccccagaggatgttgatggataagtaaaccaagaccaaagcctcctaacccatgctccatggtgtgtgccaatggtttatgatgtctctgcactacaggtcttgtccacccttaagtggccaattagggcctgggacagcctgcaaatattacccaacatggttgagcaccaccagttttgagcctcacctttacaccatacaccaaaacatacatgtgttatcgtgtatgtaaacaaactccaaaccaagccgaaacaagaacaggatgtgtataaatttcctgaatggggtagaattctggttatttcctgtgtaattgccaagtatgttcaacgtagcttctcagcaacccatcagctatatgaatcttagcagaaccgaagactagacccgatttcttcagcctttcactgaattctcctcctccgcctgtgatccctatctgggtcaatggtaccccagggccacaagtcactcaagccagaaacctgggtgtcatccttggccccttgcctctggaccttgccccaggcccacctccagcctaacacagcaccgttctatctatcctatgaaaagcatctctcaagtaatgccacttccctccaaaccctcctccactaattttccccacaaactttaaaacccacgagtgagtgagtgcattttctttgggcacaatttctctctatgcccatctattttctgtgattgagactagaggtgtctaaagatggccagtgaatgaataaaattgactggcagggtcacagaaacaagcaaagcccacgttgaccctcactggcatgatctcattacacttcctcatgctggagtcccaggaaagccaagtctctctttgtaatcagtgcagtgaggatgggtcagccttttatgagagtggtcttggagcgtgtgctcccccttgggatggcttaaaggttgagctgcccaccctgtgatgctgcgggcaccactctgggggttccagcgagatgcagcttttcccctacaggaaataaaccagatgaatgtgatttgatatgaccaatgtgaggtcccatcactcattagtatgtgtctggaaggcccacggttaggctccatcttctgtaggacaccagcagtcttccgactgttctcaggagtactctggcagtctgtagaattacctcaggtgaccatggggagcactggaggaggggcacgacagatgcagttttttccccattacgtcgcaccatcattttaccagtcaaaacaagtccccagtgggtgcagtgtgggaggagattgggcactgtgtggtgggaactgtctccaagcaccctgttaccggggaaccctgactccatgaatgttttagctttgctgcatgtgggactgcaagtacagtgtccccatcaccaagagcttgggctgtaactcacagttcaataggaccccctagatttgtagttggtgacagtggctcttagactgcattgctgtaatggaaggatccttgcctcagatcaaccagggactgtatcttggctccctcttgtgctggcgatgcaacctcagaatggtgatcacaccactcaccttgatccggatggtggaataataaaacaaaaacatgtgacgctcctgtaacacagcaggctgtgtaacatttcatggagctaagtacaaatgttgctgcctctgtaaggctgcccaggattcacgggaacatagcaccagagagattgaggacaggtggggcagaaaaacaagcttaatctcttgctcactcgcacagtccaatggtcttctgttcaccagaagtgctgggtgagcctggagccgtggaatttctgaccccacaccttcttctgaggcactgtcgactttactttactgacctacctgagacgtctctcaggcacggggattgtgaggtgatgtaaacgcgggtcggggggaggtgtaagcaaaggagaagaactcataactcggtcacggtcatatttcagaaacgaaggtgtaaagctgacgacccatgccttcccctattgctgacctgtctttccccattcctgcatgtgattgccctgcatgctcaaatggttcattatgcaatgggtaatgggcctgctcttgagatgcatgagcatctgttttgtgtcgctgtaacagaatacatgagactgcgtgatttataaataaaaaaatatttatttagctcatggttctgcaggctgggaagttgaagggcatggccctagcttcaggcgagggcttgtgtgctgtgtcataatgtggtgaggaaggtcaagggggaagtggacacatgcaatgagagaaaacctgaggggcatcctggctgtatagcaacctactatcttgggcactttgtccattcctgcgagcactaatccagtctcgccagagcaagaactcactcactactgtgaggagagcaccaagacacctacaaggacaaaggtggagccctcgtgacccaaacaaccgtgcactaagcctcacctcccagcaccaccaccttggggaccaaatttcaacatgagtggaatctcctgtgtatacggggctggcagaggaaagcattttctgctgtgaggctgcagagtccactggcctgcgcaatggggaaggcagggaagtcctcatggtccatccaacccaagagggcctgaggtggacgatggcaactggaggtcgaatcagcagtggagttgttcctttcaggagatgatgcgtagtgctgtggctgtgtgtgggagtcagtcagcatctggtgggtagtgggcatatggttctgggcaaagcagacttggacaatgttaggatcagattggagagccctggagagagtgtggtgctggggagaagggctccttgttgctgagtctggctacctttaaatcccatctctgccacttgggtttcaagagtgactgccaagttgtgccctatccaccagatttccccacatcatttcttgtttcaacaagtatttgcatcctaaatacacacatacaagcacaagcatgcccatgcacatgtatgcacagactctccctgacactcccttaccagtgcaatgactgagctcatggttatgacagcagctatgaaggaacgaacacccaacaagcccccagccctagggagttggaacgctgctcctcttttggactaaacatggggtttagggctaaaccccatgatgtcaagtcctagccccttttggagaagcagcaacatggagctgaacttcccccactgagttagggcccagctcaggaggacagagccattgtggggagataggtggtacctgtgccatcgaaaaagctgcagagacatgggatctaaagaactccatcactccataattaacagctctgtctgttcagtacctatgggtctcaccgtggctgttccccaggaatataggaaaagggctgtgggacttccaaatgctgtcgcctacctgaaccttaccccatctggatttcatttgagcttaaaggccctggacctctgaagaaccagagggtgagtaattcacccagcaggccctaagaaagcattttttttttttttctcccctggctttgcacaggggactgcatgagacgggggagggggagagagaattttggtgttcctgtgtcctagttaggcttcttgatgctaaagagcacatccaatatccttgtccatttactttggtgacccctggtgctgcagtttctaacagggcctcctccatggttgttagttaacagggacaattatgctccaaccgcccccctttcagaattctcctgctgatactgtgttgcaacacatatcaaggtcaccttaggaaggcaaaagaaaaaaaataaagtcctcatcttatggaaaggaacaatgcatagttggagacaaggccgtctgttggaaggggtctctgtcttgtggtggagtaggcggggcttgggagctctttgtcagtacaggggttaacgccttttctgaggtccacagattcttcctccacatgaccctctcgcctccgcatataaacaccgcccagttttcctcagatatgaagactgtgtgcattgctgggggtaagagagatgttattccgtcctcattcctgcatgtgagatgttattccgtcctcattcctgcatgtaagtgccccgccagggtcagagctgagagccgtggaaaactcaccgttgattggctacagcccatcgccaccaggacctagtaacaagcagcgctgcctcgaggaggagggcagacagcctaacagggctaaggaagatgctagctctctcccttcacaaccccaccaccaccaaagctgaccacccccagttcagccgacgtgttgaaagttacatcaaatgccacaaagcaaaaacagtcaagcgtgccagcatttatttcaggcccggtgaccgggacactggggcgagcaggggcatggagcatcagagggggctcggtcaccgttcacgcctgtgtctgtggctccggtggtctcagattccgagtgcccggtatcctcccctagggaggaaagcgagtgacaagtggaccctcgggagccctggggatttctgacttggcctgaggttctcttggtggaacaggaaggggaggcggatgggcttggtggcgagccagtgagacaggcagaggctggctccgaaggagctctcgcctgaagcacttgatgaaacatgccagggccctctggaaccggctcctccaagaccctcgcagaagagcaggttccctgggcaagcctgtgccactggatgggtcctccgcggtgtcagatacagcaaccaattcctcagggtctttttgcggccctttcacattctgaaagacagactaaataactggatcctaatgatccctcccatccctggcttccgttacgcaactgttgtgtgcatctccggccctcttccatgggtgagggatgcagcagtgacctgcgcagaccaaagcccagcctcctaggggacattccaggacaacggagggaagccagactcaccaggtcagcaggtggaaggaagggagtgaagatcatgcttccaggagtgtgtgatgtgccggtagggaccaacaggacttcaatgaagacaccggcgaagctcgtcactctgcccggtgcaaagaggccgagggcctgccccctccacgccccattcagcccctctgcccctgccccatcgtccctccccccctacagcctggtgctccagcaggggatacatttctggcatgtcgcattccatttgtttctgtatctcttactcccagtcctccaatctttctttcctttgctgctgcttcctggccctctcagcaggctcgagccacgtttctccttgccgagcagaaaaagcagaggtcttcaagctggtgatgagtcatcatttggtggggatgccacagacccgagtgtccatgtgggtgctctcctgcctttgattcacaggattatgtacatggatgccctgggcaggtgtatgagtccaaatgagtcgtcacagcaaggagcgtgagctgggtaatggtatccagagtccaaatcaacagcagttttcttttcagaggtttacgtgagactccacgtctatgtaccagtcagtatcaggtggtttagggcctggagggcttggaaaatgtgagagagagggagaggtgaagggcctgggctggggtgagttgaaagtagaacagccgaccagcctgggcagcatagggagaccccacccccacagaaaatttcaaaagtagcctggcatggtggcacacacctctagccccacctactcaggaggctgaggggggaggattgcttgagcctgggaggcggaggctgcaatgagccgtgatggcaccactccactgcactccaggctgggagacagaaggagactctgtctcaaaaacaaactgacaaatcaaacaaacaaacaaaagaaagtagaagagcagaggtgaaagctccttgttgcctagtcttgctatgtcaaaatcaggctttgacatttgggttacaagcaatgctgccaagttatgccccccgtttgctaaccaggtctgtgcggtccgcaccgctgacttcacaggagctccctgcaaacagtaccctgaagggaaagtggaagtaggtggcctcagagtctttctttggcttttgaaacaatagtgctgtttaggaaagcatctcttacataatcctgaggctacagagttgatctctgtgagcctatcatgggccgtgccctgaatgaggctctgcttcaagctcttctgtgagggagaaaccgagagaggcatgaatgtaacagagagtgatggagggacgtttatggggctacgggaggactgaggaggcgggcagtcactcagccttgggaattggaacggagtcagtgaagagttcccagaggaggcgtgcctgaaaggagggacaaaagaaattggccaagaaatagagaaaagggagagcatcacaagtagaagcccaagacaataccgtgaggttttgcaactgaaaatatgtaggcctggttttctgttctagggtttaatagaagtcaaagtcagtcacgaggttccagtacaggaacctgaaaagctgtgcctcacagagacactgaaccctggtttttgagaacccaaagggtatatttttaatagaattttgatatatattgatttaatagaatttgataatagaattttgatcaatagcagtccattgatcatttttccagtgtgattcatgctttcatgtgtcctaccctaagatatcgttgcctagcctcacaacagagattttctcttctgatgtttgtaggttttaatattttgcaatttacacttagatctaggatttattttgaattaatgcctgcatgaagtgtgaataatgtcgggatgaatggtgagatattgaagttgtttgggtcttccgtaaagagatctactttttccagcactattagttaattgtcagctaatttaattatctttgagcctttattagaaatcaacttactatatatatgtaagtctatttctagcccttcttctatttcatccaatgatccctatgtgaattcttaaggtcataccaggctgtcatgattaccatgtctttatattaagtcagagactttggtgatgtgagtccttcatgcttgttcttttccaaatggctttggatcttctatgtcatttgcatttatatataacttttgagaaacagttcttcactttaattatgattatggtgagcctatagatccattacttgagaattgacatcttaacctgagtcttctgatcaacgaacattatatatctctgtttatttaggtctccactttctctcgccagtattttatagtggtctgcatacaggtctttcacatattacattaaaattctcaatagatacctcatttattttgctgtaattataaatgacattttaaataatgtcatctccaattatttgttcccagtatgttgaaacacagtgggtttttgtatgttgagtttctgtcttgtaactttgttatgtgacttgttaggtctaggagatgtttatccccacattccttagtattttgtatgtagactatcatgctatttgtaaatggagaggttttttttattccttcctattcaatctgtatgccttttacttattttccttggctcattgcactagctgggacctcaaggataattgtatacgcatagtaagagtctgccttatttttaatcttatgggagaagcattcagtatttcaccattaggcatggtgccagctgcaggttttttgtaggagtactttattaggttgaggacgttgctttatgtacttatcaagtggtttgggttttttggtcatgaatgggtgttttatgttatcaaattacttttctgttatatatctggataataaatgctcttttcttttattccattaatatggtgaaatatagtcacggatttttaatggtaaaatgaccttacattcccaggacagactgtgcttggtaatagattatttttttttcatatattattggattcaagttgctaaaattttatcaaggagttttgtaactatgttcattaggaacactggtttgtagttcctttttttcttctggtatcttttttctattttttttttttaaataaaagtaatgctgccatcataaaatgaactggaaagtgttccctcctgtattttctaaaagtgttcttttgggactactactatgttttctttaaatgtatgacactgctaaccagtaaatctattgaagactgaagttttctttatgatttacaaatacggttttaaaaagtctccacataaccattcttttaaccttaacaaggtctttagggatgattaccaattaattatatgtagttattagaagagtgtgcttaaaaaattttcctcagcttttaaatgtcttattttctttcttcttttctttaatttttatttttctttatttcttctaaaacaattaacgggatacatgtgcagaacgtgcgggtttgttacataagtatacgtgtgccatggtggtttgctgcacctattgacccatcctctaagttgcctcccctcatcccctaccccccaacagctcctggtgtgtgtccttcccctctctgtgtccatgtattctcattgttcaactcccacttctgagtgagaacgtgcggtgtttggttttctgttcctgtgttagtttgctgagaatgatggtttccagcttcatccatgtccctgcaaaggacatgatcccattcctttttatggctacgtagtattccatggtgtatatgtaccacattttctttatccagtttatcattgatggacatttgggttggttccaagtctttgctattgtaaatagtgcctgcaataaacgtacatgtgcatgtatctttatagtagaatgatttatattcctttgggtatatacccattaatgggattgctgggtcaaatggtatttctggttctagatccttgaggaatcaccacactggcttccacgatggttgaactaatttacgttcccaccgacagcgtaaaagcgttcccatttctccacagccttgccggcatctatcgtttcttgacatttttaataatcgccattctgactggcataagttggtatctcattgtggttttgatttgcatttctctgatgatgagtgatgttgagctttttttcatatgtttgttggccatgtaaatgtcttcttttgagaagtgtctgttcatatcctttgtccactttttgatgggattgtttgttttttttttcttgtaaatttgtttaagtgccctgtaaattctggatattagccctttgttagatgggtagattgcaatgattttctcccgttctgtaggttgcctgttcattctgatgcttgtttcttttgctgtgcagaagctctttagtttaattagattccatttgtcaattttggtttttgttgcaattgcttttggcgttttcgtcatgaagtctttgcccattcctatgtcccgaatagtattgcctaggttttcttctagggtttttatggttttgggttttacatttaagtctttaatccaccttgagttaatttttgtataaggtctgaggaaggggtccagtttctgttttctgcgtatggctagccagttttcccagcaccatttatttaataggagatcctttccccttgtttttgtcaggtttttcgaagatcagatggttgtagatgtgtggtgttatttctgcggtctctattctgttccattggtccatatgtctgttttggtaccagtaccatgctgttttggttactgtagacttgtagtatagtttgaagtcaggtagcgtgatgcccccagttttgttcttcttgcttaggattgtcttcgctatatggggtcttctttgattccatatgaaacttaaagtagtttttcttctagttctgtgaagaaagtcaatggtcttgatgggaatagcattgaatctataaattactttgggcagtatggccattttcacgatattgattcttcctattcatgagcatggaatgttcttccatttgtgtcctctcttatttccttgagcagtggtttgtagttctccttgaagaggtccttcacatcccttgtgagttgtattcctaggtattttattttctttgtagcaaagaagaaatcatgggaattcactcatgatttggctctctgcttgtctattattggtgtataggaatgcttgcgatttttgcacattgatctttgtatcctgagactttgctgaagttgcttaccagctgaaggagattttgggctgagacgatggagttgtctaaatatactgtcatgacatctgcaaacagagacaatttgagttactctcttcttatttgaatacgctttatttctttcccttgcctgattgtcccggccagaacttccaattctatgttgaataggagtgatgagagagggcatccttgtcttgtgccggttttcaaagggaatgtttccgtgtttgtcataaatagctcttattattttgagatatgttccatcaatacctagtttatcgagggtttttagcatgaaggggtgttgaattttattggaggtcttttctgcgactattgagataatcatgtggtttttgtcattggttctgtctatgtgatggattacggttactgatttgcgtatgttgaagtagccttgcatcccagggatgaggccgacttgatcgtggtggatgagctttctgatgtgctgcgggattcggtttggcagtattttattgagggcttttgtgtggacgttcatcagggatattggcctgaaattttctttatttgttgtgtctcttccaagttttggaatcaggatgatgctggcctcataaaatgagttagggaggagtccctctttttctatcgtttgaaatactttcagaaggaatggtaccagctcctctttgtacctctggtagaatttggctgtgaatccgtctggtcctgggcttttgttggtcagtaggctattagttactgcctcaattgtaattttccttttaatgtggtgcatcacattaattaatttgcacgtgttgaaccatccttgcttgcttcccagaaatagatcctgcttagtcatggtgaacgatccttttaatgtgctcctgagtttggtttgctcgtattttgttgagaatttctgcctctatgttcatcagagatattgtcctcctgcttccttttcttgaagtgttttcatcaggctttggtatcagggtgaccctggcctcatagaacgaacttgacagcattctctcttcttcaagctttgggaagcgtttgagaaggtttggggttaattttctttaaatgcttggtagaactcaccagggaagccatctggtccttagcttttctttaatgggaagtttttgattactgatccaatctccttactccttattgttctgtacagattttctgttttttttaatgatgcaggcttggttggttgtatgcatctatgaatttatccacttctgggctgacccatttattgctgcgtaattgttcacagttgtctcttatggttctttttatatttctggcatcaattgtaaagtctcttctttcatttctgattttatttccctgattcttctctcttttcttctcatttagtctggctaaaggtttgttaattttgtttatcttttcaaaaaaccaactcttattttcactgattattttcctgtggtcttctattccctattttttttttatttctgctctaattttttattatttcattctttctgctaactttggagttagtttgttcttcttttcctagttcctggagataaaaagtaaatttagtccaggcgccgtgactcacgcctgtaattccagcactctgggaggccgaggcgggtggatcacgaggtgaggagattgagaccatcctggccagcatggtgaaaccccgtctctactaaaatacaaaaaattagccgggcgtgggcgcctgcagtcccagctactcgggaggctgaggcaggagaatggcttgaacccaggaggcagaggttgcagtaagctgagattgcgccactgcactccagcctggaaacagagcgagactccgtctcagaataaaataataaataaataaataaaataaaaattaaaataaaaaataaatttaatggacatcaatatattttgtttaaatctatgtacttgctgtttgttttctattttcccatttgttctttactcctctcgtccattttttttcatctcatcacattttggttgggcgttttaggattccatttgtcttcactactgtcttattagctgtatctatttcaatttatttaaatggttgctcaacttaccacactctatcttcaagtaatactatagcatttcacatacagtgcttcaatctcactggagtataccttatttttctcctcttttttttttttttgcagtgctattgttacgcattttatttctacatatgctataacatatgtatgttataaacatcattccgctttcaagttagttataaactgtcagttgtcatttatatatatatttttttaaatgaggaaaaaagctatcttttatatatagccataggtttcattcattcctcttggtcaatcctagtttccacgtggtatcattttacttctgcctatatttacttctgcctgtatttttttggggggagaaatggctgttcacatcttttgcccatttctcaatgaggttatatgttttattattaatttctaaaactaatttctgtaatctagatacaagtcacttataagttatatgatttgcaaatactttctcccattctggggcttcttttttcacattcttgatggtattattaattgcagcaaaaagtttttaattttaatgaaagtcctgtttatcctatcccattgtagttttggtttgcatttctctgatgatcaatgatgttgagtacctttccgtatgtctgtttgccatatatgtgtcttcttttgagacgtgtctattcagatcctttgcctattttttaatcggattattacattttttccctatagagttgtttgagctccttatgtactgtggttattaatctcttgtcagacaggtagtttgcaaatattttctcccattctgtgggtttgcctctttactttgttgatgaacaaaggattccacttgagactcctagtttcattgattttgcccccatggttttctattctctattttgttttcaatgttgacggtttcctttgctgtggcagaagcttttcaacttgatgtgatcccattggtctatttttttttcttgctttggttgcctgtgtgtgcggggtattactcaagaaatctttgcccagtgcaatatactggagagtttcccctaatgttttcttttagtagtttcatagtttgaagtcttagatttaagtctgtaatctattttaatttgatttttgtgtaagttgaaagatagaggtccagtttcatgcttctgcatgtgaatatccagttttcccagcaccatttattgaagagactcttttctctagtgcatgtttttggcacctttgtggaaaatgagttcactgtaggtgtgtggatttgtttctgggctctctattctgttccattgatctatgtgtctgtttctatgccagtaccgtgcctttttggttactatagctctgtagtataatttgaagtcaggtaatatgattcctccagttttgttctttttgctcaggatagcctttgctcttcttttggcaatctgtagattgttttggatagtatgaatattttaacaataataattcttccaatcaatgaacatggaatagcttttcatatttttgcaatccccttcaatttctttcatcagtgttttacagcgttccttgtagagattttcacttcctttgttaattcctaggtattttattttattgatagctattgtaaatgggattactttattgatttcttttccagattgttcacagttggtagtgattttcgtatgttgattttgtatcctgggactttactgaattcgtttatcagtgctaatagttttttggtggggtctttaggtttttccaaacataagattatgtcatatgcaaacaaggataatttggctttttcctctgtaattttgacaccctttatttctttctcttgtctgactgctctagctagaacttcctgtactatgttgaataacagtggtgaaagtgggcatccttgtcatgttccagatcttagaggaaaggctttcagtttttgcccattcagtatgatactagctgtgggtgtgtcatatatgacttttattatgctgaggtttgttccttctatactcagtttctgcagagtttttataatgaagggatgttgaattttatcaaatgctttctcagcatcctttgaaattatcatatgtttttgtccctcattctgttaatatgatacatcacattgactgatttgcatatgtcgaatcatccttccatctctgggataaatcccatttggtcatgatgaattatctttttaatgtgttggtgaattcggtttgtgagtgagtattttgttgaggatttttgcatcaatgttcatcagggatattggcctatagttttctgcgtgtgtgtatgtgtgtgtgtgtgtgtgtgtgtgtgtgtgtgtgtctttgtctggttttggtatcaggaaaacactcatagaatgagttcagaagtattccctcctcctctaccttttgaagtactttgagtaggattggtatttgttcttctttaaatgtttggcgcaattcagcagtgaagccattgggtaccaggctttactttgctgggagactttaattatggcttccatctcattacttgttattgttctgttcaggttttaaatttcctcatggttccatctttgtaggttgtatgtgtgtatgaacttatccatttcttcaaggttttcaaatctacaggcatatagttgctcacagtagcctctaacgatcctttgaatttctgcactatcagttgtaatgtctcccttatcatccctgattttatttatttggttcttttcttttatttctcatttattctggctaaaagtgggtccatttggtttctcttttgaaaaaaccaacttttcatttcattgatcttgtgcattgttttcttcgtttagattttatgtatttctgctctgatctttattatttcttttcttctattaattttgagattggtttgctcttgcttttctagtttcttaagatgcactgttaggttgttaggttgtttacctgaagtttttctacttttttgatataggggcttataactgttaagcttcccgcttagtattgcttttgctgcaacccacaggttttggcagtttgtgtttccactatcatttgttttaagacatttttcaatttccttcttaattttttcattgacccactgctcattcaggaacacattctttaaattgcacatttttgtatagttcccaaaatttcccttgttattggtttcaagttttattccattttggtcacagaagatacttgatattatttcaattttttgaatgttttaagatttgtcttgtggcctaacatgcggcatatccttgagaacttatccacgtgctgaggagaatgatgtgtattctacagctgttggaggaaatgttctgtaaatacctgttaggtccatttggtgtatcgtgcagagcaagtccgatatttctttgttgagtttctgtctggatgatctgttcaacgctcaaaatggggtgttgacgtctccaactattgtttgtctttcaacactgtaagtcttttagtttgtttccacgatgcttcgtggttttgcagagtataagttttgcactttctgttaggtttattcccatgtattttattatttctgctgctattgcaaatggaattgttttcttaattttgtattcaatgtcctttttgctactctataggaatagaaattattttcgtgtattgacattgtattccttcactttgccaaattcagtatttgtctttaaagtcttttagtggattccttaagattctataattacaagatgatgccgtatgctaatagaggtagttttatgtcttcatttcccatctttttgaaaaccaggtaccatggccacaaccctcaatacattgttgagtagtagtggctacatcaggcatccttgtgctgtttcagacattaagggtaaaagattcggtcttctgccattaaatatgatgttacctgtgggtgttctttatcataggtgctctttatcagtttgaggaaaattcccttctattcccagttttttttttcttgagtgtatttcttatgacaggctgttgaactttttcaaatgcttcttctgcataaattgagatgaatacgtgttttttgaatgattatctgttcatatgataaaatccatttattgatgtgtagctgttaaagcaaccttatgtgcctgagataaatgccacttggtcaccgagtataaatatttttgtatgttgctggatttggtttgctaatattttgttggggattttttctgtcctattcatagttttgcttttgagtctatatatgattttgttgccaggcttatgagttatgaagttttccctcctcttctatttttttggaagaactgttgaagaattgctattaattcttatttacatatttagtagaattaaccattgaagccatctgagcctgatctttttttctgggtagtttttttgctttttgttttttgtttttaattactatttcattctgtttcattttcatagatctatttaacttgtgtatttctcctccagccagtttgcatggtatatgtatacctagaaattcatccatttcatctaagccatcaaatctattggcatacaattgttcatattatttctttataattctttatttttccataatgtagatagcagtgtctcctctttctttcttgatttcagcgaatagaacctcctcacttttctcttgatcaatctggcttacagtttgtcaattttgttgacttcttcaaggaatcagatttttgtttcattggtttatctctgttatttttccactcttcatttcattaattcatgctctaatcagtgtccacttttctcttcgatttgcttaggtttagtttgctctttttcccagggtctcaatgcggagggtaaggttattgacccgagatatttctttttttttttttttgttttttgagacggagtctcgctgtcgcccaggctggagtgcagtggcgcaatctcggcccactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccacccgcctcggcctcccaaccgagatgtttcttatttttttttagtatcagcatttagagctatacattttcttctaagcactgcttaactgcatcccaaaagtttgacatgctgagtcttcattttcatatatctcaaaaagtattttctagtttcccttttgatttcttctctgacccttgattatttaggagtttgttgatttctttatgctcatgtatttcccactaatgtatgttttattgatgtataacttcattccattgtggtttgggggcctactttatattatttctatccttttacatttattaaggtgttttatagcccaccgtatggtctatcctggagaacatttcaggtgtacttgagaagaacatatattctgatgttgttgggtgtagtgttctataaatgtctgttaggaccatttgatttattgctttttcaaatctagtatatccttgttggtattctgactagcttttctattcattattgaaagcaaggtattgaagtctcaaacaatgattgctgaattatctattccccttttcatttctgtcagcatttacttcaggtattttggtgttctgttgtgcagtgcaaatatatttataatttatatatcttcctcttcacacttttataattgtagaatgttcatgttttatctctagtcatagtttgtgttttaaactctattttttctggggttgacaaaactactccagctctcttgcggttgctgttttcagtgtatttattttctcaaccttttacattctaactatttgtgcctttgaatccgaagtgtgtgtcttgtagacagcatctagttcaaccatgtttttattacatcctgccaatatctgctttaaaatacatttgtattgttcagtctattcacactgaacttaatgtaattacttaatgtaattactgttggggtagaatttatgcctgccgttttttgtattttctttctcatgtcttactgttcctctgtccctgcactgacgtattcttttctgctaaacagatattttctcatatactctattcatttacctgttgtttctttattgtatttttgggttgttttcttagtggttgccccacagattacagatcacattttaactcaaaagaatctagttcagattgataccaccttaatttcaatattacacaaaactgtgaccctataaagctgaagagtctcttctcctttgtgctactattgtcataaaattacttctttatacctgtgatgcccatctaggtagttctataatgattgctttatgcaacaattgtcctttaaatcaggtaaaagaagggaagagttacaaacaacaatacattcgtacagtcttttatcaatgctgttgtagttagttacctttaatggtgttcttatttattcatcgggatttgagttactgtctactgtcttttccagatttccctttaatatttttttgtaagggaagtctgctgatgatacattgactcagcttttctttatcaggggatagctttacttcatcatcatttttgagggagagtatttctggatggaacattcttggttaactgtttgttgttgttgttgttgttttcattaacccctttgactgtgacttctcactaccttttggtccccttggtttctgataagaactcggttgttaatcttactggggatcccttgtgtgtggtgagctgtttttctttgctgctttccacattctctcattgtctttgattttcaacagtttggctaagatgtgcctcggtgaagattttcttgaattcatcctctttggagtttctgtggttctcatttgtgtccattaataatttgaatcaaacttggggagtttgggccattattgtttcaaatgttctctctttctcgagttcccatttctgttgagcccctctagtgagtttttcgctgtagttattgtacatttccacttcagaatttctgcttgggtgttttaaaaacactaatttatattctgtgatgatttctctatttgttgagacatcattctcatacttctctttaattcttttcacatggtttcctttagttgtttgaacatattcacaatagctgatttgaagtctttttctagtaagtccaatgtctgagcttctctctgcgtgttccatactctcctgtttctttgcacgtctcgtaagttttttgttgaaaactggacactttaactaatagaacgtggcaacgctgaaattcagactctcccttctttcaaggtattgttgttgttgtttggtgctattaatcctgctgtcacttgtttgtttagtgacttttctgaactacttctgtaaagtctgtatcctctgttatgtgtggctactgaatgccctgcttggttggcttagtggtgacctggtgattggacagagatgtctttatatgcctggaaaaggtaagtttcccagtcattgccatggggctctgtggatatgttggacatgccttcaactcgcagccaggcaattgacaactctttcacagagcctcaaaataaaccagagttggccgtttaggcaccttttgggtctttgcagaccatgtcatagtcctaggtgagtgtctggccttctagattcccaggaataggtaatcgcttttaaaagtcccaatggacacctcgttacctagatttccttttaaggtatcggttagcctattgtgtgccccaagtgttatccattgcctgaggcagctgcaatattgagcaattgcctccaaatatttttcacaaatgcatccagggaaaaaggcgtttcaaactgggcacactctgagtcagtccaaataaagacagccatgtaagtagggccttcccgggaactaccagacagatcaaataatgacaattctcgggaatgcggctttgcaggagctccaaccctgttctgttccctctggtggctgccaggctgctggttttcaccatgattgcaggctgttggtattcaaggctaccatggagctgcataaagggccatgaggatagggctagttgaaatgtcacatagttcactgttcctaaaaagattctgctgtttttcttgaataaacacgcccaaggttgcccctcagctttaggtgaatttgcaggtttccgaaaacattcattttgacaatttttgccagttttctcattgcatttacgaaggggagaatttttagaggtccttacgttgctgatgttgctgactctctgcacgagttttcattatacctatccatgagggtgtctgttgttaggtggtccctctgtgctcggaacttacgtatctctcaataatcactttacgggttaccgaccatgtgaaagggaccacaaccggagctctagaagcaaagatgtatagctcaccacctttgatctcaaagttgtcattctcaagtagattccatttaaccaaaacatttaaagccttatgatcaccaagcctgcatctggtcaccaaattatttcttaattcagtaagatgggggcagggatggaggatcaaggatgtgggctgtttttggccaccgtgtcttaaatataaccaggcttttacctgcatatttggcagcagcctggctagtatctcttgtcacaacaggttttattcctagccacttcagaagtggctgggagcctcagggagtaagagtgcagatgaggtgctgcagagatgtcccatatgaagagctagaaactgaaatttatttcaacaactgggcttggttttgaataactccttagcaccaatctaggatttcccactgaaatggcttgatttatatcgatgcagcccaccacctgggcagttattaataggcctttaggtagaaagcagcagggacccaagagactgctctttacaccacagcgtggaaacataactccatccctctccttttgaatcaacctctgcatatcaacaaacatcacatggtcattgatcgaggatcccgttagtaacctaagacttgagtttacatagaataacctgtctctgaaaccctttgaactgaagctgctaacttactcacaacctgtttgttgagggcgtgacttctcaaagtattctggtgccttggataaatatgtctgtaaagttgccaagagccttcaaatgacagtataatgtttaagagtcagacaaattttactctgaatccaggctctgccactttctttcccgtgaccatggataaatgacttagcttccctcaacctcagattcctaacttgcaaaactgaggataagactaaagggattgtaggaattaaagatgacaatacgtgtaaagcatgtggtgcactatccggcagccagctaatgcttcaaaaaatattaggtttagttactattgagcaacgtctttttttattttcatttttatttttatttttatttttattatactttaagttctggggtacatgtacagaacgtgcaggtttgttacataggtatacatgtgccatggtggttttatgcacccatcaacccgtcatctacattaggtatttctcctaatgctatccctcccccagccccccacccccggacaggacccggtgtgttatgttcccctccctgtgtccatgtgttctcattgttcaactcccacttatcagtgagaacatgtggtgtttgattctccgctcttgtgttagtttgctgagaatgatggcttccagcttcatccatgtccctgcaaaggacattaactcacccttttttatggctgcatagtattccacggtgtacgtgtgccacattttcttctttatccagtctatcattgatgggcatttgggttggttccaagtctttgctattgtgaacagtgccgcaataaacatacgtgtacatgtgtctttatagtggaatgacttataatccttcgggtgtacacccagtaatggcattgctgggccaaatggtatttctagttctaaatccttgaggcatcaccacactttcttccgtttgaactaattcacactcccaccaacagtgtaaaagcgttcctgtttctccacatcctctccagcatctgacgtttcctgactttttaatgactgccgttctaactggtgtcagatggtatctcactgtggttttgatttgcatttctctaatgatcggtgatgatgagcatttttttcatatgtttgttggctgcataaatgttttcttttgagaagtgtctgttcatatcctttgcccactttttgatggggaagtttgtttttttccttgtgaatttgtttaacttatttgtagatcctggatattagccctttgtcagatggatagagtgcaaaaattttctccctttctgtaggttgcctgttccctctgatgatagttccttttgctgtgcagaagctctttcatttaattagatcccatttgtcaattttggcttttgttgccattgcttttgctgttttagtcgtgagatctttgcccatgcctatgtcctgaatggtattgcctaggttttcttctaggatttttatggttttaggtcttatgtttaactttttaatccatcttgagttaatttttgtataaggtgtaaggaagggatccagtttcagctttctgcatatggctagccaattttcccaacaccatttattaaatagggaatcttttctccattgcttgtttttgtcagggttgtcagagatcaggtggttgtagatgcgtggtgttattttggaggcctctgttctgttccattgttctatatatctgttttgctaccagtacctcgctgttttggttactgtagccttgtaatgtagtttgaagtcaggtagcctgatgcctccagctttgttcttttggcttaggattgtcttggctatgtggcctcttttttggttccacatgagctttaaagtagttttttccaattctgtgaagaaagtcaatggggatagcattgaatctataaattactttgggcagtatggccattttcacaatattgattcttcctatccatgaacatggaatgctcttccatgtgtttgtgtcctcttttaatgccttgagcagtggtttgtagttctccttgaagaggtccttcgtatcccttgtcagttgtattcctgggtattttattctcttagtagcagtcgtgaatgggagttcactcatgatttggctctctgtttgtctgttacgggtgtgtaggaatgcttgtgattttttgaccttgatttcgtatcctgagattttgctgaagttgcttatcagctgaaggagattttgggctgagacgatggggttttctaaatatacagtcatgtcatctgcaagcagagacaatttgacttcctcttttcctaattgaataccctttatttctttctcttgcctgatttccctggccagatcttccaatactatgttgaataggagtggtgagagagggcatccttgtcttgtgccagttttcaaagggaatgcttccagtttttgcccattcagtatgatattggctgtgggtttctcataaataactcttattattttgagatacgttccatgaatacctagtttattgagagtttttagcatgaagggctgttgaattttgttgaagaccttttctgcatctgttgagataatcatgtggtttttgtcattggttctgcttatgtgacggattacgtttattgatttgtgtatgttgaagcagccttccatcccagggatggagccgacttgatcgtgatggataagctttttgatgtgctgctgtatttggtttagccagtattttgttgaggattttcccatcgattttcgtcagggatattggcctgaaatttcctttttttgttgtgtctctgccaggttttggtatcaggatgatgctggcctcataaaatgagttcaggaggtttccctctttttctattgtttggattcgtttcagaaggaatggtaccagctcctctttgtacctctggtagaattcggctgtgaatccgtctggtcctggacatgttttggttggtaggttattaattactgcctcaatttcagaacttgttattggtctattcagggatttgacttcttcctgatttagtcttgggagggtgtatgtgtccaggaatttatcgatttcttcgagattttctagtttatttgcatagaggtgtctatagtattctctggtggtagtttgtatttctgtgggatcggtggtgacgtcccctttatcattttttattgcgtctgtttgattcttctctcttttcttctttattagtctggctagcggtctacctattttgttgatcttttcaaaaaaccagctcctggattcattgattttttgaagggttttttgtgtctctctctctccttcagttctgctttgatcttagttatttcttatcttctgctagcttttgaatttgtttgctcttgcttctctagttcttttaattgtgacgttacagtgtcgattttagatctttcctgctttctcttgtgggcatttagtgctatgaatttccctctacacactgctttgaatgcgtcccagagattctggtacgtggtgtctttgttctcatcggtttcaaagaacatctttatttctgccttcatttcgttatttagccagtagtcattcgggaacaggttgttcagtttccatgtagttgtgcggttttgagtgagtttcttaattctgagttcaatttcattgcactgcggtctgagagacagtttgttatgatttccattttttcgtttgcatttgctgaggagtgttttacttccaattgtgtggtcagttttagaataagtgcgatggggtgctgagaggaatgtatattccgttgacttggggtggagagttctgtagatgtccgttaggtctgcttcacccactattattgtgtgcgagtctaagtctctttgtaggtctctaaggacttgccttatgaggctgggtgctccggtattgggtgcatatgcatttaggatagttagctcttcctgttgcattgatccctttaccattatgtaatgcccttctttgtctcttttgatcctcgttgatttaaagtctgcttcatcagagactaggattgcaacccctgcttttctttgctttccatttgcttggtaaatcttcctccatccctttgttttgagcctatgtgtgtctttgcccgtgagatgggtctcctgaatacagcacaccgatgggtcctgactctttatccaatttgccagtctgtgtcttttaagtggggcacttagcccgtttacatttaaggttaatgttgttatgtgtgaattcgttcctgtcaatatgatgctagctggttattttgcctgttacttgatgcagtttcttcatagcgtcgatggtctttacaatttggcatgtttttgcagtggctgataccggttgttcctttccgtattgagtgcttccctcaggagctcttgtaaggcaggcctggtggtgaccaaatctctcagcatttgcttgtctgtaaaggattttatttctccttcacttatgaagcttagtttggctggatatgaaattctgggttgaaaatccttttctgtaagaatgttgaatattgagccccactctcttctggcttgtaggatttcttcagagagatccgctgttagtctgatgggattccctttgtgggtaacccggcctttctctctggctgtgctttaacatttttttccttcatttcaaccttggtgaatctgacgattatgtgtcttgggtttgctcttcttgaggaatatctttgtggtgttctctgtatttcccgaatttgaatgttggcctgtcttgctaggttggggaagttctcttggataatatcctgaagagtgtcttccaacttggttccattctccccgtcaccttcaggtacaccaatcaaacgtaggtttggtcttttcacatagtcccatatttcttggagactttgttcgtttcttttcacccttttttctctaatcttgtcttctcgctttatttcattgagttgatcttcaatctctgatatcctttcttccacttgattgattcggctattgatacttgtgtatgcttcacgaagttctcgtgctgtttttttcagctccatcaggtcatccatgttcttctctaaactggttatcctagttagcaattcatcgaaccctttttcaaggtccttagcttccttgcgttgggttagaacgtgctcctttagcttggaggagtttgttattacccaccttctgaagcctacttcggtcaattagtcaaactcattctccgtccagttttgttcccttgatggtgaggagttgtgatcctttggaggagaagaggtgttctggtttttggaattttcagcctttttgcgctggtttctccacatcttcgtggatttatctacctttggtctttgatgttggtgaccttcagatggggtctctgagtggacgtcctttttgttgatgttgataccgttcctttctgtttgttagttttccttctaacagtcaggcctctctgctgcaggtctgctggagtttgctggaggtccactacagaccctgtttgcctgggtatcaccaacggaagctgcagaacagcaaagattgctgcctggtccttcctctggaagcttcgtcccagaggggcaccccccacatgccagccagagctctcctgtatgaggtgtctgttggaccctactgggaggtgtctcccagtcaggatacatgggggtcagggacccacttgaggaggcagtccttcccttatcacagcctgaacactgtgctggaagaactgctgctctcttcaaagctgtcaggcagggacgtttaagtctgctgaagctgtgcccacagccgccccttcccccaggtgctctgtcccagggagatgggggttttatctgaaagtccctgcctggggatgctgcctttttttcagagatgccctgcttagagaggaggaatctagagaggcagtcatccttgctgagctgcggtggactccgcccagttcaaacttcccagaggctttgtttacacagtgagggtaaaaccgcctactcaagcctcggcagtggcggatgctcctccccccaccaagctcgagcatcccaggtcgacctcagactgctgtgctagcagcgagaatttcaagccagtggatcttagcttgcggggctccgtgggggtgggacccgctgagccaggcgctggagagaatctcctggtctgccggttgtgaagaccatgcgaaaagtgcagtatctgggctggaatgtactgttcctcccggtacagtctatcacagcttcccttggctaggaaagggaaatcccctgaccccttgtgcttcctgggtgaggcgacaccccaccctgctctggcttgccctccgtgggctgcacgcactgtccatccagtaccaacgagatgaactggatacttcagttagaaatgcagaaatcgcccgccttctgcgtcgatctcactgggagctgcagaccggagctgttcctatttggccattttgccagctctacctgtgagcaacctcttaatgccataaacacccagtctgttttagtgacccaaattaagagatttggaatccagttgcctcacctgaccaacagtgagctgcttttcccctgtgtttccacggacgtaaagtggccagggagagagatccttcatgttcatgactctccctgatatgcttagtgatgctaggtgacaacacaatcaattctcctcaaattaatgcacttacataatggccaatttgccacatttactgaatttcctgattgtcattttaacagctttcacaggagtactaatttttggttattaaagatgaaatatacctttctgaatattaactcagtggaggtggacataccttaggaactggggaaaaatccagaattaaagactgaaaattttctgaattattattttttcaatccaaaatctggcagtttgcatatgatagagttccttaaatattcttgatatacgtgggagtctttcaaataccattaaaaaaaatctattcaacatacgtgctttttttttttcttagtgttctcttgcatttttttcaatggctttatcagacagaattgcttattttgattgggaataaagatggttgaccaaatgcagctgggatgtgcctcttccccagagaggaagcaaaatattaagtaaatctgcacacttcaaacacatcttttgagagaaaacatgggaattcaataaaggggcaatggaagacactgtggtggaagagggaggaagcaggactgcctgtttggtattgctgggtgccacgactggcccctggacacagactggacccgaggaagtggtgagtgaaggaaccctaaggcaccacattcctgctgtggacctctgagatcctagacacaggagttccctttgggctggcaggcagagctacagggagaagatgcagaggcactgcttgaacctgtgtggagcccaaaaggcttcagtgtgctgggcagctgcagcaaaacatggctctaggtgcccacccccaaggctccgtgtcctgccctaagcagctgcagctcctactgtctgctgggccgggagatagcggagtccaggcgtgctcatgtgcccaacacaggccccgctgccattgccctgggaccaaggtgcatctgagccacatgcccccgtgtttgcccctccttcccaagactgcctgcctggctatttctgtggtggtgggggttggggagggcaggaggggagggggagggggagggggtgggggaagaggaggaaattcttcctaattcattctataaggccagcattaccctgatgcccagaccagacaaagacacagtgaaaaagaggaagctgccggccagtgtccctgatgaacacaggtgcaaaaatcttcaacaaaatactaacaaactgaatccaacagcacatcaaaaagataatacaccacgatcaattgggatctatcccagaaatgcaaggatggttcaacacacacgaatcaataatctgtctcatcaacagaacaaagattgaaaatgatatgatcagctcagtagatgcagaaaaagtgttggacaaaatgcagcgtcacttcatgataaaagctctcaacaaattaggtacaaatggaatatacctcaacataataaaaggctgtatatataactaacccacatcatactgaatggagaaaagctgaaagccttttctctaagaacaggaacaagagaaggaggcccactctcaccactcttatttaacatagtactgaacgtcctaccagagcaattaggcaccagaaggaaataaatgacatacaaatggaaagaaaggacgtcaaattgcaccccttcacagatgacatgatcggatagatggaaaaacctaaagactccccgaaaactcttagaactgataaacaaattcaatagagttgcaggatacaaaatctacgtacgaaaatcagtagtgcttctatgcaccaataatgaactagcagaaaaggaaatcaagagagtaacccctgcagccataagaaagaatgagttcatgtcctttgcggggacatggatgaagctggaagccatcattctcagcaaactaacacaggaacagaaaaccaaacgccgcatgttctcactcataggtgggagctgaacgatgagaacacatggacgcagggaggggaacatcacacactggggcctgttgggggtggggggcaaggggaaggagggcattaggacaaatacctaatgcatgcggggcttaaaacctagatgacgggttgataggtgcagcaaaccaccatggcacatgtatacttatgtaacaaacctgcatgttctgcacatgtatctctgaacttaaagtaaaattaaaaaaaaaaaaaaagggcaaccccatttacagtagctacaaaaaaaaaaaagtatctaggaataaatgtgaccaaggatgtgatagatctccacaatgaaaacttcaagacactgataaaaaaaattgaagaccacacaaaataatggcaaggcattccatgcctatggattagaagaatgaaaattgcttaaatgaccatattacccaaaacaatctacagattcaatgcaatcccacccaaaataccaacgatattttttacggaaatagaaaaaaatatcctaaaattcatatgggaccccaagagacctcaaataaacgaagaaatcctgaggggttgggggaagcaaacaaacaaagctggaggcatcactctgcctgacttcaaaatatactataaggctatagtaaccaagacaccgtgatattgttatagaaacttaaaggcttaaatggaagacttgaaactataaaaataacaaaggagaaaagcttcagggcattgttctagtagggcaaatattttatgggtaagactacaaaagcacaggcagcaaaagcaaaaatacgcaaatgggaccatataaaactaaaaagcttctgtacagcaaaggaaacaatcaatagagtgaggagacaacctgtagaatgggagaaaatacttacaaactaatcgtccgataagagactgatatccagaatacactagacgttcaaagaactcaacagcaaaactcccccaaataacactattaaaaatgagcgaaggatcggaatagacatttctcaaaagaagacatacaagtcgccaagaagtttatggaagattgctcaacctcactaatcatcagggaaatgcaagtccaaactaccgtgagatatcctctcaccccagttagaatggccattatgaaaaggacaaaaagataagttttggcgaggatgtgaagaaaggggagttcttacacattgttggtctgagtgtaaattagtgcagacatcatggaaaacagtacggaggtttctcaaaaaactaaaaacagagctaccatatgatccaacagtccctcaactgagtatttatccaaaagaaaggaagtcggtatatcaaagaaagatttgcttccccacgtttattgcagcactattcacaatagctaagatacggaatcaacctaagtgtccgtcgacatgaatggataaagaaaatgtggtatctatgcacaatagaacattattcggctaccagaaagaatgaagtcctgtcattcgaggcaacatgaatgaacctggaggattttatgttaagtgacacaaggtaggcacagaaagacacaaataccacacgttctcactcatatgtggaagctgaaggaaactgggctcatagaagtagagagtagaattgtggttactagaggctgggaagtatagaggggaggggaggatagagagaggttggctaatggatacaatattacagatcgataggaggaataagttctagtgttctatagcactgtaggttgaatacagttaacagtatcgtatagtatatgctaagaaaaagctggaagaggggattttgaatgtttccagcacaaaggaatgataaatgtttgaggtgatggataccctaattactctggtatagtcattacacattgaatggatgtatcaaaatatcactctgtacctcgtaaatatgcacaactactatgtgtcaactaaaaaataaaagaaaaaaaaggaagacaaataccacatgatctcactcatgtggaatcttaaaaagttgatctaatagaagcagagagtagaatgatggttgccagaggctgggggtgacggggcttgggggggatacggcaagggaagatgttggtcaaagagtacaaagttccagttagacaggagcaagaagctttagtgatctattgcacagcatttctagttaaaaataatgtattacgtattttgaaactgctaaaagagtagattgtaaatgttctcgccacaaaagaatgataggtaggtgaggagatggatatgctaattagcttagtttaatcattccgcattgtatacatatatcaaaacatcgtattgtaccccacaaatatatataattattttttgcttttttaaataaaataaatttatagagaccgctgcttctggaaagatggaaagatggtgtagttgtacatttccctattcttcccactaagtacaacttaaaattctagacactatatataaaacaaacataaggctggaagtggagagaagaaagtagaccaactggggacctcagaacgacatggtggtgagttccttgggttttgtttttgcctgatatatcccaaacttggagctgaagaaaccagctactagggaatgccaaaatgcacaggcaaaacgaaacaaaactaaacaaaacaggtgaagaaacaaagaaataaacctacaaaagcctgttctgcctagcctaaggatcagaaaagaggcagccaaacaagacagaaaatatttttcacaataactgctctactccagtcgaacacctcagaaaactctgtggccccttccccactcatgccagcaaagatctagtggggagcgtagacttccacattcatttccatgggcagagacgagggtccctttgcgctatcatatcaccaggattatgtggagatctccaacatatactcccaccaggccataaggagacacccctctttgtccctgctgggatgatgtcaggattttcaccaccactcagtgttaaggatgccactcaatccatgggctaaagagaaaatcttccagatgtaaactaggagagccattatggaaaacagtgtgaaggttcctcataaagttaaaatagaactaccatatgacctagcctccccacttctgggactatattcaaaagctatgaaatcagcatgtcagagagatatctgcactcccatcttcactgcatcactattcacaatagccaagacttacaatgaacctaagtgttcatcagcggattaacgaataaagaaaagtgtggtctatatacacaatggaatactgttctgccatgtaaaagaaggaaatcatggcgtttccaacaacacgtggcatttccatgtgtggaaggtgaaaaagtcgatcttttagaggtagcgagtggaatggtggttaccagaggctggagtttgggggagtgggggagatgttgaccaaagggtacaaactttcagctagacaggaggaataatttcaaaagatctattctacaccgtggtgactatggttaataacaatatgctgtatacttgaaatttgctgagagtagtttttaggtgttctcaccacacacaaaaaatggtaagtatgtgaggtaatgcatatgataattaccttgatttagccatttcacagtgtatacttattatcaaaacatcatgttgtacaccacaaatatatacaatttttattggccaatttaaataaaaagaatactgaagactaaatcttccaggacttcagaaagtgaattgaactgaatggaaatgattataaaacatgtcaacatctgtggtgcaaagctaaagcattgttgaaaggaaaatttatgccattaagtgcttccattagacaaatggaaaattatcaaagcagtaatctatgatgtcactacactaaactagaaaaagaggagcaaaagaagcagaaggaaggaaatgtgaaagataggtaaaataatcaatgaaatggaaacctgaaaaataatagagaaaatcaataaataaaaaccgaggtctttaagaagaccaacaaaacatacaaaactcaacaaagactgacaaaataagcctatgatgattcactgcctctgtgcatatttactgaatgactttaataactatagttatgaaacttttcatatagttgactttaggaagctaagcccttatgttttcaatatgaatcatacaatggaaagaagaaataaaagaaacatcagactcttgacttaaatcacaacaaaatttgatttttgaactaacagccagatccctgcctttcaccatagaaactagtttctgcgatgtctttcacaattaactcgatttcctttctaagaggtagacatgatacccaaataactgcactatgagttcaatttttcatgctacgagcgtgtctttgcaaattggaaagttcttggagacaaaatttcccatgattcatgtaatgctaaaagtaaggtagttgaaatttttcagactttgaatcaattattcttccatactgttagaaaggtcttgtattacatggacatttgagtggcgacttaggtgaaggccttctgcgttctgtaaaatattatatatgtggtctcataattttctattatgcgttatgtaactgaaataacaatacctttttatgaggtctccaccaaaaatgtgtgtgtgtgtgtgtgtctgtgtgtgtgtattctacaagatccgagccattttttagttggccaaattaataacctcagatcctcttaataattatcataaactgccttttttgctattgctgaccaattaattctaatttcaggcaacgaattttgtcaatctgattagactgttagagggaaaattcttatcaaattcatcatgtatttgcttacatttctcttaatattgtccagtttattctctttacatttctttcaacaaaacgaataaacagcttgtgctctgtctctgccacagcaaatgcaacatcgacaacaacgaggtgggggagggggtgagatgagcttttttacatcaaaatgcccatccataaaagcagaaatgaattatagaattagagaaatcaccactttttaaccaacaaagtaataatcaaatcgggcaggagccctgaatgaatactaaggccaagaggtaaaattctgttggagagcagaatatccgcatgtcatcgaaatatcctgacagactacttattaatcacaaagggagagaagtaccttcccagtgtagtactctgtctgaaaaataccttagttaagtgataaaactgatgaatacaaacagcatcaccgataactagagaaactggcgttaggagcctccagatgtgacataatgtgaactgctcatcaccttcttaatattcgtacccaaagtgtcaaacataaatataaacaagaggcaaatatcaggccagcccgtattgtgggacactttacgagacaacaggcctcggctctggaaaaaatgtcatcgtcatggaaggtttaaaaaattgtttgggggtactgtttgcaattagaggacactaaagagacatgacaactgtgtgcagtgtaccatgcttgactggattgttgatcccccaaaacgtctttcaaaaggatattattgggacatttggtgaaatttaaatatgaactgtatgtgaacttggatagtattaccccttcattgttacatttcttcaatgtgataatggcactgcggtttcataggagtacattctagtgtttaggaggtgcatgctgaagtaactgggtgaagtgtttggaactgctacgtggttaggcaagaaaaaaaattactgagagataaagcaatgagacaacgtgaatctaggcatcagattgttcactgtattaccccctcagctttgtgtattttcaaaataaaacgttgaggaaaatagattcctcatatttagagttacgcactgaaatgtttacaaatcaaataagatacattaagatatccacgtatgatttttgtacttttttgatttctgatatttgcttgaaaataatctggaggagggggagaggagaggatatgtatgaaatgtgattggccatgagtcgttaatggttgcagttgggagatggatatttggaggttccttatgttatcctctcttgtgctgtcgttctcaaaatgtggtcccctaccagcagtgttagcatcaccagggaacttgtttgctaagcaaactcggccgagcctggtggctcacgcctgtaatcccagcactttgggaggcccaggcgggtggatcacctgaggtcaggagttcgagaccagcctgaccaacacggagaaaccccgtctctactgaaaatacaaaattaaccgggcgtggtggtgaatgcctgtaatcccagctactcgggaggctgaggcaggagaatgtcttgaacccgggtggcggagtttgcggtgagccgagatcgcgccattgcactgaaacctgggcaacaagagcgaaactccgtcaaaaaaaaaaaaaaaaaaaagaaagaaaagagaaaaagcaaagcaaagcaaagagaaaaagcaaagcaaagcaaagcaaagcaaagcaaagcaaagcaaagcaaactctgggtcccaccccagatcttgtcgtctgagaatacagatacggagctcagaaatctttgttttatcaagccctctgggtgattctgatgcaagctagtgttttaggaccactgctctaatgtaccatacacaaaaaaattaatacaccatagctaagttacatttactatgggagaggaaagctggtttgacattagcaaagctgtaactggaaggggacccgagagaggtttgtgtgttgctcatatattttgttgcctgttctagatactaattgcatgcgtatatttaatttttgaaaactcattaagaggcctggcttggtggctcacacctgtaatcccagcacttttgtcgggcggactgcttgggcccgggagttcacgatagcctgggcaacatggagaaaccccgtctctacaaaatatacgaaaattagctggggatggtcgtgtgcctgtagtcccaggagttcacgatagcctgggcaacatggagaaaccccgtctctacaaaatatacgaaaattagctggggatggtcgtgtgcctgtagtgccaggtacttgagaggctgaggcaggaggattgcttgagcccaggaggtggaggttgcagtgagccaagatcacgacactgcacttcagcagcctgggtgacagagtgaggggctgcttttttgtttcttctttgtttacaaatcaaataaagaaagcagcccaaggaaggaaggaaggaaggaaggaaggaaggaagggtgggagggagggaaggagggagggaggaaggaaggaaggagaaagagaaagagagagagaaagggagaaagaaagggtaagaaagaaagaaagaaagaaaggaaaagaaagaaagagatagaaaactgattaagatatacatttatgattttttaaccttttggattataagttaaacttggctgaaggttttggaaaaaacctgggaagttacctaggctgggtattctagagataatggattctcccataactgatccatagattcagtgaaaatgcagtccaaatctgttacaaccgagtttttgggaaacttgaaattgcatgctaatttatgcagaaggacaaaaggcctaagacattcgggggtggaggtggtgtggtgtagggagagaggaagaagaaaggaaggaaggaaggaggaaaggaaagaacggaaaggaaaggaagggaagggaagggaagggaagggaagggaagggaaaggaaagcaaagaaaaggaaacgaaaagttaaggaaaacacaaggaaacaatattaatatggaaatgctggcagcattccttttaaaatccggaacaacccaaagaagcccaattttgctgtcgctattagatctggtactaaatttcctagccagcgctgttaaaaaacaaacagccaaccaaccaaaaaaaaaaaaaaaaaaacaaacaaaaaacccccataacttcaattctatttctactatgcataaactcacagataatcccagaacgcctactatagagtttagcatgttgacagactttaagatcaagtcacgtttttaaaagttaaaggcatttctgtaaattcgatccaaatagaaattgtccttttaaacagacatcaagtacaagaacagcaacaatctacagtatcttggaataaatacaataaatgatgtgcaagatctaaatatacaaaagatgaaactaaaaactgaactgaaagattaaaacattaaggacgcacataagtggagacatcccaagttggtgaacaggaaggctgagtattctacagatagtagattctccccctaactgatccatagattcagtgaaaatgcaatccaaagctgttacgactgagtctggggagacttgacattgcatactaattcgtgcggaaggacaagaaggcaaagaatggcaaagaatagcaaagatgtgtttggagatgatgaacaccatgcagggacttgccctagcagatgtcaagatgtattgcgaagtgaaaaaatttaagacaatttagtagtggtacaggaatagacacatttatctgtggaacataacagggagttcataaacagagacacacaaatatggacgaaagtgtctccaagcattgttccctgggggttgcaaagtcaccactgattgggaatccgcggcatggaaatatggatcgatctttaatcacatgctgaatttttaaaaggtaaattacaaaataccaagtacatgagttataaatgcatgcacaccaaatatttcacacccaaagggagactaatctgggaaacaagccctggggagcataaagctcaacgatcacttcacgatttcttgactgacctagtacagggagcgggagaagctacggggaggtgatgggggcgtggcctcagaacgtgagcatcaagagatctcgaggttcattggtcgccagccacagcggcgggaggtcgaaggcagcgcaagagctcattggcctttgtggcaagagcgggaagggaagcagaagctggatcttccctcagaccgtctgactggttctgacttgccggaggctgaggcaaccacaggctgacatcagaattaggtcctcgttctccacgcctcttatttcctcccaccctcctgagccagattcccaaccccttcccctctctgctacctcagcagggaacccccaactgctcctgatgtcccatcgcgccctcagctctcccggaatccctttcgggaggactccttgctccagccccctgagccctggcctttggccaatgaggcagggctcatgggattgcttttgattcggaggtccgggagggagtggatgattgggcttcctgaggaagtggtgcgctccagggtggtgggactgcgtgtgtggggtggggtgggggtggggggaaatggtgtgctcaagcacaattgttgaagtgtggagaggattatggaagattttggggaggctgtggagggaatgtgtgggttttcatgaaagcagaaaaggtgtgtgagtccaagagaaacactactgcactgaggagttccctactggctagatcagaacctgacacttcataggaggctcaacaggtacctgctgaatgaagaatcaagggaatcggccgggcccggtggctcacgcctgtaatcccagcaccttgggaggccgaggcaggtggatcagcctggccaacatgtgaaaccccgtctctattaaaaaatacaaaaaatggcggggcgcggtggctcacgcctgtaatcccagcactttgggaggccgaggcgggcggatcacgaggtcaggagatcgagaccatcctggctaacacggcgaaaccccgtctctactaaaagtacaaaaaaattagccgggcgtgatggcgggcgcctgtagtcccagctacgcgggaggctgaggcaggagaatggcgtgaacccgggaggcggagcttgcagtgagccgagattgcgccactgcactcccgcctgggcgacagagcgagactccgtctaaaaaaaaaaaaaatacaaaaaattagccaggcgtggtggcaggcacctgtaatcccagctactcgggaggatgaggcaggagaatcacttgaacccgggaggcagaggttgcagtgagccgagatcacaccattgccctccagcctgggtaacgagtgaaactccgtctcaaaaaaaaaaaaaaaaaaaaaggccgggggggatgcatgaagggatgaatgaaattagtaactgaaagagggccagggatccaggagaacaatatgatttcatgggatacaagagggaaatcagctcaaagggggagcaagggaataattaagtgtaaggtggagtacaagaaaaaaatcagcatgaaccagcatgaaatgtgaggggaaaattgaatatagggcatagaagagactgacaatggaattgagtgctggtggcacaaaatcctgtgcggggagtgaatgaatgcaggaggttctgaagagaattggtgaagtggatgccaggaataatacttgggtttggcagagtgcaggatgatacacaagaagggcgtgtagtaatggtggaagagggcaggggagtgcatgtgcatgcctgaaagtggggtctatggtgaagtgacggtaagcaaggagaataatgactgcattgaatgggtatgggatccattccaagagtttcttgggagggggctatgtgtgagtggggcttctgggaaggaggcaacatcagcaagggggttgcagtgaaggttggcgaaaaccatgggagaagaaggggagggaaggcaatctgattccagcggtgagaaggatggagaaggagcattgagccacctcagatagggttttccaagggcagaggaagtacgttgggggtaggggatcacgtggccattctgacctccgctcctgaccctagaagcatggatcccgtgtgtctgaacctccatttccctatggatgtactgaggacaaataaatacccgctgcaccctgctgcccctctgactctgaacgcaccacagggcgtcagactggagccccatgggggactgaacttggccccagaagagctataggttgctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcagtgagtgtttctggcaagggagggagccagagtttgggtggaggaagcatgagtggttctgtcaccagtcctgtcacagaattgcagtgcgacctggggcaaattgctccctggaccttagtgtgcccaggtgcaaaatgtcaccaatgttgtctaccaagtgtttgtaggaaggagagagctgggggacagggcaatcgaagagctccatggtgagatgagacctgcgactggaggtggggtgaagtggggtggggttgggggaaagactcaccaaagctgttcctggtctttcacagctgggaaggagaacaacatgctgcagcccgagacccacatcttcacagcccccgaggaggtaaggagagtcggtgaccagtcgggcaggctcccacccagccactgtccagacatctttcaccgtgtcccaaggacatgggtttcatcttcaatcctatcaccagctcaccatgtgaccttgggaaatatcacttctcctccctgggcctcaatttccccagttgcaaaatgaaaggcaagactggctggtcttcaaggtcttcggagctctgacattctaggctcctatcctcatcctaaaacatgtccacacctcctctctccatggctggcctggtacctgactgcaacctgtgctctctgcccctgcaggggagctcccaaggggctctgctgcttggccaggccccagaacctttgtctctgccctgtactccagtgaccttggagcagcaactggtttctccttctggggatccccacagggcccctgccctgcccagcatgtgagtagcgtgaggaccatggagcaggttgtgtcttgtgtgcctaaccttgtccttgatgccgtgggagatggaggaggaagagggggaggaggaggaggaggtggtggagggggaggaggagcaggaggaggaggaggaggaggaggagggagaggaggaggaggagaagaaggaggagggcaaggcagcatctaatactaacgggcgaggacagggctctcctagctttgctattttctatttgtgagactttggacaagtgactttatgtgtctgaacctccatttccctatggatgtactgaggacaatattctatacccatagcattgaaaagggaacgggcacaaggcctgccacatagtagggcttcaacaaatgggggttgttatgccacatgaaacaggtggatgggatagaaggtcctgctgaaaggtggggtccgtgctggcgagggccacagaggcccagggcaaagcccagaggccattagagaaagcttcctggagacccttcaagacccatggggactgggcaatatggaagtgagaaccagtccctgaagagggacagtaatcacatctctccaggtgttttgcaaattaaagcacggacacctgtaatttcccatgattttcaccattgccctgggaggaaagagctggtaggaataagcgtccctgtcaggaaaaagaggtatggaaaagaaacctggccaagcgggagaagggacttgccccagccacaatgactaatggtccagcaggcattgggattctcacatccagatactgcaaaatcctgcccctctttctgtctactggtagtatgtgtccgccagcggatttaatcccctggcctctcctttccttgtttctagatgctcaactctgatcctccagccctgtgccacccttgaccctcttctactgcagccacaggtcctgggaaagtagtggggtccagaaccctgggaggggcggagtttagtggatgggaagagcagaaggccttggtgggggtgggggaggaggttgagggaacagggggctgaaggggcacttgtcgtattgggaagaggtgtagtttcccagtgcctattctctcatgcactttcctttccaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccaggtagcctgctccctgaaaggagaatacagggtgggaatagctggggaatgggggtcgttgtggtaagcaggttctaactgaaaaatcagagtcagtaagttgaatctccttggggccaggcacccaagctcctcagtatgactcccgagatggtagttgagggctgtttattgaatcttcggtttattgagctttgtgtgcaacagcaagcgttcagtgccctgatgtcaagaaagaaggaagctgaggccctgagagtggcagggacttgccctctctgatatgcatgcagcatatcaagtggaagaaccggccctcttgactttcagcccagggtctatgctcagccgcctgtggcctactgtggtctggggaggacatacagaggtgataaagggcttggtctggaaggaggtctggtctctgccttccgggagcttccagtctagatgtggagcctggatgcccttgcaagctgtgttttgtggccaaattttaacgatgtgcccagagaggaggggctggaggagctccgaggggggataaacaactggggaggctgggagggaaggctaggcattcccagatccaaatggtgaatggagcatggtgtgtcagtgaagaaacacccctggagggactgctggaacagaaagggatgaggctggagaggataccaatcacagaggtctgacaggtcaggcttaggaggctggaccagcaactgtgggtagtgaggagccagggaacgttttctgagctagggagaacaatttcagagaccctgagcttgacaaaaagagttgtggtggctttgatggaaggattgggggaggcaagatgggagatggggaaatcagagaggaagaggtctatgcaacagtccaggtgacaaatctttggttgggcgggacgcataaaaagagtagatctggaaggggatgtggatgtgacctggctctggccccttcctttctgtccacagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggc

SEQ ID NO: 4736 - DNA, 71794 bp, human; identical to SEQ ID NO: 4735

SEQ ID NO: 4737 - DNA, 795 bp, human
gccctcggcctctttgcacccggcagagtgacgagcttcgccggtgtcttcaacgaagtcctgtcggtccctaccggcacatcacacactcctggaagcatgatcttcactcccttccttccacctgctgacctggtgagtctggcttccctccattgtcctggaatgtcccctaggaggttgggctttggtctgtgcaggtcactgctgcatccccagcccctgcaagagggccagagacacacacaacagttgctgggtggggtgaaggaagccagggatgggagggagcattaggatctggctatttagtctgtctttcagaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggtgagagctccttcggagcacgcctctgcctctctcactgctcgccaccaagcccatccgcctccccttcctgttccaccaagagaacctcaggccaagccagaaatccccagggctcccgagggtccacttgtcactctgctttcctccctaggggaggataccgggcactcggaatctgagaccaccggagccacagacacagagccatgaacggtgaccaagccccttctgctgctccatgcccctgctcgccgcagtgtcccagtcaccaggcctgaaataaatgctggcacgcttgactgtt

SEQ ID NO: 4738 - DNA, 711 bp, human
gtccctaccggcacatcacacactcctggaagcatgatcttcactcccttccttccacctgctgacctggtgagtctggcttccctccattgtcctggaatgtcccctaggaggttgggctttggtctgtgcaggtcactgctgcatccccagcccctgcaagagggccagagacacacacaacagttgctgggtggggtgaaggaagccagggatgggagggagcattaggatctggctatttagtctgtctttcagaatgtgaaagggctgcaaaacgaccctgaggaatgggtggctgtgtctgacgccacggaggacccatccggtggcacaggcttgcccagggaacctgctcttctgcgagggtcttggaggagccggttccagagagccctggcatgtttcaccaagtgtttcaggtgagagctccttcggagcacgcctctgcctctctcactgctcgccaccaagcccatccgcctccccttcctgttccaccaagagaacctcaggccaagccagaaatccccagggctcccgagggtccacttgtcactctgctttcctccctaggggaggataccgggcactcggaatctgagaccaccggagccacagacacagagccatgaacggtgaccaagccccttctgctgctccatgcccctgctcgccgcagtgtcccagtcaccaggcctgaaataaatg

SEQ ID NO: 4739 - DNA, 71794 bp, human; identical to SEQ ID NO: 4735

SEQ ID NO: 4740 - DNA, 7993 bp, human
gatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctccagcactaataaatggctaaagccctcataactatcaaagcaggcgtctctcaggcgtgggggctgaatgcaggtctgcggcagcgcgagagaagtcaaagcgatcgcgatcacagcctaaccagcaagccagtgggcgactgctgggagccagggcgagggaagtggccgttccactttaatcttaaccggggctgggggaggaatgtttgttttcaactgttgttcttttattacattcttattattccaaccctcgctccctgtcattagagaaaattagtaaaaatcgactctgagtattttcatccctctggggaggaaatggcatttcaatagcatttgtccgcaatgattatgctcctgttctcagttctgcactttgtctttcctccaaaaagcaaagacaggagggtgggaagtgacccatttttaccattaggagaacttttagccaggaagaggaagttctgtgtattagaacctcactagagtagcgatcccaaggtaaaagtagagttgaaatacttggctttaaagcgtttgcaagtaaatctgcattttaaaaaaatatgagtgagtctgtcgactaagtagaatagaaaaagaggttagggtggggcactcccagagtttttattacatctaatctcggggttgtaattaacatccactcactaaaccctaacaatcagcaaaagacacaaaagctagaaaagtagttgctcgcagtctaggattatgttttgaaacacattaagaggaaagtcactggcgtgctgtttgcaatagagaacaagagaggaaatggatgagataaaagaaattatctccagccttgaattttctatttatgaggaaaaatatgacagttttatctgcttaaaggtcttccgtttacatttgcttttattagcctgagtctctctcttgggcaattctaatgccaggaaaggtttcgaaacgggctccttagtctcttgcatctttgagctaaaccctcaaacctgactttacaatggcaccgtcacaagattttctatccaatttctatgagaagtttaaaatggaatgatattggaaccatttcgatttttggcagcctattctatagatgaggcttcattaaattaaaacttcgtttcattttaatgtcttataaatgaaaataacccttttgctgtattcttatagtctaaggtgcatatttagcagcaatttaagaatatgatgaaaaactttggttatctccctagaaaaaatgcacaaaggcacagcagcacacacacaaacacaagtaatttgttacataattttaggagattcatggatccattgaagccctttcaagggacatcaggttataaaccccacgaaaaaaattaagctgatcacctcactaggccacccactcaggaccaaaatgcacccatttatatgcttagtacatagtgggtcttaaatatttgtttaatgaatgaatgagtcagatcctcctaaattttccacttcactctgtagtactgtgggataacatatggtttatgactgagaggaaaagatgaacttcaatatggaagtaacccttgattaaggtagtcagatgaaagttctttccattactgaaaaatgtcttaaataaatgtaaaaaaggaaaaaatgcatgtattagtggacaatcagaaaacatttcatagcgaccattatagcatgttattttctaatgagagcaaggaggctgacagatagagtaaatgactgttccctaagtgacctgatttaaaaagaaggcatgtttatttccacttagttctctaagtggtctatttctatacatatctaactttaaatattatgcaaaaaggaatatgacagaaaagtttctatggaaaatttaatattttcatgcactttcacattttaaacattggcaaggtgataacctaagcaggctggagagaggcttttctgttagaagtggaaaagagggggagagcaggaagtaattgtgattgattctgattctgattgattgttttaagccactggacaacatgaaggaatttatgcttgaaaggcattattcaataaggacacttcataaaattagttgcttaataattcttgagagttatcattgtcccttggttttgctcatttcatgggacaactttttaaaaatgaatttggatgcaatttttagctaaaaacagtgaaatattaccataagatgaaaagtcctcacagtggagtccattagacagtactccctacataagaatattcattttcataatctttacattcactcccatcatcatcacctctatgtttggagagtgactttctgcctagcagcacttttgcagccagtctttcaaatgaacaccattttaattttatttagggtgataagttatcatatattatgacatttgcttgtgaattctggggagataatgtggttgggaggatgggaaggactccatccatctttaactacagaagtttttctgactctttgaggagaaggcaaatacatcatagatagtattaatttcctaaataaactcaataatggctgaaaatggagcccatcaccctcagaaatgtcatagtctctggaagaagagaacagcttgaacaataaaagttagttctgttagtgctatttttttggtgcttgggtatgggaatatggacattatgctttaccagaaaatgtccaaatccccttcatcatctgttctggtttcatcattttatctggtttcatcatttaagaagaaggggcaatgggattgagagagacaatttgaggagcgggacacaaaaggagcaccaggaaattcaaatttatttctctttgtaaactgtgcagtcagttttttcccctgagctacatcttcttggagttttaggtcttatctgtcagattttggcaacagactctttttaacacttcacatggctttgatatgcagccaggatcttccttatccctcctttcttcaggggttatattgccggaaagggtaggatttttatggcaaataaaggggcctggtcttgactttattgtcctcagaagaaactgcaagaggggaatttatgaccaatgggggtggggaaggactacaacatttccagagttattgatgtctgattatgtttattgattatcaaagagcataaaacatggataaagacaagttgaatttttaaccagtctgcctcaagttataatttaaacactcagcaactttaagattaagaagggttttagaaaacatgatttcaaagatacatttcgatctcaagatttgatgttctagaaataaattaaatctccaagttttcatttttttctctaaatatgcattctgtctttgcaacatgccaaaaggcagacttacggtttccaggtttttgcttagactcagaaaaccagctcaaaatttaggattttaaggtaggttaactgactggaccgcatagttttccttttctaagagcgggaaaaggagattttgttcagttcattatttagccatttagattaatcttaaaatatatcacttatctaaaatttatttcttcactggtgtcctttttttttttttttttttttccttttctggagatgaaagggtgtctgacatttgtttagggcttgtaaattctgaaccaattggctggtgttcctgaatgtaaagagggttcagaatgggatctgatgctatgtaactcttttgttaggcctgtgctgtatcttaacacctcagtggagtttagggaaccactttaaagacgtctttgtcctacagatcgcccccaaaaaatcacataaaaaacaaccagggaagatcagaaggagtatttaaaagccatagagaaaaggaggaagatcctggaggagggtagagaaattaaaaagaaaagagaacttcctaagtatctttggaaaatttgaaaggaggaataaagctctattcgaaggagggcatgaggaattagttaaatgttgtaacacaaagcaaatgtttgtatatcctttcaaagggcatggaatactcactttattctgcttaagtcaacacctcctccttcccccattcactacctacttggtaataaaaattaagactcccacataaaaactatttttttttctaataggtaatggggttttctgaaacagaatctgctaaatgacaattaatgttttctttttaaattactattcaaaccaaactctaggaaattatgtaactataatgttaggatcccacaagtgttttccactcttgggccattattatgcgtcccagcatatttgaacttggaataacatttagttagcatacttaaataggagtcaaagatatgtgtttgggtccccactcctcaattctctaacacaaagtcatttaccttaactgagcttcatgtttcttatctgtaaaatggagataagacatgttctgcataattcaagaaggtaggtaagaggtttaataggaacagtatgaaaagactgcataaaatgtagtgggaagtgcctgtataatggacagctgctattactgccaatgctaatcacatatgtaagtgggaaggtaataaacaccatgggttaaagtgtttaagcattttcaatgctctgctgtgaaaataggtcaagatgggatgattgtgatttgaccaatcattttaggagaaacattaattaaagagatgttggttttatatataaggagagatatagatatagagatatatgtctatgtctatagatggtagacagagatattgctatcatagccacagatgagaatgtatttaatggagaaattgacttttatgaatatttgattcaaaaatatacttattttatattttaaagcaaagatgagggtgggaagagtgtctatgatttctttaactaaaacaatctccaagaagcagaaaaagattaaatgcaatgctttctctcctaacagggaaaaccaggacaaaagaaaagtatcgtgtagtttacactgatcatcaaagattggagctggaaaaggaattccattgcaatagatatatcaccatccagagaaaatcagagctggcagttaacctgggcctttccgagagacaggtacaccagaagtatatccaacatgtcccgtatagtccatttcaatagaatcagaattctagaattgtaaagtcccttaatgcattgccttatcccaagtagcttgcatttcaaccacgtgtgaaggcacattgatatcgctctcttctatctccagcaagagatataaaatatttcatcacccttgttctctcatttatgtgtttcattaatattttactaataggaagacaaacttcttattagtaatagtatactaataggaagataaattttctattttattttattaatattatactaataggacgtttctctttagtgaaatattaataaaacatagaaatggttgattataattacctttgctatttaaatctctctctcttatcagcacacctcagcttctgtcattccagcattatttatttctacctgtgcaacagaggaggtgggtaaggtataatattaagattattgcattcagagttagtagccctagacttggatctcagtttcatttcatgcaaggtacttgccctctctaagtctcaagctttttttctaacctgttaagtgggcatacttcacaaggtcattgtgaggctgaaatgaagtgatgcatatgaaagggctttgtaaatgctaaagtctctgtacaatatcagaaatcactaagttaactgcattcagtatgttgccccattgtgtttcaggtgaaaatctggtttcagaatcgcagagccaaggagagaaagatgatcaaaaagaaaatctcccagtttgagaatagtggaggctcggtgcaaagtgactctgactccatcagccctggggaactacctaacacttttttcaccacaccatctgctgttcgtggatttcaacctattgagatacagcaggttatagtctccgaatgaaagaaagcaaagagaaatttaaagtgccctttttttagtgatgtcttttgggtctctaagctatctacaggggagttggagcagggtgtaattccctgtaaggcagtatttggaacagatggatgcacaatgggttgaagataatttaggggactcttacttttagaaactatccccagaaaactcctgtcacgtgctgtgctatatgtcagtcactcaggaatcttagtggtaaggtatataattaaaagctagaatcacaggcccttccaactctgttcacaatttcagaaacttgcttatgaatagactgtaaaatacaattttgccagaaagcacatttgtgtatgtgtacttctgtttgttatttgatgctaggtgttttcttttatgctatctttaaggagtgagaagaaggtaaaccgaagtttatctatctttagctacctttccaagtgtttaattcaaaagctaacagaatttttataataagataaatgttttaaaaatcatcagaaggtgattctgattccattgtcactgcttaacaagaataaccaataaaaaagacaattttggccctcaatcatacttgtctggcatcaattatctcagaactttcaacttgcagtgtcattttaaaatcttgtcaaaacaatg

SEQ ID NO: 4741 - DNA, 45663 bp, human
agcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtaaaggaacgatgtaggggaagaacagaacatggagggcggcggagggaacttgggccaggaagatccttaatttgtgcatttttccagttcacgggaggaaaaaatggaatacgttacaggccccagttttccaaaaggatgttgagcatttgcttcccattgtgaaaggaatgcgggttcctttcctctaactagagtcaaggcacctgagcatcggtgttttccataatgttccctgtttaaaacatttgtggttcgtcatttgtagcagatgtatttaaagggcgaggccttaggattatgttcatccgatggtttgtgaaagttttccttgcctttgttcaggttgaccggtcttatgtgaatcctggggtactctagccccctcccttggagttgggaccgattccatctagatctgggattcactctgatcacctgcaacgccttctttccccgattcaacttccctagtttatcgcatctactcgcattagggaaggctggtaatggctctccttgggcactggggcagaattgtggcgagaaacacgtccagatagcatcaggcatgcatactgtatacaaatgggagcaagaagagagaggactatcgcggtgcgcagggtatttgagaggctggatgaggaggcgcggcgccgaggggcggcgctcaagcttacagtatttgagaagacctgagttaaggggacgggctccagtggggcgggggtggggagagggaggcacgcatgcgcaaggcttgaatggcgtcggggttggagggttggaaggtcgggaagtgaaggactcgcaggcatatttaacaacgcaaagttgctaggagttggtaccagcgtttgggaggtagaggtggcgctcatgcatatttgagacaacatctggatggttggggagaacggtaaggaggaagcggcgcgcatgcgtatttcagacggagtgccggggaggggaggcgctcagcattcgggtaattaaggttgcaaaatggcgaggggggaggtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcggtaagtgggtacaaaaatgaggaggcgatgatgactctgcaaaaggttgcggcagctggcggtgcgtaggaaatgcgtaaaaagggagcacttggagacaggccacatttgggcagtacgcattcggagggctctctggctttccgatcttgggtcgctgtacttggctctgaatacagtcaccccatcagagtagcaaaacactgtggttgtagtgtgagaatccaatgttaatgttggccgaaagctcttgattttcttccctgagaacataggcgtgaggatttggatgtgtttccaaatgcttgttactctttgccgtaaacctggaatttggacctatggctgcctgggactcatactgtcgtggagaaagattgaaaagtagttaatggcagtggtggtatgaaggtaacctgggctttcaccctttcctttattttttcttctgtagaactttcagcacggttttgtcaagggagaagattagagtttctattttaaaggcagatgtactgtcatgactctctgaagacttgctgttaatcgctaaaactagtaagttagcacttagatacagacatagttagaaggagcacaggattaaaaactgaaaaaaacatcttttcccagtaatcctagctattatttcatggtggtccttttccttctctgggcctatttctctctctcgctcatttatttatttacttttagacagagtcttgctccgtcgcccaggctggagtgcggtggcgcgatctcaattcactacaacctccgcctcccgggttcaagcgattctgatatctcagcctcccaagtagtagctggggttacaggtgcgcgcacgcccggctaatttttgtgtttttagtagagacggggttttgccatgttggccaggctggtctcgaactcccggcctcatgtgatccgcccgccttggcctcccaaagtgctgggattacaagcgtgagccaccacgcccggctgctgggcctatttctctatctgtaataatgattaaacgtcaatagcacttactacgttcgaggttctggtctgcgtgcttttacataggccgtaactcatttggtactctcgacaatcttacgaaacacagtactgttattaagtttatacaaatgagaaatttgagggacacgagactaatttgttcaaggctttacagccagttgaatggctgagactgggtttttatccaggtgggatggctccagaagcatgtgcttttaagcattatgctttattccctaaaaagagggggcgaatttaaaggaaccttcttttatgatttcaaaatttgtttgtaactaaccaaaaccatttgagaaagaagacctgttttctgtttctgactgtgcagactacagggttacatacctaggagacaaaagataaagaattgttgatttggtgcctagtggggtggctatccttaactacccttgttttctgtgctttttgttctgcagagggtctaaaatggccgactgcggcaggctggacacacccttcttgttttgcctgattttctgtctgatctaatgctttgagacatctaaccagtcatttactgcagtagttttttttttaacccattattagtatttcgtgttgatctaaatatacaatagtgatggaaaggttattgtcttttttcttgtaataaaagactgaaaatacatttgttttatttttattatttgcttaggatacattcgtggaagtggagttagtacatcaaagggtatgaacattttaaactctcagtatctattgccaaatttcttcctaaaaaggttgtatcaatttttactcatacaagcgctgaatgttgttgttttttaatttttaatggataaaaaccagtattaatttttcgtttgcctattagtttggattttcttcctccatatatatctcagcagttttctttcatgtaatgatagttcatatcttatgttgatttatgcgttgaagttttagtttactgtttattattatctgtttgtgttctgtaaataaagattagtattcagacttttgtaatgttataaatacctactccatgttattgtttgcctcttaatttttgtctttaaatttttggctagtagagatttgaaattatttgacaaatttatcttctattttgtgatttttattctattgtttaaatttgaatagctccctcagtctagaaatttggtaaatattgtaactttgcctgagggtaactatcaagcatgggagaaaaaacatccatgattttaccacccagagataactattgttaatacatttattcacttcattctctgcatttttctttgcagttgataatatatgtgtactattttatattgtgttttgtttttaacattataacatgcgcatgtccatgttaaacattctttgtaattgtcattgtttcatgatgttctgttgtatggaagtattttacagattttcagtattttaaattatgtaatgaatatcttttcatttggtttttattatttattttgggttgtttatcgaagagacttctagaattagttatttgtcaaaagatttgaacattataaagaattggcatatttacttttcaaaaaattaatgtcagtttttgtacccagtcatttaggtacttataaaaaatgtttttgctttttttttttttgctgactccatatgtaaatgaatgaatgatatctctgtggggtttttttgtttttgtttttttctgagacaggctctccccctgtcgcctaggctggagtacagtggcgtgatcatggctcactgaagcctcaacttccagggctccagagatcctcctacctcagcctcctgagtagcgggagtacaggtgtgtgccaccatgtccagctaatttttaaatttttttgtagagatggagttttgccatgttgctcaggcttgtcttgaactcctgggctcaagtgattttcccaccccggcttcccaaaatgctgggattacaggggtgagccaccatacctggccgatatctttgttttgtgatacagttctctgattattagtgaggctggacttttagatcttaattactagctcttatttccttttgtgaattattcaatttgtgcctgaatgttatttgtaagttgcaaatgtcgtttgttgcagatatgctcccagtaatatttgttgccattgagtctgaagaaatgtttgcaattccaaatataactgctgtgtggatacatgtctggttcttggtagccattttgagataacatttgtctgacctctatcttatttttgtttttatttttagagtggaggtcttgcccaggctggtctcgaactcctgggctcaagcaatctttctgcctccgcctcccaaagtgctgggattacaggcataagccaccttacccagccttgtctgacctttaaacagaaatccatttctttttatctaaaaggaaagcacttttgagtactgtacaacagtggtgcttcctggctctgggcatggggagaagacagggcaacattttgtccctaatgagaaactaatttagacaagaaacaaaacagcggtcccttctcccccatccattcagggactggtcttattttaaatatttctgagtggtctgagggaggatatgggcaatattgaagtgtccacatttatacatactgttaaatgctttggggatgtgaaatgctaataggaacacgctagcatgtgagaaggcaccaggagtgggctaattggcagaaaggaacagtgtataggcaagagcagtgaaataactttaggggaaaatagtatgttaagcttattaaataacagcctcatagagacattgggtcccaaaacagtgatctcagtataactgtcaacaacttgctgatgttatcagccctatttgctggtcagagacaaaaaagccagtaaaaacctaggtattattaagaaaggtatgaggcacagaaaaatgccatcttatctttgtataaaaccatctgaaccaaataactattacagtaataatcttgcctcaaggagtctgttactatcactcacatgattttgaaaagggagtgggcagagtgtgttatctctctgtttcatttttcttgtttataatacataggtgaattagatattctcaaaggtcttggaggggtctaattctggtttcctgaaactgaatgttatttctagtttagagaatctgtttaattatgtttattaaataaacttttctaacttattcctactctgatctgtatattatctattttgtatttaataacattctaactttttttttccagtgaaggatgaggattattggatttagaagtgccaaatgagctattacttactgctttttgctatccggttacactgggttaatccagttagttgtaagctcccatttttcagcattttgctagctgtagatattaaaccaggctcatgtgggtagtagggtggggaggttaagaggagtataagcaaaaaggaaaaaaaaaagctcatattttagaggaggggattgagaagttcctttattggaagtctgtgcatggaagtcccattttacatcatgccagtgtctagttcccaattccgtctatggccacgggttagggaaagcctgaatatttgaaataaccgaaaagcatttaacctttgatttctataatttgttcctcacctctcttgatgttacagccagcagcagcctggagcagcaccccctgggaagaaattttacatcggccattataatacaacctgataagtgttatagcacttatcagattgtattgtaattgtctgtgtatatgcctgtctctcttcctgttatcagttagactgtgagctccttgagggcaaggaaggtgtcttcatctccagagcccagcctggcacattagtaggcctcagtaaatgtttattagatgaataaatgaatgactcatcagcaaacatttattgtgtgcctgctaaagtgagctccacaggctctggattgtcagctgtttcttcaaaaagcatgtggtcagaaatttgatatttctgtatatatcttcctaagagtttctcatgagacaatgccatttttgtgtttggatttcagtccttgatatttacagatgttgcaactgttgctattgctgacacttgctttcttggtgggacttgagtgataactgttagattggggcctcatcctcagggcccaggtaatcatccaaatagtattcttagataggactttgcatttttctttcttttttttttttttttaagggacaggttctcactctgttgcccaggctggagtgcaatggtgcgaacacgggtcactgcagcctcgaactcctaggctcaggtgatcttccacctcagcattctgagttaggactataggtgtgtgccaccacccctggctaatgtttgtatttttcgtagagaaggggtctcgttatggtgcccaggctgttcttgaactcctggactcaagcgatctacctccctcagcctcccagagtgctgggattacaggtgtgagccactgcacccaaccagactccatattctaaaccaagggtgggcaaactttattgcccatgggctacctgtttttgtaaataccattctatattggaacacagccatgttcattcatcgatgttttacctggggccgcttttgcggcccagtggcacaattaagtagctattaggttggtgcaaaagtagttgctgtttttgccattaaatatattggagacattgtggcccacaaagcctttgtagaaaaagatctgtgcccactctggatcatcactcgacagtgatggtttcatttctcattccattcaccagaccagaaattcatatttatttacttcatttgtcattgcttgtgacaagtctttttcctcttttacagataagccagctaagacatgttttaaagtagaagattataagacctcccccagggtcctgcagtcagtcagttataccctgcccttcaacatcaagctttgaacctctactctagaaataccttttattatattcaaacttgaagcacgtggacatagcatgctttggtgccttcgtccttgcccccctccttcctacacagttctttgcaatgagaatatgggaaataaggacttaatgtgagataaggcagaaaggtaagctgaggcaaatgtttagagggtccctaacactaatttttaaatgaagaagtggggtgtctgaaatactcatttatttagatgtatacagatagtgagcctagacttccaagagcttagagcccctccccttgtgcctccccaactttacatgtactatcttggtaacctgcctatgaatacatgttgattcatttcacttcattaaaaagtcggagagctcaaagtcatatttgagaaagctaaatctaaaacaaaatggaggaaacactgaataggttcatctcgttggataggatcatcctaggaataaaatataatagaaggaaaggtcttacagccatatttttaaagctgcttgctggatttttcccaaaattgtattgtgaaagttgtcaaacatacatacagaaaagttgaaagaattgtacggtgaaaagccatgtacccaacacctagattttataattaacatttaactatacagtcatgtgttgcttaaagacaggatatgttctgagtaatggatcattaagtcattttgttgttgtgtgaacatcataggggagtgtacttatacaaacctagatggtatagcttactacacacctaggctatatggtatagcctattcctcctaggctacaaacctgtacagcatgttgctgtattgaatactgtaggcatttggaatacagtggtaagtatttgtatatccaaacatatctaacatagaaaaggtacagtaaaaacgtggtgttattatcttatgggaccaccattgtatatgcgcctgtgactgaaatgttactataagattcaggactgtttgtgttatcacagtaactcatctttgttgaataggttttaaaaatctgtctgtcttctgtgttaatgtcatctgtatctgacccatcatggtgctgaaaaagcttcttttcattcttatttttgtcttctaagtcagcatgaataccagcacagcccaactatgtgtaagcagatctgtgcaggaatgagagtcccagggagagaatccacgttgtttctgaaagaaaatggctatagctcactgttgtttactggaaatagtagggggaaggaaagatggaagtccaggtccagtgtcatatactgccctgcaccttactcacttctctgcctttagggtaggtggttttctgagcagcttctgcttggttctctcctttaaggcttgctaaaggagaaacaacaatgtcatattgaaatgccaatgaggcaatatttagcattagaataactttggaattctagcaaatggaattttaatttgggctactgtctaatagtattctttgagccttttctgttagcaacagctgcagtttcaattaggaagcaccatgaaattttgtttatctttatccatggacatgataatggtaaatgttacctgtttgtgtctctctcctttgatttaaactcaagggtagagatgtgttttactgatctttgcaaatctcttacactgtaagatttgtattcatttatagggatatacccccaaatatatgtttaacattatttaaaaaaagatttagatatgggcatattcacggtgttcataacagtaaataatggaaaaacttacctagtcatgaataggaacttggttaaatacattttggtgtattcatgtaatgggacagcatagccattaaaaataaaaatagtcttgaagataaatatttgacttggaaagaagtatacagtatattaattgaaaaagggctaaagggcaatagtatagtttcatctaatcattgtaaaataagaattcatgtttgtgtatgtacatggaagttgttggatgaacataccccaagtgttaaacttttctgggattctggctgatttttttttttgagacggagtcttgctctgtcgccaggctggagtgcagtggcgtgatctcggctcactgcaacctccgactccctggttcaagcaattctcttgcttcagcctcccgagtgggattacaggcatgcgccaccacgcccagctaatttttgtatttttattagagacggggtttcaccatgttggccaggatggtctcgatctcctgaccttgtgatccgcccgcttcggcctcccaaagtgctgggattacaggcctgagccaccgcgcctggactctggctgatttttacattctttgcctaatatagttctggaattttgtttttttttttgcagtgttcatctatgactatcaaagttagaggcacattgaaactatttccattttgaaattgttgacctgaacagaagtggaataaatgggggtggtgaggggttctggaaactggagaaatttagtttggaaaagaactgggtggggtggggggaagggaatggtggaaataagatcactgccttcagaggaaggcactaactaccacctacccctctattcctggctccttagtgcaagcattttctggatcagtgtttacacttctcatttatttcacagttaggccctctacacattccttttctgcccttgtccctctgggctttaaagctacaataattgctagtggcagcagctgcttatgaatatgcaagtcttgctctagtaaatggtggccttagttgctccaataaagagatggctcaaacctatcaaggctcctgcttcccctctcctctcagctaggcagcaccaatcttccctatctatggtgggagaactttctgcctgggtctcatggtcactagtagattagaggacagatactttcttgctggtggtaggtaaaacagttaaaaatgagtcctgggtaactgctccttgggacttccaggggtttgagttgagggttgccctcatctcactgagtaacaggacacttagcagtattggcttgtgctgccagcatataataataacagtaacctgggctttgggccattgctgaattgccagatttctgggttacttttcatgctaagcagctagggactgagaaacttacaggcaataggctgcttccttagaaagaaaggaccctttggccgggcagcgtggctcacacctgtaatcccagcactttgggaggctgaggtgggtggatcacctgaggtcaggagtttgagaccatcctggccaagatggtgaaaccccatctgctaaaaatacaaaaattagccgggcgcggtggcaggtgcctgtaatcccagctactctcacaccactgcactctagcctgggcgacagagcaagacactgtctcaaaaaaagaaagaaagaaaggactccttgatggtctttggcttgtatctcatgactcgagcctgttactccagtggttgattcttggagttaggggcatagccactggtctgcctagctttttgtggtcctattgataacccagacagctgggtgagggagcagataatgttcaattccttttcacttaaggtaaggtgagtcgtggtgggagttgagattgtaaatgatagggtcttggtccaagagcccagagttttgtaaccttttcctatcagtgtgaaaaccagatgccatctgatgactagatgaaggtttcattcaccttttgcaggctgttttgatcaggactaaagaatgtaggttcattaactaccagacacagaagggccactaaggggtcaagtttgcccacttattcaaagcgatattgaagtctaaagaggggaagaacttgaaggaaactatgaagataagcactggagttcacatctgggtactaacactttggtgtagtcattggtacctctgtacccaggttctctcgtttaaaataagggcaggaatccttactaacaattgtagaccttgcaactgcctttgccagaaaatataattgtgatgctaagtgtgaatgcttagcaagagtaaaatctgagatccatggtgtggctggctggataacttgactaaggtataaaaataaaattaaagctggatctcaaaccttgactgttccatcttacgtttgtttcttttcttctccctgtcctataggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttggtaagtggccagtggctttggtgggcttgcccagttagtgggatggggtagggtaagagtgcttaataggcactaagcaattactggatattttcacattatgatatgaaaaaaaagtcttaaaatattcaggctgtactacagaataaagagtctaacctcttttttccctattctcccatttttatagatgggggaattagaaattgcccaagattatatgagaccacagtagatggcacaaattgcccaagattatagctagttggcatagaaaatggatttgagtccaagccagtactgtgtcttctactcagtgcttcatctaggttctatcaaatccaaggaagccatgtgagacaaaaatgtttttatttcacagtaaaagatttttttttctttttcttttttttaaattagagatgggggtcttaaactatgttgcccaggctgttcttgaacacctgggctcaagtgatccacacaccttggactcatttcacactaaaagattctgtaatagctcctgagattttactcctctgatgttggaaatttccatagtgtgaagttttgttatgcataaaatcacctggggtgcttgttaaacatgcagattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggtaagttgtcagtggctttggtggggttccccagttggtggtagaaaagagaagggaaactggtcgtgatctggccctttctagctttctagcttattaagtacttactaagtgccagagactgttgcagatattaacaaagtcttaccatggaactttcattcttgtgaagttagacaaagggataagtaaccagtaaatgtataatgtatcataagtgttatatcaattgttttttcccattataatgtaaaaaattgcacttaaaaatggttaggttaaactaagcaacatcttgtgtttttctccctttttcccattctcccttttaatacctgccacagttgctcaatgcaatggaggctgaccaagctgagtgtcaggaaggtcatagatgatgcaaacactcttttctctttttgtaacttctcactaggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacacagttgtgttcatccattattgtcgatggcagctttcatgctacagcagagttgagtagttgggagagaaaccaaatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttgcatatttctgcagatgtcttgacctttctggggagtaagcccccttagaagattaattttctgtagttctctattgaggaaatacatgacatttagctttttaataatttgatgccattcattgagtacctactgtgtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaacccttcttctctgggcaggtgtggtggctcctacattatcccagcaccttgggaggccgagatgggaggattgtgtgagcccaggagtttgagaccagcctgggtaacatagcaagaccctgtctccacaaaaaaataaaaaattaactgggcacggtggtgctcacgcctgtaatcccagcacctggggaggccgaggcgggtggatcacgaggtcaagagatcgagaccatcctggccaacatggtgaaaccccgtctgtactaaaaatacaaaaattagccaggcgtgatagcaggcgcctgtagttccagctatgggaggctgaggcaggagaatcagatgaacctgggagacggaggttgcagtgagctgagatcacgccactgcactccagcctggtgacagagtgacactccgtctcaaaaaaaaaaagaaacgatcacatccagatgtcctgttactggaagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaatcactagctattaaaagaagcaaaaaaaaaaaaaaaaaaaggtggctcctgacctagtctctttgagtatgaagacctatttactatgtaaagctgtcacctgccttgaaaagattaagacagcaagaaagttcttagaaagtgggtatgtggctggcctcagataaggataaattgctgagaagaaggagttgggttttttttgtgtttttttgtttcttgtttttgagacagggtcttgctctatctcccaggctggagtgcaatggtgcgatcacagctcactgcagcctcaacctcccagactcaaataatcctccctcctcagcctcccaagtagctaggactacaggatgcaccaccgtgcccattgtttctatatcagggtcttataatatggcagacacaatggcctcccacagagaaatgagccataaaaggaccctgtaaaagcaaggatggctcattgttttaagacagccaaatgtatggcacttggagaatttcaaagagtagaaggccttcttgattgcactcccctttaacagccttgcctcttatggggctatgtggatcgttgaaatggttcacaagtaaagtgaaaaatggttatgcgtagtgtgtcagccccaccctaagctcccagagcctccattctgagtacaaaggtcagttttcttctcgggacaggccaaggatgatggggttttaatttctctcctgatccatggcaaagcattcctaaactaggcactggaagtcttggtaactggaaagagacattcaccaagatgaggaaggccaaaaccaagtgccttatatagtccctagaaagcatttcattttatggaacaatctttggtctctctttttttttttttttttgtgagacagtgactcaggctggagtacagtgattaggtcactgctcattgcagcctcaacttcccgtgctcaggtgatcctctcacctcaacttcccgagtagttgggactgcaagcaagcgccaccatgcccagctaattttttgtatttttttgtagagacggggttttcccatgttgcccaggctggtctcaaacttctggactcaagcaatccacctgccttcgcctcccaaagtgctgggattacaggtgtaagctaccatgcccagctctggtctcctttcttaatcctgttgaataaggaagattttttttatctgaaccctcctcttactcttctttctgttctccttccatgatcactttgtccatcttcctctttgtcataggcatgtcctatttctaattccctttctcttttctttggtaggctagccttcgagactgcattaccctccccaacttaaaatcttttgataacccaggcagctgggttatccccaatttaaagtctttttgttgtagctgtatggcatttatctagagcatggggtacacacagtaggtttctctcctctcttttttaacatatttattatgtttatgcatgtaaagagtttgttgttggccaggcctgatggctcacgcctctaatcccagcactttgggaggctgaggcgggaggtcaggagttcgagagcagcctggccaacgtgatgaaaccctgtctctactaaaaatacaaaaattagtggaacagggtggctcatgcctgtaattgcagctactcaggaggctgaagtaggagaatcacttgagcctgggagctgagatcgtgccattacactccagtctgggtgacagagggaaactctgtttcaaaatcaacaacaacaaaaaaaagtttaaaaattggaaaccaccaaaaggtagtattaaaagggaaataaaaattactcataatcccagaacgcagtcatatgctatttttagtcttattttattcagccatttttctctttacacaaacttttttttttttttttgagatggagtctcactctgttgcctgagctggagtgcagtggtgcgatctcggctcactgcaacctccgcctcttgggttcaagcgattctcctgcctcagcctcctgagtagctgggactacaggcgaccgccattacactcagctaattttttgtatttttagtagagacggggtttcaccatgttcactgggctggtctcgaactcctgacctcatgattcgcccacctcggcctcccaaagtggtgggattacaagcatgagccactgtgccctccctacaggttttaaaatttattattatctaaatattcattttaaatgttaattttagtgtacttctttgattattttctttagagaaatttctgatttcagaaccaagtttattagcattcactgtatacattagcaccattaaaactagctagacccaagaagcagtattgaatgggtaccccttctttactttcctctgattcactctactctggtgctcacagctaagtaagtatgtacagcaatggcctgtcatttggtcgattatcttttgtgctctgaaatgtctttgttttttcatctgctctcaatacctctgtgctctgatcctttgtatataagggtaaccatatttgttctttcctgtgaaataataattcttttccttccattcagagtagctgcctgactcatacaatgaataaagtcacatagactcaaagagtggagatggaggtcggatgtggtggctcgtgcctgtaatcccaacactttgagaggctgaggtgggaggatcgcttgagcttgagcacaggagtttgagatcagtctgggcaacgtagtgagatctcatctctgccaaaaaataaaaattagctgggtgtggtggtgcatggctgtagtctcatgtagtcccagctacttgggaggctgaggtggggggtcacacatactttttgttgttactgcttcatcattggttctgatcactcagtgttctttcccttacaccagatcataatacagtattctgactaggcaacttagctcagtttattacgaatagccttaattaatttggtaaattactatgaatgaacatttcattcattctgctaggtctaggttttgccagctgttccattaagggacactatggcacgggttggcaaactttttctgtaaagggctaggtagtctctctattcaactctgctgttgtagcatgaaaacatccatagacaatatggatacaaatgagcatgattatgttctgataaaacctgatttacaaaaacaggtagtaggttggatttggcccaggggccatagcatgctgacccctgctctacagtatacatacacaaagactttcaaacaaagatgtatacaataaaacaaccattcagagttatttgattcacagtgtgtataatataataaaaataatacagctgtatttgagtcagcactgaaaagtctcttgtgatctgtgtcttacgtgcatgaattgcagaatattcatacgaataccatgaatattcttcacgggccatgttattaccatcccttagaggaatctcttccttgtcgtgggtctttctttgtatggcttagaagtgatgttgtctttatattgtgttatttgttcttaactttacattatcagctctggtgtgcttacctttttcaccaacgtgtcttctaccctacttacctcataagtgaatctaatacagaggttattttggatataatcattatcttaacaggcaagatagtgggctgtgctatttcaaaccctaaatttggctttcaggattatgaagtattaattcttccactgatatctcaaaaggtgatctggacaaaggaacaggtatctcaggtaagcaattgttgaatatgaaagtaaatattcttctttgatcgtttgttgtatttgttatgtttaatagctttcctaataatgaaccaactttgcatttctggaagaagattcgtacttttttgagacggagtcttctttttttttttttgagatgtagtctcgctctgtcgcccaggctggagtgtagtggtgcaatctcaggtcactgcagcctctgcctcctgggttcaagcaattctccagcctcagcctcccgagtggctgggattacaggtgtgcatcgccatgcccagctaattttttgtattttttttagtagagacggggtttcaccatgctggccaggctagtctcgaactcctgacctcgtgatctgcccacctcagcctcccaaagtgttgggattacaggcatgagccaccacgcccggccagattcatagttttcaagaattttgaattatatttgctaaatttgatatttcaaattttattttctattttatttattatttttttcctttatttatttattttttttgagacagggtctcactctgttgtccaggctggagtgtggtggtgctatcatggctcactgcagccttgacctcccaggctcaagggatcctcctacctctcagcctcctgagtagctgggaccataggtgtgcaccaccacacccagataatttttgtatttttcgtagagacggggtttctccatgttgcctaggctgttctcaaactcctgggctcaagctatttgcccaccttagccttccaaagtgttgggattacagggtgggctaccatgcccggcctttttctgtgttcaaaagtgagttgttttgcgggggatggcagtctttttcaattgttgatgttagggtcattaatgaaatcttttgttgcctattgttttaaactgaaccaatctcaaatatatcccatgccattaaatatactttaataacatcttttaaaaattggcacataatacaccactgcatgaatgtaaaaatttaacttgtatctgatatttggaaccttgttttaattactgctcttttaattgtgtgtaaatagtgctacagtgaataactctatagataaatttttgtacatatgtgtgttttatttcctgaggttggataaaatatatggtccttctattagtgtataagaatgcccgttttttttttttaactttttcaccagtacactatgttaaggtttcagaagaatttgccaattgtaaaggtaaaaaatggcctttgatattttaatttgtatttctttgattcctaacaagatagaacagataaaaatcttgggtcttatttttgagtttatttttcacacttagttttagtctatcatatgttgcagatatttcccccagtttggcctataaattattaatttgtatgtagctcaaatatctttttctttatggtttattctccacttgcattttataataggaagataaatatattttttatagttcataattcctttatactttttattatttttttaaatacaaatctttcccattgggaacctttttggtgtgtggtatgtaactgatttttctaaatgttcagcacattcagggtttggggggttgtagtaagggtacttgtggagctctcaacagcaggactttaaaaatcttttctccagtgctctgcttttaacatgacttaaatattctctcagcctgtttcagttttcctgccattggcttatgctatcttctatgaggggagttagcaaactttttctataaaaagcccagtggtaaatattttaggttttgtgggccatatggtttctgctcttgtagcatgaaagcagtcatagacaatacataaatgagtgagtatggctgtgttccaacaaaactagttacagaaaaaggtagtgggctggatttggtttattggcggtagtttgccaatacctgctttatgacactgtactcttacaacttctgctcacctagtttctgcttcgtcatagtgggctttctcatagttatgcctctgattttcccttgtaacttcttagaataccttcttcacctctcatctttgctactgattacctgtttccatatttcacaattttaagtttccgagagcacaggcgatagctaaattaagatgctttgcatgttaccactattatgtactttgcttggctgtctaccctgttgcttcaatataaccaattccaaatagctgcattccttttgagggtctcttccttgcaatccagagttcattgcaagaaatggggtgatttggatcattttaaggaagtttatggaattcaactctagtgtggtatcattaatgtaattaagctcttctctccttatgtgtatcatgttggtcctactacagtttggtttcctcatactctgtcttcctctaacctcctggttactgaatacttagattttttttctcattcataacttgagcttttgcaactactataggtgtgaccttccttctacattatctttctctctacagactatcgactttagctcttgctactctccatgttgccaagttgtcattaaactgagaatctgattccctgtgggttaagtttcctgagaccgcagggatagtagttgctatttggcaggtctaggacatttccccctactgattactatgtgcaaatgtatctctttccctatttatgatgcaaaattgctttagcctaacacaatccagctactataagtgtatccagaatcaagctctaaaactagaatgcaacccagtcatgtagcatccagaagtacctgaaccatctttggaacttgacagtttcacagttaactctgcaaccttactctccttatatcctgatgctattttatatgcctgttaggttgtatcagatctacattctgatctatagtttggagattataattttctaagcaaccctttgtgaggtcacagatactttttgtttgttactggttataggcattattggttctcatcactcagtattctttcccttttcccttacaccagatcataatatagtattctctctctctttttttttttttttggaaacagggtcttgctctgttgcccaggctggagtgccgtggtgcaatcttggctcactgcaacctccgcctcccggctcaagtgattctctcacctcagcctcccaagtagctgggaatacaggcgtgtgctaccatgcccagctcatttttgtattttttgtagagatagggtttcactatgttacccaggctgttctcaaactcctgagctcaaagcgatctgcctgcctcagcctcccaaagtgctgggactataagcatgagccaccatgcctggcccataatatagtattctgacttgacaacttagctaagtttattaggaatgtctttatttaattaatttggtaaattactaggaatgtagtagtttacattactgctatgaactcccttcttgctacatactcacttcctcatttctattctttatcccattgctaatggatagtttctgcttatttatttatttatttatttattttttaactaatagagacagggtcacgctgtgttgcccaggttattattgaactcctggcctcaagtgatcttcctgccttaacctcccaaagtgctaagattacaggcatgagccaccatgcctggccagtttttgcttatttatagcttctgactcctgtgcctattcctcacaagttgatcttatttaaatctttcatgcttcttacgtagctgtggtatgttcttttaccatgtatccattcacttcagctgagtttctgttcttctgtttttcccaattgcaaatttaatctaattttctcacgtcatccttgtttggggagggctttcatgttacaagtcataggctgttgatcagcgtgtagacatatgcctttgagtctgagctttactttcccttggtctgatcaactttggatttggaggaggggtagttggtcataagaatgctttcttagcaggcttgtttgcctggctaaggaagtttttctttagaaagattttgggtgtgggtaacactatgacacattcactctatctggtttagctctttaaagctgcttgattgcagcatctaccaagtctcttaaagactcaccttcccctgggtaaaagttctaaaagttccatgatatcacaagctggtttgcacaacatcatcaaaacaaagaggattctcttcaggttcgtagccagcttcctaaactgcattcctcttagggggctgttctgcttcttactattggttaggcacttgtgattgctagaaacagattctctgttgagctcacataatgacaggttatttgcaggccacctgtggggaaataatggtgacttggatcacatgcagtttcacatacaggtgatcttttgtgtctgtgtgtttcacatctgtggattcagccatctgtggatcaaaaatatttggctaaaaaatatggatggttgtgtctgtactgaacatatacagactttttttagttgttattccccaaacaatagagtataaccactatttacatagcatttatatcgtattaggtattataagtaatctagagatgatttaaagtatatgagaggatgtgtataggctgtatgcatttactagaatattttatataaaagatttgaatatctgcgggggattctggaaccagttcctctgtggataccaagggacacctgtttagggggaccttaatgtgattatgcctgttagggatgggaactggattcagagaagctctagaaaactcagcagccagagcttgtacatctttccattagcattgcgccatttatttaactgagctactttgtctctctgcgtatctttttttttttctttgagatggagttttgctcttgttgcccaggctggagtgcaatggcacaatctcgcctcaccacaacctctgcctcctgggttcaagcgattctcctgcttcagcctctcaagcagctgggattacgggcacccgccaccacgcctggctaattttgtatttttagtagagacggggtttctccctgtcttgaactcctgacctcaggtgatccgcctgcctcagcctcccaaagtactgggattataggtgtgagccactgtacccggcctctctgcttatctttggtgtcttataatttctgctttttaaatattggctcgcccatccactttgttttttctccatctctctttttttttttttttgagacggagtctcgctctgttacccaggctagagtgcagtggtaagatctcagctcactgcaacctctgcctcctgggttcaagtgattctcctgcctcaacctcgaatacctgggattacaggcaccagccaccatgcctggctaatttttgtatttttagtagagatggggtttcaccaaattggccagcctggtctcgaactcctgacatcaggtcatcctcccgcctcggcctcccaaagtgctgagattacaagcatgagccattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgaaaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatgggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccagttgtctacaaaaagcctgattggcttcaggtttttttttttttaatttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaattttaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaataatcaggccaggtgtggtggctcatttctgtaatcccagcactttgggaggccaaggtgggtggatcatttgagctctggagttcgagaccagccagggccacatagcaagacctcgtctctactaaaaattaaaaaaaaaaaaaattagctgggcatggcggtggttcatgcctgtagtcctagcactttgggtgccaaggcgggaggatcgtttgagctcagcagttcaagaccagcctgggcatcatagtgagaccctgtctctatttataaaaaaaaaatgaaaaaaaaaaaaaaaaaaaaaaaaaaagaaaacaatcaggccaggtgcggtggttcctacctataatcccagcacttcaggaggtcaaggtgggtggatcacttgagcccaagagtttgagaccagcctgggcaacatagtaagaccctgcctgtactaaaaattttaaaaagcattagctgggcatggtggctggtacctgtagtcccaggctgacgtaggaggatagctcgagcctgggaggtggaggttgcagtgaaccatgatagtgccactgcactgaagcctgagcaacagagcgagaccctgtctccaaaaaaaaaaaaaaaaaaaaaaaaagaatcacgtacgaggaagaggttgtgaagctatacataagacaattggcaatcttgtatttcacaagaatctaattagagaatttgggtggccaatcccctcagcatagtaagggagtcaaggaagcttttaagaacctcatcagttttctaccttccctgaacaagtgtctcttatttgtaactaaatttgtcagcttaacagtaagcagtaactggtattagactcaatttttcaactagatttgtaatttggcacagtaatgaaatcttaagcccatgcacctattctgggcttcttgtttgtttgttttgagacggagtctagctgcatgcagctggaatggagtggcacaatcttggctcactgcaacctctgcctcccgggttcaagcgattctcttgcctcagcctcccgaatagctaggattacaggcacacaccaccatgcccagctaatttttgtatttttagtagagatggggtttcaccatgttggccaggctggtctccaactcctgacctcaagtgatccgcctgcctcagcctcccaaagtgctgggattacaggcgtgagccactgtgccttgccacctattctgttttgaacttcattttcctaacaacatcctgaattactgagcttttgtatcacttcatgttaaagttttcattcttatgtaccaaagtactaatttgaatttgtaatgagtctgatggtatatttcaattttttgctttgagggactggctgctacattgcagaatatcttatatccctgactgctttccactaagtgtcagtggtgaccccaatccaattattatgacaactgaacatgcttatgcatccctcatgcctttattttttattttgggaaatctttcagcttcagtttttgctgatatttatgtgattctttgttctgcaattcaaatttctgggagccaaacagtctccttggttcagattactgttttttgactagagcttctcacttcagattctgtcataagattatggcttaacctatggttgtcctttgatttggtgccatatgaaataaaacattattttctatggctatgtattaagaattttgtgcaattctgtttttcttagaaggctgagggtgtgttgtcagacaccatgactgatgtgacaggtgtattttattatgcggccgccaggcagacaggcatttcttcatatttatatattacttaaatttaatattatttacataatttttttttttttgagacagagtcttgctctgtcgcccaagctggagtgcagtggcacgatctcggctcactacaacctccgcctcctgggttcaagcgattctcctgcctcagcctcctgagtagctgggattacaggcacccgacatcatgcctggctaatttttgtatttttgtatagatgggaggtttcaccatgttggccaggctggtcaagtgatccgcctgccttggcctcccaaagtgctgggattataggggtgagccaccacgcctggctatttacatatttttaaactagagccccttaacatattacaattttcatgtatggaatctctaatgtattcacccctgccagtctagatagtaacacaaattgctgtctagttcttgtgtcccagaatgatggtatggggtagcctgaagcatgagccaaattaatagaaacagaaagtagttgccagggtgtgtcagggttgttgccaggggccgggggagggggaaaagggtcattgtttaatgggaatagagtttcagttttgcaagatgaaaaagttctggagattggttgcacaaaaatgtgaatatacttaatactactgaactgtatatacttaaagtggataaaatggtaagaaaaatagagcaacaatatttcactaagtaggcagtttacactgaatatccttggggacatcagaatatccttgagaatattaaaatacagcatcttcaaacaaaagtaagttaaaggactatctttgatgcagcctcccagttctctatatcagggtccagcaaactggcccaagagccaaatctggccaaccgcttgtttttatacagtctgtgagcaaagactgttgtttacattttttaattgttgaaaaaaaatcagaattataaaacttaattacatcaaaattacaagaaattcaagtgtcagtgtccataaataaagttttattggaacacagtcacattcattcatttttttttttattttgagacggagttttgctcttgttggccatgctggagtgcaatggtgtgatcttggctcaccgcaacctccgcctcccgggttcaagtgattctcctgcctcagcctcccaagtagctgggattagaggcatgcgccaccacgcccggctaattttgtatttttagtagagacagggtttctccatgtcggtcaggctggtctcgaactcctgacctcaggtgatccacctgccttggccttccaaagtgctgggattacaggcatgagccaccgcacccggcctcatactcattcttatgtgtgtcatgtatcgctgcttttatgctacagtagcagaatggagtaattgggacagagaccatatagcctacaaatcctaaaatatttgctgcttggccattaataaaacatttaaagtcagactattacaaaagttgccaggtccctcacagcatcatctttgatagctttaaatgcctaattggcagccttgtcatggactagtagggactattatcattctgttctcttatgtttggtggggattcttatttccttactccctactgtgacactttaaccagttccagaaaactcattcttggtgagcttcagttgtggctgaaatccctttagcaatttctataggctcttgtattgttaagaaccagacatctcttgggccagccaagcaattgggaccacctaagcaatttggaccacccatggctgggcttggtcagcctctaagatggacagggatctcataagaattcaagtaaggaatttgagtaaagacaattaaaatttaaagaaaaattttaattcagtttcctgagtttggaaattagttccaagacagatctgggaatgtcagcgcaagagtttgtgtcatccatcctagtataccacctttaacattttttaattcctctgtgtgtttgttcagtgccttcctcattgttgactcaacctttactttacctcctagcttagtctgcattctgcttccccttcaattttcagctattcataattaaatgttgcttgttgccccagtgtatgagatagtgcccaaaggtatttatttcatgttttccagctttcttgcatttcacagattctatttattttgcatttcatagactttattccttagtgtaagaatttcagtggcataactctgccctgcttgggagtcactttttgaatcttttaatgatatataatggcacttggaaagtgtcccccacacctgatactttctgctttggactacaaggcagatcgtattctaaaaatcattgctgtctaggactgcttcccagaactatgttctccagaactataggtggaacagtttaccttagatgggaatgtgagtgtggccaccacttgattcagatgtgttcatattgcatttctacatcttggccgctaagcacatgtgcccttcatcttatatatacgtttctgaagatgcttctgtttatactattccaactcttactgaagcagcagtgttagaatgtcagccagatgctatagtctgaagtaatgtcatgagaccgttttagaaatttacctgccactttcacaagcccaggaggcggaggcaggagtattgctgagcccaggagttgaagactgcaatgagctatgatcgcgtcactgcaccccaacttgggtgatagagcaagaccctgtctcaaaaaaaaaaaaaaggtaaagagatactaataaataattcagataacacataaagaaataaatatagtcaagataagctataatcttgtcactcaactaaaactatgaaacttttggtgtatagacttttattacttttatttttttgagacagagtctcagtctgtcacccaggctggagtgcagtggcaagatctcggctcattacaaaccctgcctctcaggttcaagctattctcatgcctcagcctcctgagtagctgggattacaggtttgtgccaccacacccagctaatttttgtattttttagtagagatggggtttcttcatgttggccaggctggtctcaaatgcctggcctcaaatgatctgcctgccccggcctcccaaagtgctaggattacaggcgtgagccaccgcacctggcctttgtatagatttttaaatgctagacttctttgatattattgagcatatattttatctaattatgacacctgttttgattctgtgcttaattaagcaattttatgattataatttggctataggaaaagaatgtatgctttatatggaaacaagtattctggttacattgatgggtatattgtagtaaattaataaactggcacattgaagattattcatcttcttatgtcagctgtgctgattgtccttataatttatctttgcacagttgactaattgtttccttaccaaatgtaattttagtcatagaaggtgcagtgaatactctcaggactctgaaatatggttcatacccatggaaaaaagcctaacaaaaatactgatagcatggttccaaagcgggcatgaggaggaatatgcatttggaggtgttagagaagataatatgataataatcagttactatagttttgttaggagaacctccctcattttttaactgtacctagataacgaactttgtcagtttatttattttttttaatttcttaattttttgagatagggtctctctctatcactcaggctggagtgcagtggcatgatcatggctcactatcctcaacttttcagtctcaagtaattctcccacctcagtcttctgagtagccaggactacagacatgtaccaccatgcctggctaattttttggatttttttttgtagagacggggtttctgccatgtatcacaggccgatctcaaactaggctggtctcaaactcctgggctaaaacagatcacccgcctgagcctcccaaagtgctggggttagaggtctgagccaccgcacccagccaactttgtcattttagagatagcagcatatgctttatcttggtcctgaggcatggttgctggaggtcaagtctatgcagttagctacgatgggccacggaaagattctaaacttcttgtagtcatccaagtaggtggattgcatgcactatttgtaattgaaaagtatgagttcctgtttttttgttgttgttgtttttggttttaaggagctgagagtttaataggcaagaaggaagggagaagacagaaggaagaagctccccctatacagaggcagagggaggggggatacaaagccgaaagaggaggtccctacctgctaaccataccagccaggtatatatgcagaggctggaggaggcggtgtttgatttgcatagggctcaggggattggtttgattaggcatttcattcacatggcccatggaaaaagctggccctcccactctagccttttaatatgcaaatgtagggtgccatgatggtctacacacgtggggatatgtgggggtggccatgttgccaggaacctgtggggaaagggcaagaaggcccggggcatctccatgtttgggtgggcccagtttctaatggcctgcatttgcatatcaatggttgctggcctggctctgagagccagggctttgcaagaaacttttccagaggtgctttaacaaacaaaaacttcccaaggaccccttttcctacaacattcccccctgtggagatgccacactaactgctgttagggggtttggggcgatgactctttctggctacttcctgctgaaaaggggcatcgaatggggaacagcagctaaggctccttctggggtcgatctaaggatcctcggaagaatggcgtgtggttcagtttacagcaccatttgaagtttgattgcttctaggcgagaagaaacaatttgagttataatattgagtatacagggtccaaatatcaatacaagacagataagcaagagagtgcttaataaaggggttaaccaattccataaagaagactggaatttattaaagagggattgtagccactcgggctgaagctggcattttccctgagcctgtcaataattttgatttgatttctaagtacgcgtagattttcctctactttactagagttgttaatccaaaagcagcatgtttcatttaaaactacattactaaacctaataaaaagtcctagcagactcagtgatagtaaaactttcatgcttcctttttgtcaactattatccttgctataaggataataattaagcaaaatactacagcaatggaaactctctgtccaatatttcagttagaaggtggtaccatgtgtaacgctattgcaaatagtagggtgaggacagcagttcccacaaatgtggtgtggcaggtaatttccatctaaaattttacttgccaagatattagaattcccctttgggggtctatgaagttccctggttttattttcccaaacagaaacctccaggttatgggcacttactttaattatctggcagaatttgcaagataattgcccagaactagcatattgattcacatttttaccttacccatccctattcttttattccaagctgcagaagatcaccacgtgattcacaggaataagcaaggttagtctaaaacataggcaaaaagcttaaaaacaattaatgagagtaggctttaatgacaaatttatgataagctttggggcaaaatttttctctccagtcctcatttttggtaaaaactatgaataaactttagtcttatacttggcctgattatttgcataaagtgcagcaagaatggttatttttacataggccttttggattggctttgatgaaactctgttccacaaggaatttcagataagacttaaagccgagcccagccatgggttgtatcctttaatacctgtgagttgggtgatcctctcctcttgagttcccaagataaactctgagcttctatacctgttagaaagtgacattctttactgaccacaggttaggaaccctgtgtggggactgtgcagacaaggtatgaggccagttctccacaaggggcttttattggctttgcatgtcaagcttgattccttaaagggaaacacaccctttcagtcaaagccttggtaaaataaccagtttttccaattgtgtcctgttgacaaagaaaaatggattcgtattgcactgatgcaaacaactatattgccataaattaagagtactcacagatagtttccaaattctaggggaaccaggcagagaaaagtaaacatgctccaaattttgttcacaggggtataccttactcaatcattaaaggccataaatagtttaaaataacttcccttgactctgaaaatcaaaacaaggattagcaatattccaagcaacagtcaaaaaggttgctttaactttctgagtgtagtccacttagttaacttttgttttgcttggtatttgtcaacatgtcaattctttgagtcctgtacattctttatttcaatgttacaatctttaaggctattaaaaacctgcatttaacaacacctgttaaagtccctaatatagctttattataaactgtcttttgagaaggaacaaaggaagacaacaattgtctgcgaatgacaaatttccaggatagttacagttaaatatatgactaagaaagaagtttacttatcttcgtggtttacaataactttacccttaattatgattgatagcatatacttagacattagaattttagaaatctcatacaattttggaacatattagtatttattcaccaaaatataacttacaacaatataactttatagcaataaagaagattggacatcattttggcaatctcatgtgactaaacatgtcaagtgatcttgtttacctcttttctgaatatttcaggggccctctgaaccatccagaaagccaggcagcagtaatgacaatttccagattgccataaattattttgtaaaaataactcaaaaggcaaaagcctttcatcagcctttactatgatatgaaaattttgttcaaagcaaaatttttcccttgcattagtttattaatgttaattccagttcgtttccatgaacccttatagattatcccgtctaatcctaaccaatttgaccatgaggtgaaatctttacaaaccttttgtaacccttttactaaagggcagattagtgtcttaagacctccttgctgtgcttctattttaatgcttaattcatgaaaagaccgtatagatgctatgggagaagatggtgtagtgcttctaccatgcatttcattgcaaggcaacccaaagccaattggcttattttgtaatcagcccatccctgatgggcgtctcatctcccagtgggggatggggatgtttccttatcttccaggtggccaagagcatgcttctctgttttgtaactgctattagccatcccttactgtgtattttctacctagttattacacaccaaagctctctcataatgcaaagtaatttctgataacccccaaaactcaaaaccgtcagataacacagtgcaaaacagaataaagcctttgattttgagagggatctatctccttttaattcctggggtttcatgaggaaaacaggctttttctgaaaacagggtttgcggtgcctcctctgtttttccccaggagtcccatactaccagaagttattttagggctttttatgcatgcattaagaggggtaagacaaaaaacggagaaaataattcagtcaactgagaagaaaagagcccttttccagaaaagcaagattcaagaagagaaaagcataaaggcctttaaatatacctataacttgaatatttacttttaattaagctgagcactctttaagaaaatccttttaaatcccttgttacttgactttagccacaccaagcagttaagattttcggcttttgaactttacagaaagtacccttataggtgaaaccaacgagccttaattaggttatgatttaattacgagtgtacaaggtatttttaaaggagtgatagacagcttttgaaactgtcattgcaaaactgtcactgagacagtcaaagagatcccacccaaacaactccattttgtttccaggtttccagccctcaagctgtccttgcccatctctgggtgtaggctaaaccaactttgggaggagcctggtttacagtctatagtctaaaacaaagacgataacagcggcttcccaagatatatttccctcttacctggggaccagtccaagaaactaaccacaggattagaaaccatggcccaggagctggaggccacaagattttgaccctccctaaactgctctcaagatcagtacttaagatattttgtaaaccctgcccttgatagatcagctggcaccacccagattgacaaactggcttatctgatttagcacaaaaagacagccaccattgtaaaatggcggagactaaaacaaagtattgccatgcagttacagatgacattcccaaagacatgaaacaagatggagacctgtagccgactttgccactgaccgctttgctggactggcttgaacagcaggcttatggggtcctgggcctgcatcctaacctaagattccctttctttgacagaaccatacagaaagacatgcaaagcacacaagattgtctacagcttaaggccagccttacaaatcctttttcattagttatacatttacagagaacatcaacagtgatccttattatcccttttaccggtttgcacaaggagagagaagccaaaagcccaactgctaagaaatgtttacccttttgccggcacatcaggcttctgggtccactttcccctagctcaactctatgccaagcattttaagatttggcaaattaacttttcctaggttggaacaacattataaaagagacagaagccattttaaaccacaaaagaaggaaaaacaccttagaaaggagtttcaattagggttgttaagaagtaatacctctcttcctattgggaatggtgtttcccctatttctttgccttccctatttttctcttttcccttctggcccactataggagacatattgcttatctccaaaattttcttctgcttgcagagctgcctgttttagcagcagtgagggtttgacttagcagcaacataacatccctccatatgaggtcaaatacgtgagttaaattttggaaagcttctatatacctatcagggtcgtcagaaaatcagcctcagtttgcctttacttgcctaaggtcattaaaggggcccaaaataagagggaccatcagatgatttccttgaaagttacttttttaattttggggaactagtttccctggacctgcccgatatggttgctaaaagagctggcttgatcttgcaatgttgcaaaggtctagtaaaaagaccatacccttgtgcaaaagaaaataagccactttttcttcaaagtttcaaggtcgaaggagtcccagtgcttcaacatatactccatgggagtgcacattgaagacgatctgttacccatctagaaaaagaagtgagaataaaagcgtccttttagtctccttcctttcagtatgtgatccagggtggagatgaaaacaatagagggcatccccccaactattttctctctgttgctccaggattcccggcacctgcttaaatgtgccacccatgactgcaggtgtgaccctccaagctgtggcaccagaggaactgagttccttggtcacgctgtccccaagcaatcagtactctgccttttatttccctttgaccttctagacttgcgtggcctgtgtgccttccaaaacacggatttcaagaaaaaccatgtaattgggcaaggcccctttaagggagggggagtgctagattgaactgtgtattctgctattatagcccatgctaaagcatttactcatggaagaatggttctggttaacttccggactcaaaaatccccttactaattcagtactgtcttaataggagacaaaatcaatgccttaaaggaacgtaggagcctaatggccgttttcctgccagtggggacaatatcgagactaaaattcggctagggaagacatcttactcctaactgttaaaagcaaaaacttcccgttcccaaaagaggcctagagcctgatttctactaggcggcttagaaataccatgtgcttgccagggaaaacagagagagaaacatttattgagttactgcctgccgtgattcacgatcttttctgacagacctgttttccctgaactgtaaagattcctgcacattgaacacccagagagagggtaagagaccaccaatagaaagtttggtgacagggtagctggaagaaagtcttgagattaaaggacagatttgaagttgagatccgctccatactcaccagtctgatgattgaattttccttttcccgcccatgcaccaaaatgatatggctctgatgagtggaggaacaccagggttcttgttcctcaggctggtttagataaaacaacatggacacatgtggagtggttttaaggagtggagagtttaataggcaagaaggaagagagaagacagatggaagaagctcccccttacagagacagagggaggggggcaccaaagctgaaagaggaggtcccccaagttcctgtttttattagcctggaacttgatagtaatgacattaactgaaagtaggacataaactatatattttagtttaatatgtaaaaggatcttctgcatcactaaagaagaaaagtgtcttgctgggaatgagattaggaaacaaatttgggaaataccattgttccttttttgtggagaaaggtaccctgtccaaaaagaaaaatgtcttgctttgctagataaatgcaccgttttgcctaaaaaccagtgtaacattttattctaagtcagaagtaattactgagctgtggttttgtgttctgtatgtataatctcatttattgacagttctaacctagtaatgaaagtgcaacaggagaattataaccagaaacatctaactgttatattatacatacatgtactgtttaactgtaattgtgaaaatgcattttgaaagttggaaaaaaagaaaggttgcctctatggtttggcagcttaataccgaaaagtagacagtgtcttgcgggtcatagatcatgggactcaacataaagtcatacagctaagacttgttacagcaacataataagcatatatagcctttctaaggttagcataagggaaaaagagaaggtagagtctggaggaaccagcgtgcaggtctccttatgctctctccctctcatgagtggtcatacagagcgcattcttgtagcaataaaaatttggcaacacgtgtgccatgtttctgctcgaggagcccattagagacttggcacccaaagtttctattgtaggttggtcctgtaggcactttctgctttgcatgtaccaaaattccacattcccagaaggaaagcaggtattcaacatgacccacttttatttgcacaaacaatctagtaaaaggccaaccttggcagcaggtcttcctaaggatactagtctcagtctgtgcacataagctgaatgtgtaaaatggttaaatactggacccttctgtaactgatcacatgcaaactgcttaagggcagaagtgggccagtttaataagaatgagtttaaatacatgattcctgttgtatttggggcatgctaaaaaatactgggagtcctttaggttaagttaaagacaataacctaagcttacaggattttaaacaaaatctttgatatattggctgtttttgtttgcttccttttgctctcatactatgcatagagttacctgaaagaattgtgttaatttaaaaatttggatgtcattccttccccacagtttacttggaaattggtgttcaaatatttggaaggagccattctttttttttttttttttgagacggagtctcactctgtcgcccaggctggagtgcagtggcgcgatctaggctcactgcaggctccgcctcctgggttcatgccattctcctgcctcagcctcccgagtacctggtattacaggcacgtgccacaatgctcagctaatttttttgtatttttagtagagatggggtttcaccgtgttagccaggatggtctcgatctcctgaccttgtgatccacctgcctcggcctcccaaagtgctgggattacaggggtgagccaccgtgcccggcctggcaccattctttaagaaagaagtacaagggaatattagatttttattgtgtggtttcacatcagtgtaattagaatataggaaatttgtttaaaataataggccttttcatttgacgagatttaaaaacacagattggctgtggtatctgggcataatttgatatagataatagtattttcctccatatcgaaaattgaggtaagttttataacctctttgatgcattttcctagtagagttaaaaatgttgaagtatagccaccaaaacattcatgttggttatccttttttttttccttaatgaaaatgtactactttggtggaaaaaagttaataatttcgttagttggtaggtgaataatgagtgatagagactgttctgacaccaattgtctgacaccaactgggtatcctgcaattcatttcaattctgacactaactacccagagttaacacaaactaccaggcacacaaagtgttcatccaccaggaagctccttgaactttgagtttgcagagttttattggccacatgattaacttccttctccagctcctctttaatctctgaacatctgggggtgtggctaaaagttccaaccctctaaccatatgcttggtctgtctggcatggccagctcgtcctttcaaactatgtgagggcctaccttgagtcacccccaagtataaactcagatatagtccaaaggggcttcttatgaataacaaagacacttccattaatcaggaaattccaagcctctctaagctctgtaccaggaacaggagacaaagactagatttattcttcattatatgacagatacatttttatattttgcctctggttttagtaaagtttttgttgtgaagaacacaaatgccagatcaaatgagggggctgtaattagcaaggctgcaagggattgtgagcagtaagggagatagggattttactggaaatccaccaaaggaactggtatgtagctatgcctctcagtaaggggaactagaaagctattaggaaatcaaggcatctggagaaactatgtgtgtgtgcccaccaacatgttcatgtttgcgctgcatttttgctttgtcatcctcttgcctcaggttgttttgctctcttgtttgactttctatgcccttctctaccctagggcttctacttagagtttctgcttccacaggactccttacagcttaagttctagtttatatgtggctatgcatattgaaaacttgggttctttttttggagacagggttgtacaggctgttgcacaggctgtattgcggtggtgtgatcatagctcactgcaaccttgaactcctgggttcaagtgatcctcctgcctcagcctcctaccaccccctgctaatttttgttattgttgttgttgttagagaatggggtctggctatgttgcccaggttggtcttgacctaagggcctcaagtgatcctcccacctcagcctcctaaagcactgtgaatttcaggcatgagcttgagttcttattaactgtcagcctgactggctctttcctagctaggctagtcagctcggctgaggagtcaagggaggacaggcttattactatggaaagcacttccaaaacattaaaatgtttctctttaaagagtgtttatcaatgctcaaacctgaaccagaaaaagaaaaaagaaaaaaaatggaaaagagtgcttaaaatattaaggatattaagcatgtcaatccttttcttattcctaataccaaaagaagaattcctaagataaaagattgataagtgtcatgacatgaaatttaattgagtttaacatatttaagtaaatatttgacttttgattttgtaagatcagccgggagaaaggacaagagagcaagacccaagttcaggcaagcttttattaaacccgccggctgctttatcacagacaaaggaggcagcagcagccagcttacagaatgaggggtttatattggggagggagtttgagggagttctttggtatggccgcatcccggggttgtttgctggtttattctgccacattatcaccttgtgacgtttatggtaccggagattgtaggtaaagtttgtttatgcttcccacgacctccctctgtgcggtccggatggtttgtaattggggtttgctttatagcagcgaggcctgataggtaaagtctgctggcttcactgtggcgcctagataagggcttagaaatgtaaaaaggcttggggcagcatggagaggagttgcagagtggggaggggcaggcagcaccaagaagcttcttgaggcagtttgtccctaacagatttattttcggaaaggaattctgaactctgagaccaaatcagtatatttgtgtatattttttcatatacttccaaagtcttttaattcttaattaacctgatatttaagtgaaaagggtttactctttatcctagttaattacatattccatttgttaatgaaactatcctttgctcactgcgttgtaaacacatctttatctttctttcttcaaacatagaagccataaaataagattcataaatgcagctacataaaaaatatttttaaatatttaaatattaatattaatttttttaaaaataaaatattttgtgtcaaaatgctctaaatgaagtcaaaagagaaacaagaaactggaaaaaatatttgcaacacacattaagtgctaatctccattaatatataaaaagcttctaaaaaaataaggaaaattaaaagaccctagttaaaaatgagcaatggtcatgaacagatagttcccaggaaaaccaatggcactttaatatataaaagcatgcttaagtcatttataggagaaatgtgaaaaactacagaaagttaatatttgagaactttgttggcaggactgtgggaaaactggcacttatagaatgctggaatgcaaaataatataatacttatgaaggatactttggagatatttatcaaagtaatagttgccctggggaatctccctgggctctggtgggtggtggctgtggggctgcagttagtgcgtccaggccctgtggcttgttgggcatgaggcagcattcgtacaccttccagggtggcttttcttgctcagtttctggaaaggaggaggaaatgctgcagcttccacagtacttttgcttaagacaaagccagggatctggaatttcaaaagagctggggatagaaggtttgagctggccccacccagccctccatttgacctccaaagcaggctgtttcctgctgctggctgagtagaggcggccttcctggagggaagggagaaaaaaaaattaaagtcgcctttatttgatctagtgaatcctcttctaagaattatcctacatagctgaaaaagtgaaacaagttgtatatgtaacattgaagaatattttataatagcaaaaggttggaaacgatccaggggctcatcaataagggactggataaactggtagattctcacaatggaatactagaatgctttagaaatgaatgaggtggcagtctatgcagtaatagaaaatttgaaggctatattaagtgaacaaaggcatataaagataatacatataatgagttttcttctgtggaagaaaatgggtgaaacatatgtttacttatattttttaaacatatagcactgagatatgaaagcagttacctctaggtgctaggagaatggggcaggtgtatccagagtgagaacaaaaattttctatatacaatgtttggaagatccaggtgatttgtttttccttttgtgtgtggtaaaatatatatagcataaaatttaccattttaatcatttataagttgcagtccagtggcatttcttttttttcctttttcttttttttgagacagtctcactgtgttgcccaggctggagtgcagtggcaagatcatggctcactgtaatctcgacctcctgggctcaagcaattcttccactccttccacctcagcctcctgagtagcccgtgccaccacgcctggctaattttatttttttgagacagggtttccttttgtcacccaggttggagtgaagtggcaccatcttggctggctgcaacctccacctcctggcctcaagtgatcctcccaccacagcctcctgagtagctgggactataggcgcaggacaccattctccactaattttttaattttttgtagatatgagattataagttgttttaaaaaaagtaatatgtgcaaatggtaaatagtacaaaattcaatttgtactaaagttgttttagttaaaagtcttctttctgcttttagattcccagttctcaatcttccttcctccttacaagatacaagcaaccttcaaccttccc

SEQ ID NO: 4742 - DNA, 14226 bp, human
acgcatgcgcaaggcttgaatggcgtcggggttggagggttggaaggtcgggaagtgaaggactcgcaggcatatttaacaacgcaaagttgctaggagttggtaccagcgtttgggaggtagaggtggcgctcatgcatatttgagacaacatctggatggttggggagaacggtaaggaggaagcggcgcgcatgcgtatttcagacggagtgccggggaggggaggcgctcagcattcgggtaattaaggttgcaaaatggcgaggggggaggtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcggtaagtgggtacaaaaatgaggaggcgatgatgactctgcaaaaggttgcggcagctggcggtgcgtaggaaatgcgtaaaaagggagcacttggagacaggccacatttgggcagtacgcattcggagggctctctggctttccgatcttgggtcgctgtacttggctctgaatacagtcaccccatcagagtagcaaaacactgtggttgtagtgtgagaatccaatgttaatgttggccgaaagctcttgattttcttccctgagaacataggcgtgaggatttggatgtgtttccaaatgcttgttactctttgccgtaaacctggaatttggacctatggctgcctgggactcatactgtcgtggagaaagattgaaaagtagttaatggcagtggtggtatgaaggtaacctgggctttcaccctttcctttattttttcttctgtagaactttcagcacggttttgtcaagggagaagattagagtttctattttaaaggcagatgtactgtcatgactctctgaagacttgctgttaatcgctaaaactagtaagttagcacttagatacagacatagttagaaggagcacaggattaaaaactgaaaaaaacatcttttcccagtaatcctagctattatttcatggtggtccttttccttctctgggcctatttctctctctcgctcatttatttatttacttttagacagagtcttgctccgtcgcccaggctggagtgcggtggcgcgatctcaattcactacaacctccgcctcccgggttcaagcgattctgatatctcagcctcccaagtagtagctggggttacaggtgcgcgcacgcccggctaatttttgtgtttttagtagagacggggttttgccatgttggccaggctggtctcgaactcccggcctcatgtgatccgcccgccttggcctcccaaagtgctgggattacaagcgtgagccaccacgcccggctgctgggcctatttctctatctgtaataatgattaaacgtcaatagcacttactacgttcgaggttctggtctgcgtgcttttacataggccgtaactcatttggtactctcgacaatcttacgaaacacagtactgttattaagtttatacaaatgagaaatttgagggacacgagactaatttgttcaaggctttacagccagttgaatggctgagactgggtttttatccaggtgggatggctccagaagcatgtgcttttaagcattatgctttattccctaaaaagagggggcgaatttaaaggaaccttcttttatgatttcaaaatttgtttgtaactaaccaaaaccatttgagaaagaagacctgttttctgtttctgactgtgcagactacagggttacatacctaggagacaaaagataaagaattgttgatttggtgcctagtggggtggctatccttaactacccttgttttctgtgctttttgttctgcagagggtctaaaatggccgactgcggcaggctggacacacccttcttgttttgcctgattttctgtctgatctaatgctttgagacatctaaccagtcatttactgcagtagttttttttttaacccattattagtatttcgtgttgatctaaatatacaatagtgatggaaaggttattgtcttttttcttgtaataaaagactgaaaatacatttgttttatttttattatttgcttaggatacattcgtggaagtggagttagtacatcaaagggtatgaacattttaaactctcagtatctattgccaaatttcttcctaaaaaggttgtatcaatttttactcatacaagcgctgaatgttgttgttttttaatttttaatggataaaaaccagtattaatttttcgtttgcctattagtttggattttcttcctccatatatatctcagcagttttctttcatgtaatgatagttcatatcttatgttgatttatgcgttgaagttttagtttactgtttattattatctgtttgtgttctgtaaataaagattagtattcagacttttgtaatgttataaatacctactccatgttattgtttgcctcttaatttttgtctttaaatttttggctagtagagatttgaaattatttgacaaatttatcttctattttgtgatttttattctattgtttaaatttgaatagctccctcagtctagaaatttggtaaatattgtaactttgcctgagggtaactatcaagcatgggagaaaaaacatccatgattttaccacccagagataactattgttaatacatttattcacttcattctctgcatttttctttgcagttgataatatatgtgtactattttatattgtgttttgtttttaacattataacatgcgcatgtccatgttaaacattctttgtaattgtcattgtttcatgatgttctgttgtatggaagtattttacagattttcagtattttaaattatgtaatgaatatcttttcatttggtttttattatttattttgggttgtttatcgaagagacttctagaattagttatttgtcaaaagatttgaacattataaagaattggcatatttacttttcaaaaaattaatgtcagtttttgtacccagtcatttaggtacttataaaaaatgtttttgctttttttttttttgctgactccatatgtaaatgaatgaatgatatctctgtggggtttttttgtttttgtttttttctgagacaggctctccccctgtcgcctaggctggagtacagtggcgtgatcatggctcactgaagcctcaacttccagggctccagagatcctcctacctcagcctcctgagtagcgggagtacaggtgtgtgccaccatgtccagctaatttttaaatttttttgtagagatggagttttgccatgttgctcaggcttgtcttgaactcctgggctcaagtgattttcccaccccggcttcccaaaatgctgggattacaggggtgagccaccatacctggccgatatctttgttttgtgatacagttctctgattattagtgaggctggacttttagatcttaattactagctcttatttccttttgtgaattattcaatttgtgcctgaatgttatttgtaagttgcaaatgtcgtttgttgcagatatgctcccagtaatatttgttgccattgagtctgaagaaatgtttgcaattccaaatataactgctgtgtggatacatgtctggttcttggtagccattttgagataacatttgtctgacctctatcttatttttgtttttatttttagagtggaggtcttgcccaggctggtctcgaactcctgggctcaagcaatctttctgcctccgcctcccaaagtgctgggattacaggcataagccaccttacccagccttgtctgacctttaaacagaaatccatttctttttatctaaaaggaaagcacttttgagtactgtacaacagtggtgcttcctggctctgggcatggggagaagacagggcaacattttgtccctaatgagaaactaatttagacaagaaacaaaacagcggtcccttctcccccatccattcagggactggtcttattttaaatatttctgagtggtctgagggaggatatgggcaatattgaagtgtccacatttatacatactgttaaatgctttggggatgtgaaatgctaataggaacacgctagcatgtgagaaggcaccaggagtgggctaattggcagaaaggaacagtgtataggcaagagcagtgaaataactttaggggaaaatagtatgttaagcttattaaataacagcctcatagagacattgggtcccaaaacagtgatctcagtataactgtcaacaacttgctgatgttatcagccctatttgctggtcagagacaaaaaagccagtaaaaacctaggtattattaagaaaggtatgaggcacagaaaaatgccatcttatctttgtataaaaccatctgaaccaaataactattacagtaataatcttgcctcaaggagtctgttactatcactcacatgattttgaaaagggagtgggcagagtgtgttatctctctgtttcatttttcttgtttataatacataggtgaattagatattctcaaaggtcttggaggggtctaattctggtttcctgaaactgaatgttatttctagtttagagaatctgtttaattatgtttattaaataaacttttctaacttattcctactctgatctgtatattatctattttgtatttaataacattctaactttttttttccagtgaaggatgaggattattggatttagaagtgccaaatgagctattacttactgctttttgctatccggttacactgggttaatccagttagttgtaagctcccatttttcagcattttgctagctgtagatattaaaccaggctcatgtgggtagtagggtggggaggttaagaggagtataagcaaaaaggaaaaaaaaaagctcatattttagaggaggggattgagaagttcctttattggaagtctgtgcatggaagtcccattttacatcatgccagtgtctagttcccaattccgtctatggccacgggttagggaaagcctgaatatttgaaataaccgaaaagcatttaacctttgatttctataatttgttcctcacctctcttgatgttacagccagcagcagcctggagcagcaccccctgggaagaaattttacatcggccattataatacaacctgataagtgttatagcacttatcagattgtattgtaattgtctgtgtatatgcctgtctctcttcctgttatcagttagactgtgagctccttgagggcaaggaaggtgtcttcatctccagagcccagcctggcacattagtaggcctcagtaaatgtttattagatgaataaatgaatgactcatcagcaaacatttattgtgtgcctgctaaagtgagctccacaggctctggattgtcagctgtttcttcaaaaagcatgtggtcagaaatttgatatttctgtatatatcttcctaagagtttctcatgagacaatgccatttttgtgtttggatttcagtccttgatatttacagatgttgcaactgttgctattgctgacacttgctttcttggtgggacttgagtgataactgttagattggggcctcatcctcagggcccaggtaatcatccaaatagtattcttagataggactttgcatttttctttcttttttttttttttttaagggacaggttctcactctgttgcccaggctggagtgcaatggtgcgaacacgggtcactgcagcctcgaactcctaggctcaggtgatcttccacctcagcattctgagttaggactataggtgtgtgccaccacccctggctaatgtttgtatttttcgtagagaaggggtctcgttatggtgcccaggctgttcttgaactcctggactcaagcgatctacctccctcagcctcccagagtgctgggattacaggtgtgagccactgcacccaaccagactccatattctaaaccaagggtgggcaaactttattgcccatgggctacctgtttttgtaaataccattctatattggaacacagccatgttcattcatcgatgttttacctggggccgcttttgcggcccagtggcacaattaagtagctattaggttggtgcaaaagtagttgctgtttttgccattaaatatattggagacattgtggcccacaaagcctttgtagaaaaagatctgtgcccactctggatcatcactcgacagtgatggtttcatttctcattccattcaccagaccagaaattcatatttatttacttcatttgtcattgcttgtgacaagtctttttcctcttttacagataagccagctaagacatgttttaaagtagaagattataagacctcccccagggtcctgcagtcagtcagttataccctgcccttcaacatcaagctttgaacctctactctagaaataccttttattatattcaaacttgaagcacgtggacatagcatgctttggtgccttcgtccttgcccccctccttcctacacagttctttgcaatgagaatatgggaaataaggacttaatgtgagataaggcagaaaggtaagctgaggcaaatgtttagagggtccctaacactaatttttaaatgaagaagtggggtgtctgaaatactcatttatttagatgtatacagatagtgagcctagacttccaagagcttagagcccctccccttgtgcctccccaactttacatgtactatcttggtaacctgcctatgaatacatgttgattcatttcacttcattaaaaagtcggagagctcaaagtcatatttgagaaagctaaatctaaaacaaaatggaggaaacactgaataggttcatctcgttggataggatcatcctaggaataaaatataatagaaggaaaggtcttacagccatatttttaaagctgcttgctggatttttcccaaaattgtattgtgaaagttgtcaaacatacatacagaaaagttgaaagaattgtacggtgaaaagccatgtacccaacacctagattttataattaacatttaactatacagtcatgtgttgcttaaagacaggatatgttctgagtaatggatcattaagtcattttgttgttgtgtgaacatcataggggagtgtacttatacaaacctagatggtatagcttactacacacctaggctatatggtatagcctattcctcctaggctacaaacctgtacagcatgttgctgtattgaatactgtaggcatttggaatacagtggtaagtatttgtatatccaaacatatctaacatagaaaaggtacagtaaaaacgtggtgttattatcttatgggaccaccattgtatatgcgcctgtgactgaaatgttactataagattcaggactgtttgtgttatcacagtaactcatctttgttgaataggttttaaaaatctgtctgtcttctgtgttaatgtcatctgtatctgacccatcatggtgctgaaaaagcttcttttcattcttatttttgtcttctaagtcagcatgaataccagcacagcccaactatgtgtaagcagatctgtgcaggaatgagagtcccagggagagaatccacgttgtttctgaaagaaaatggctatagctcactgttgtttactggaaatagtagggggaaggaaagatggaagtccaggtccagtgtcatatactgccctgcaccttactcacttctctgcctttagggtaggtggttttctgagcagcttctgcttggttctctcctttaaggcttgctaaaggagaaacaacaatgtcatattgaaatgccaatgaggcaatatttagcattagaataactttggaattctagcaaatggaattttaatttgggctactgtctaatagtattctttgagccttttctgttagcaacagctgcagtttcaattaggaagcaccatgaaattttgtttatctttatccatggacatgataatggtaaatgttacctgtttgtgtctctctcctttgatttaaactcaagggtagagatgtgttttactgatctttgcaaatctcttacactgtaagatttgtattcatttatagggatatacccccaaatatatgtttaacattatttaaaaaaagatttagatatgggcatattcacggtgttcataacagtaaataatggaaaaacttacctagtcatgaataggaacttggttaaatacattttggtgtattcatgtaatgggacagcatagccattaaaaataaaaatagtcttgaagataaatatttgacttggaaagaagtatacagtatattaattgaaaaagggctaaagggcaatagtatagtttcatctaatcattgtaaaataagaattcatgtttgtgtatgtacatggaagttgttggatgaacataccccaagtgttaaacttttctgggattctggctgatttttttttttgagacggagtcttgctctgtcgccaggctggagtgcagtggcgtgatctcggctcactgcaacctccgactccctggttcaagcaattctcttgcttcagcctcccgagtgggattacaggcatgcgccaccacgcccagctaatttttgtatttttattagagacggggtttcaccatgttggccaggatggtctcgatctcctgaccttgtgatccgcccgcttcggcctcccaaagtgctgggattacaggcctgagccaccgcgcctggactctggctgatttttacattctttgcctaatatagttctggaattttgtttttttttttgcagtgttcatctatgactatcaaagttagaggcacattgaaactatttccattttgaaattgttgacctgaacagaagtggaataaatgggggtggtgaggggttctggaaactggagaaatttagtttggaaaagaactgggtggggtggggggaagggaatggtggaaataagatcactgccttcagaggaaggcactaactaccacctacccctctattcctggctccttagtgcaagcattttctggatcagtgtttacacttctcatttatttcacagttaggccctctacacattccttttctgcccttgtccctctgggctttaaagctacaataattgctagtggcagcagctgcttatgaatatgcaagtcttgctctagtaaatggtggccttagttgctccaataaagagatggctcaaacctatcaaggctcctgcttcccctctcctctcagctaggcagcaccaatcttccctatctatggtgggagaactttctgcctgggtctcatggtcactagtagattagaggacagatactttcttgctggtggtaggtaaaacagttaaaaatgagtcctgggtaactgctccttgggacttccaggggtttgagttgagggttgccctcatctcactgagtaacaggacacttagcagtattggcttgtgctgccagcatataataataacagtaacctgggctttgggccattgctgaattgccagatttctgggttacttttcatgctaagcagctagggactgagaaacttacaggcaataggctgcttccttagaaagaaaggaccctttggccgggcagcgtggctcacacctgtaatcccagcactttgggaggctgaggtgggtggatcacctgaggtcaggagtttgagaccatcctggccaagatggtgaaaccccatctgctaaaaatacaaaaattagccgggcgcggtggcaggtgcctgtaatcccagctactctcacaccactgcactctagcctgggcgacagagcaagacactgtctcaaaaaaagaaagaaagaaaggactccttgatggtctttggcttgtatctcatgactcgagcctgttactccagtggttgattcttggagttaggggcatagccactggtctgcctagctttttgtggtcctattgataacccagacagctgggtgagggagcagataatgttcaattccttttcacttaaggtaaggtgagtcgtggtgggagttgagattgtaaatgatagggtcttggtccaagagcccagagttttgtaaccttttcctatcagtgtgaaaaccagatgccatctgatgactagatgaaggtttcattcaccttttgcaggctgttttgatcaggactaaagaatgtaggttcattaactaccagacacagaagggccactaaggggtcaagtttgcccacttattcaaagcgatattgaagtctaaagaggggaagaacttgaaggaaactatgaagataagcactggagttcacatctgggtactaacactttggtgtagtcattggtacctctgtacccaggttctctcgtttaaaataagggcaggaatccttactaacaattgtagaccttgcaactgcctttgccagaaaatataattgtgatgctaagtgtgaatgcttagcaagagtaaaatctgagatccatggtgtggctggctggataacttgactaaggtataaaaataaaattaaagctggatctcaaaccttgactgttccatcttacgtttgtttcttttcttctccctgtcctataggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttggtaagtggccagtggctttggtgggcttgcccagttagtgggatggggtagggtaagagtgcttaataggcactaagcaattactggatattttcacattatgatatgaaaaaaaagtcttaaaatattcaggctgtactacagaataaagagtctaacctcttttttccctattctcccatttttatagatgggggaattagaaattgcccaagattatatgagaccacagtagatggcacaaattgcccaagattatagctagttggcatagaaaatggatttgagtccaagccagtactgtgtcttctactcagtgcttcatctaggttctatcaaatccaaggaagccatgtgagacaaaaatgtttttatttcacagtaaaagatttttttttctttttcttttttttaaattagagatgggggtcttaaactatgttgcccaggctgttcttgaacacctgggctcaagtgatccacacaccttggactcatttcacactaaaagattctgtaatagctcctgagattttactcctctgatgttggaaatttccatagtgtgaagttttgttatgcataaaatcacctggggtgcttgttaaacatgcagattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggtaagttgtcagtggctttggtggggttccccagttggtggtagaaaagagaagggaaactggtcgtgatctggccctttctagctttctagcttattaagtacttactaagtgccagagactgttgcagatattaacaaagtcttaccatggaactttcattcttgtgaagttagacaaagggataagtaaccagtaaatgtataatgtatcataagtgttatatcaattgttttttcccattataatgtaaaaaattgcacttaaaaatggttaggttaaactaagcaacatcttgtgtttttctccctttttcccattctcccttttaatacctgccacagttgctcaatgcaatggaggctgaccaagctgagtgtcaggaaggtcatagatgatgcaaacactcttttctctttttgtaacttctcactaggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacacagttgtgttcatccattattgtcgatggcagctttcatgctacagcagagttgagtagttgggagagaaaccaaatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttgcatatttctgcagatgtcttgacctttctggggagtaagcccccttagaagattaattttctgtagttctctattgaggaaatacatgacatttagctttttaataatttgatgccattcattgagtacctactgtgtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaacccttcttctctgggcaggtgtggtggctcctacattatcccagcaccttgggaggccgagatgggaggattgtgtgagcccaggagtttgagaccagcctgggtaacatagcaagaccctgtctccacaaaaaaataaaaaattaactgggcacggtggtgctcacgcctgtaatcccagcacctggggaggccgaggcgggtggatcacgaggtcaagagatcgagaccatcctggccaacatggtgaaaccccgtctgtactaaaaatacaaaaattagccaggcgtgatagcaggcgcctgtagttccagctatgggaggctgaggcaggagaatcagatgaacctgggagacggaggttgcagtgagctgagatcacgccactgcactccagcctggtgacagagtgacactccgtct

SEQ ID NO: 4743 - DNA, 113114 bp, human; identical to SEQ ID NO: 3501

SEQ ID NO: 4744 - DNA, 192595 bp, human
aaaaccagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggtgagtaggagcgctgccatacagcttcctggccttctcgccggctccccggctggctcggggtggcggccgcagggggtggaatgaactggggtaagtcgagctagacgagaaggaagggaaaacggaacggaggacgtctgtatgcgaatgtgtgtgtctgtgtatgagggagcgaggccgctagggcgagagatcccggctcgccctgacaggcactgcaatctaggaaaggcctctgtgcttgcgccgtaggaagggggttgcggggggaggggaagcgagcggaccggagccgccgcgcttacacgcacgcagctcggcagagtgccgcctcctttcggactggtgcagggtagagcctggccagggaatggggcatgggcatggcacgcttcggcgagagcgggaaaacccacgcggcggccgaggccgggcgctcggaccaaagccgcaaaggtgcgaagccgggcggccgtggcgaccacagagcgcccccaggacacgcgccactcggccgaggctgcggacaggtttaagttggaggccagaccgagcctcgcccagctcatctcctttgcggaaattggcttgtggccccttcgcgctctcggtggcggtcgaattgacgcttttctgtgtggcttctggcgcttctctctgccgcgccccgcagcacacgtcggctcgcgtcttgtacaccctgtagggcgggaaggccgtgagccggcgcggggagcggagtcccgctccgggaaagtgtggaaaccgcgctgctgagttggcgccgttccgctgaggaattcagcgatttcagcatgactgcttctgtctgtctgattcgtgagggaccgaatcacccgcgcaaggttttctgtctttttcgaagttaaaaaaaaattggcatccccatttcgacaacagcactcttgatttttatcaagcttctggttgcattttggaataagtgggtctcatattttgcttctggatcttggctcccagcatattgttgaatgctgtgcacagcactacatttagatatgtggcctttttctaatgttgcattttctagactgttatctgaaaagacatgatttgtgttgtagggctggcagggctgtttttaaaaatgtctaaagcactttaatcccgggatttgaatatatccttggttgtttttggtggaggagttcctggaatattttgcttggtgagaaaaggtgctgtaatggtcttctctgaactccttacgaccatttgtgttttggaggggtgaatctcccttacatcttttacacatgaggtaacatatgaccaaacgttttatttacagcagtgacgttcttatggctgaggagaatttacacttattgaaaaaatatttttagaagggaacaaaaaagtcctaagtaactgtcattttacatattaactgggaaaccggctaatcaaataaaactggctgagtgtctgaaactctatcccagtgaaatatgtggctgtgaatataattaaccatctgtctagtgagcaatttaaatttgggctggtacatttttattacagtgtctaatttctggaagacatacattttacccagcagtaacaacaaaaacgtatttgcttactaggtcaaaaatttactgtgtggtggtggtatttccctttcttcctccatgtctttcatagtccccacactgcgtaacctgggaggtcaaaaatgagcttcttgtttttgcaaatagcgtatttacaatagaggaactgaaactagccctggtggctagtgattagacatttttgtctcttagaaatactttccaatatttcacctccccgaaaatctagatagattgcatgcatgctagttaaaaaaatataattttttggtgcacatggggtagggtgattgaacaaaatttgtaagacttgaaatttctctatttactttctcttattctgatgaattctctacctggctgtcccaactggcccccccagacataaactcatacaaaaacacatgcttttttccttttagacagtttttaaggttaacagcattcagatctgtgattttaacaatatactgataaactgcttttttttgtaaatcgtaagtgtaaaataccatgacataaaaatacattgtacatatatttaaagttttccctatggtgtgattttagccagaaatttattactaggaaaaaagagggatagagtttgagtagagatgaaatggctccgggaagattagatttgagagaccttcaccaaatagctattgttaacataacataatttaaatgaaccacggattgattgtgcagtaagctagagaaagtcatttaaaggaaaatatttttaaagcaaatatttgcctaaataacagctctgataaattggtaacaattatgtaagtacatggcagaatttgacatatgtcaagtctgttaaataaatcaacctgttcagtgaataaatctttgatgcatcagtgctttttcacacacacacacacacacacacacacacacacccataacaccctgttgccaaagtcaaacaactgcagtactgccactttctgttttacttcaagtctgtcccttttccctctttttcttttttccacaatcttctggttacctgtaagctacctggtgagcagagagaactaaaggtgaggtggtgttgcctgtgtttaggaggtgggagaagatgagaaaagtgctaagtgttggagcacacaaagatgggttcatggatcctggacacggtcactatggaggtcctcgtctcacggaccaccatagtgtatttgcataggagaaggactggcctatccagagaagcattggttgcagtttctctgttcctaaatccagttctagtaaataatattttttcttctgtatatcccttagtaaggggagaaaaatagattctaaatggcattcgactgttacattatctttaatcttttatctgatggcacatatataagtgttcccggtaggagtaagcaaaaggagaaaagggccaaagtggatgaaagggaaggggaatgattgactaaggagtaggtcatttggcttccttgtttttcccatcttaagagatttttggtttggacattattcattttttttttcttttacttcctctgaaaagttggccaccagctccctaatggacagtttctccaccagagcaccttttcaaacccaaggtcatagggtcagacacaaagcacttgttacgttctctatggcacttctccagggctgcttgaaaacaaaacaaagaatatatacacctactacgtacccataagaattagaaaaacaaaaacaaaaacaaagagcaccagacaagtttgcatcacttggagctacctttaagttcacaccttttctcttgcccagaaaatttctttttaggcagaggtgaacattcgtgtcttctcaaacaacaagtggctctgtttgtaagtacatcacaaccttggggaaatctggtctggggtgtcgtcagttgggaaagtggagggttggggaaagctgccttttagtgatgatagagtcttttatggaccagctacaggtaggcgtgaggaccttcattgtctctgttcccttcagtccctcattgcccacagtgattcacaggcctctgctagggaacgtgctcattttggtctttttctgcaggtaagcactatgatctgatttctttccctaccatcttctctggtggaaaagaagctgaagtcttcatgaccaactattaatactatgtacacaattattacttttccaaagagcacttcaatatgtcatcttatttatccccagtgtgataattttgatgtaaacaattatctactgttttctctagcaccctcaagccccattaaaaaaattttcagcttctcaccctcagtagcccattttaagtgttataccactagcttaaacaagaagttcctcctgatgtttactctgaaggggtttagaggtttgagaccaagattaattataccttgggcctgagtgctaaagtagtgccaagtcatcctctgtcaagaacaggtgtaaagacttaaacgttagacctaaaaccataaaaaccctagaagaaaacctaggcattaccattcaggacataggcatgggcaaggacttcatgtctaaaacaccaaaagcaatggcaacaaaaaacaaaattgacaaatgggatctaattcaactaaagagcttctgcacagccaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccagaagacacatgaaaaactgctcatcatcactggccatcagagaaatgcaaatgaaaaccacaatgagataccatgtcacaccagttagaatggcaatcattaaaaagtcaggaaacaacaggtgctggagaggatgtggagaaataggaacacttttacactgttgctgggactgtaaactagttcaacccttgtggaagtcagtgtggcgattcctcagggatctagaactagaaataccatttgacccagccatcccattactgggtatatacccaaaagactataaatcatgctgctataaagacacatgcacacatatgtttattgcagcactattcacaatagcaaagacttggaaccaacccaaacgtccaacaatgatagactggattaagaaaatgtggcacatatacaccatggaatactatgcagctataaaaaatgatgagttcatgtcctttgtagggacatggatgaaattggaaatcatcattctcagtaaactatcacaaggacaaaaaaccaaacaccgcgtgttctcactcataggtgggaattgaacaatgagaacacatggacacaggaaggggaacatcacactctggggactgttgtggggttgggggagcgaggaaggatagcattaggagatatacctaatgctaaatgatgagttaatgggtgcagcacaccagcatggcacatgtatacgtatgtaacaaacctgcacattgtgcacatgtaccctaaaactgaaagtataataataataaaaaaaaagaacaggtgtagcaattcattttatttaggggaagttaaaacatttcctctatggaggactataagtagagtgaccatatgttgtggtttatgcctgttgctccagcatacttattttaccctcaaaaatgtcccagtttggaaaagaattttgtgatcaccttagtataagccacctttgaaagaaaccatgattctcaatttggggaggtgattatatttgcaaaacttgagggtataatgagctttggagacattatagtcccctaacccagctcaacctatctttttcctagttaagagatctttctggagaagaacccctgaaatgattcagggtttcggctcaacagaattggattattggctccaaaggcatctctcctaaatgcctgtttgtatttgcacatacacatgcacataaagaggtgatgtctgcatgctggaaaatggctgctctaactttcatgaaagactggtaagaattaataagtttaaagtttatcaggagaaacttaggtttagaagcaacatcctgaccatggtatttgtgagatacaagggcatagcaccaagagaagtgttaattcttttcagaataggtttgagaagtgcacaggcaactttctatttcaaatagtttgtatgtggtcattactcttatgtatatagtttttcaatttgccttttccataatggacacgatgatcttttcaactacctctcattcctcccagtatccatgattggctttcatcgatctagggcaggagttaaaagaaactatggcccacaggccaaatctggcctgccatggaaaaagaaataatgcagacaagaaaaaaaatggagccatttagagttgcttctgcaaacattttcaggcttcctcttcttaattgagcttcatttagttcaatgttaggatgagtccacatttcatgattatatttcagctcatatctagtgtttggagattgtccagagcctggtagagtggcagggggtgacccgaaaagtgaaatccacaaatggatttttttgtttgagtcaaaatgtcaatagctattttttctttcctgcctaggtgagtaatccaaattttgttgtgccactaaattctttatgccttcctccccaatatttgtcatgttattccagacatgcatatgatttattaacccagagactagatctcagcaaattgcttgaataggaacatgctttgtctttagttactaaataactggaacacatcctgaagatgtgctgttttactaagtagggaagtagaaaaagtgggtcatcaccatctagccaatagtccctaaccttggcatgaacccctgtgaaaattcagtgaatgccaaggatactctcttcagaaaagtgcatatttacacatgtaacacttgcatacattttcaggaagtccagccatatattgtgagtttaaacctccgtgctggcctttccctagctgttacagaattcttgttgtatggctgtcatggtcatggtagcttgaaatggaagccattaaatgtctctctcaaaaaacatgttattagtatatttatgggccacatccctcagctaccgtacaagcatttttctgattagccttcacagacatttttttattatgaagaagagccacttagcactcacttttacattaccattctcaccaaaaacgtcaagactagtttccccaaattattgacttgtcaactctctgattcttcaaaatgcctgttcagctttcacacaccccacacacaagttcatcattaatatataaaatatattccataaaagctcactcacatttcatctgcctctacctctctctgtttcatctgtttctctcactctatatatttctcttagccaaggttctgacaaatgtggggaactctttctagcaccaatcattaggtatggtgatggagtcagagagggagatggtgtctagacaccttcatggggaccttgagacacatgagctttttggagtattagacatcttggagagagttaatgtatttcatcctggatatctaacatcatatattaaaggcaaagttccttaagctctgcaaacacaaatatatgccacatctgcgccttgcagttgggatggtagtaataggtggtatattagtctgttctcatactgctataaagaaataactgaaactaggtaatttacaaagaaaagaggtttaattggctcatggtcccacaggctgtacaagaagcatggctgggtaggcttcaggaaactttcaattatggcagaagtggaagcaggcatgtcttacatggccagagcaggaggaagagaccaaaggaggtggtgctacacacttttaaacaaccagagctcatgagaactcactcactatcatgagaacagcaagggggaaatctgccccccatgacccaactacctcccaccaggcctgtcctccaacattggggattacaattcaacatgggatttgggcagggacacaaatccaaaccatatcaagtggtattcagattcatgaataaatgtttattgcttgttgtcttggtagtttagaatactgtagagcatgtgggttaatagaaccctaagactggaggggtccattaatgataattactgattcaattcagcaaacacttattgaacatctactctgtgctaagccctgagatattggggacagataaaagaataaaatgaatttttctgtctcatagggaattagctttgctcctggctgggtctttttaccatctgcatgaatttacccccctattttcctaattcaatgcattcttctattgtttctatgttctaccccttggtaaatgtcttagtctgtttcctgttgcttttaatggaatgcctgaaactgagtaatttataaagaaaaggaatttatttcttaaagttatggaggctgaaaagttcaaggtagaggggctgcatctggtgagggccttcttgctggtgaattctctgtagggtcctgaagcagtaccatggcatcacatggcaagggggctgaatgtgctagctcaggtctctctcttcctcttcttataaagctaccagtcccactcccgtgataacccatttatccattaacctattaatccattaatccatgaatggatcaatccattcaccttttaaaggctccacctctcaatactgccacatcagggattaaatttcaaaatgagttttggaggagacaaatcaaacctcagggagtttcttggcaaataggtatctctagctgggttgagacaagatttccagcccctatggcaaaaatgcttcttttcttatccttgcattagtttagcaggccccatttaatagggaataatgtgattgtttccctgtgattctgaggcaacatttctatcactgctatcattggtgatgtggaattgcaaatatcattagccgtgatgtattgactactgccttaaaattatagtatggagttgttgattctgactaatgaattgaatgtactctgcaaaaagccagctgtccatctttgagtgagttgatttttaacccctatttggtagctttagcagttttctactatggttgctgtaacaaatttccaaaatcttagtggtttaaaacaacaaatttatatttctacagttttgaaggtcagagattgtctgaactaggcactgactaggctataatcaaggtgtaggcagggctatatttatttctggggtctctgggtggagactccattttcttgcttttctggcttctaggggctgctggaattttttagctcatggtccccttccatattcaagccagagatgggagattgtttcctcacactgcatcacttaaatcttgcttccatcattacatttccttttctgactctcactcttctacctccctcttctgtttataatgacccctctacttatatttggtctatctggatggataatctgggataatatttccatcccaagatttgttgattttcaaccataattctatctgcaattttaattcctcttgtgccatgtaacctaacatattcacaggttctaggagtaggatgtgaacatctttgaaggcctttattctgcctaccacagtgacttgacttttttgttgttactttttattttggaataattatagaatcactggaagttgcaaggacagagaggccctgtgtatccttctcccaatgccccaatggttacattttgcataatagttctgtgtagttctgtatcactttatcacatgtgtatatttgtgttttttatttatttttagttttgtagaaacatggttttactgtgttgcccaggctgatcttgaactcctggactcaagaaatcctcctgccttggcctcccaaattgcttggattacaggtgtaagccagcgtgcccagccagcacacatgtatatttgtgtatccaccatcacaatcaagataaaatattatttcatcaccgctagagatctcttttgtgctacacctttatagtctttgtaattcacccccactcctttgccatatcaaacttgcaatcaccaatatattttccatatctaaagttttatcatttcaagatttttatataaatggaatcattgagtatgtgacttttgggggttggcttttttcactcagcgtaatgccctgagatctattccagttgttttgggcattaacaattcatttctttttactgttgaacagtattacatggtattagtgtatcacaatttatttaatcattcacctgtagggagaaattttggttgtctggagtttttggttattacaaataaaactgctatgaacattagcatacaggtgctttttgtttggttggttggttttgtttgtttgtttgtttgagtggggcggagactttctctgttgcccaggctggagtgcagtggcacaatctcggcccactgcaatctccacctcccaggttcaagtagttctcctacctcagcctcccgagtagctgggactacaggcgcatgccaccatgcctggtcaatttttctaatttttgtatttttagtagggataggtttcaccatgttggccaggctggtcttaaactcctgacctcaagtgatccacctgccttagcctctgattacagagttggaattacagtgctgggattacaggcatgagccactgcacctggcctagcatttttgtgtgaacataagttttcatttctctgggaaaagctcccaggagtgcaattgctgcattgtatggtaaatgtatgttttagttttttaaactaaaaactgattttgcagttttttcagaaactgaaaatctattttccaaagtgtctgtaagtacataacttattatagtctactagtatcaacattttacctgtttgagtaaattatagaaaccttacccctctttaagttcctttaaccttccccacttataattgccttactttctctacatatatctagaactacattagacaatgctacaatttttgcttcaaccctcaaacataattgagaaacccaatgggagaagcaaagtcaattatatttacccttttactctttctgttgttgtttctttctgaggtttctagatttcttcttttacattttttttctgttagagatcttcctttacttattcttttaatgcaggtttgctagcaacaaattatcttagttttccttcttctgagaatttattgatttcccattcattcctgaaggatattttcacctgatgtagaaatcctggttgacaggttgttgttgtttcctgaaagcatttgaaaaatgtgccatttctttctggtcttcatgggttctgatgagaaatctgctttcatttgaattgttttacacttgtagttagggtgtcatttctctcttgctgcttttaaggtttttttttttttctttagtctttagaagtttgactatgatgtgccttggcaaaatttctttgggttcatctggtttggtatatgctaagcttcttatgtctgaaggtttatgtcttttgccaagttttggaagttttcaagtattattccttcaaataatgtttctgtcctgccttctattcttcatggtttcttctgatgagagaaaacttagatcttgtttttgtagttctacaggtccccgaggcctgttcatttttctcgtctattttttctctgttgttcagactagatagtttctatcattatattttcaagttaagtgattcttttctccatcttcttcattctgttgtagagaccatacattgagtttttatgttttgattattatatttatgagactttctatttttcgtttgttacaagagtgtttctaattacttattgaaacatttttgtgatggctggtttaaaatctttgtcagataattctaatatctctttcatcctggttttgccacctatcaattgccttttttcattcagtttgagatctttctggtcattggtatgataagtgatttttatagaaatatatacgttttgtggtatgtcatgagactttggatcttatttaaactttctgttttatctggctttctctggcactgctctagctccaggacctccaattcctggggaagggagttgctgtcttgttactgccagatggtagtagaagtctgcttgcttgttgacagttggagggcaggacttctcattattgcttgttaggggttggaattcagccacatttcaagtgcttggtagccatgtatggttagtggctaccatattggataacatatatgtagagcatttctgtcactgctctaggaagactgaggttgggggagggagcagtaaaagagcttggcactacaggaattggggtttgggaaaactggcacagatggaataagacaaggatctagttattgtatctgaggtccatggctagggtttggttccaaaacctgaggtgctgtgagttctatctagagaaatatgggcacagagaactcatctggttaatatggatccagtagggcagagttagtatccatagtattaactaagttttgtcctctcagccattgtaaaagacatggtgtggcatgctgcagatcctagtaccactctatttgagtagagggaaagtcttccctattagatggcagttagtttgcttatttgtagcaacatacttgacctccatgactgaggtaaccattgattgaggaaacgttaacagaaaagagtgagttgtgaaaagggtattcatttagtttataggatctagggtttctttggcatcttggtggccttaatgttctaatccttgagacttccagcatgcttagccaggtggggagcatttatgtaagaactctgtccttcactgagctctgtgttgacttgttggcactttttgtccaagtcccaaagagttagtggaccctgttacacagcttctttgtacactgaaataactgttgccttctcaagtctctctttgcttagattagtgggggtgtacttaatgtagattcagtgttttcaatctccccttggggcagttcgttatattttcccttactggctctatgtgtgtatacatcctaatgtgcttgtatttatggactgcctgtgtactgtatctcttggcaagggaaaaggaatacctagtgtctattgaatatgtattgtttgtatagtatacaggtcacatgaccttttcccttagcaagacctgtatgtgcaaagctgtggctttgacatgttaagatatttcataacacagtcaaatccacttggctgaataggtgaaagaaaagggaattgagccagggctatagtgggatttttcacatctatgtcgtttgacttaaaatgaaacaaaaatacacactcatttgagaaagaagcagtttcagagttaggctgtaaagagaaaataaacatgctttataacccaaagccaaggtgttggttttaaaaccctagactatggctcacccagatccttccagtatgtgtatatgtggggaggaggtgagtgttgctggtctgctactcagagatatggagatggtatcatgggagcaaaatcccaatttgtcactttgtcttttaagaaggctccaaatatgccacttacttttttttctttgagaaggagtcttgctctgtgtagtggcatgatctcagctcactgcaacctccacttcccgggttcaagtgattctcctgcctcagcctcctgagtagctgggattacaggcacccgccacaacccctggctaatttttgtatttttagtagagacagggtttcaccatgttgtcaaggctggtctcaaactcctgacttcaggtgatcttcccgccttggcctcccaaagtgctgggattacaggtgtgagccaccacatccggctgccacttacttttgaagacagtggtcactagttgtgctgaggggccaaagggtcaggatactcttatacaaatctaagaagagaacctggaatcaccttttcttgccattgatcttaccattttcctataagccacagtattagtttgttttcacgctgctgataaagacatacctgggaagaaaaagaggtttaattagacttacaattccacatggctggggaggcctcagaatcatggtgggaggtgaaaggcactacttacatggttgcagcaagggagaatgagggagatgcaaaagcagaaacccttgataaaaccgtcagatcttgcaagacttattcactaccaccacaacagtatgggggaaactgcccccgtgattcaaattatctctgacaaggtccctcccacagcatgagggaatgatgggaatactattcaagatgagatttgggtgggcacacagagccaaaccataacattccatccctggcccctccaaatcttatgtactcacatttcaaaaccaaacacgccttcccaacagtctcccaaagtcttaactcatttcagtattaacccaaaagtgcacagtccaaagcctcatctaagacaaggcaagtcccttccatctatgagcctgtaaagtcaaaagcaagctagttacttcccagatacaatgggggtacaggtattgggtaaatacatctgtccaaatgggagaaattggccaaaacaaaggggttacagggcccatgcaagtccaaaatccagcatggcagtcaaattctaaagctgcaaaatgatctcctttgactccatatctcatgtccaggtcacgctgatgcaagaggtaggttcccatagtcttgggcagctccacctctgtggctttgcagggtatggcacccctgctggctgctttcacaggctggcactgagtgtggattttcctggcacatggtgcaagctttcagtggatctaccattctgggtctggaggatggtgggcctcttctcacagctccactaggcagtgccccagtagggactctgtgtgggggctctaaccccacatttttcttctgcactgccctagcagaggttctccgtgagggctccacccctgcagcaaacttttgcctgggcatccagcatttccatgcatcttctgaaatctaggtggaggttcccaaacctcaattcttgacacctgtgcacccacaggctcaacaccacgtggaagctgccaaggtttggggcttgtaccctctgaaaccatgggccgagctgtacgttggccccttttagcaacagctggagcagctgagacacaaggcaccaaattcctaggctgcacacagcatggagaccttgggcctatcccacaaaaccattttttcctcttaggctcctgtgtctatgatgggagaggctgccatgaagacctgtgatatgccctggagacattttccccattgtcttggggattaacatgtggctccttgttacttatgcaaatttctgcagccagcttgaatttctcttcaaaaagtgggtttttcttttttactgcatcatcaggctacaaattatctgaacgtttatgctctgtttcccttataaaagggaatgcttttaacagcacccaagtcaccttttgaatgccttgctgcttagaaatttattccaccagataccctaaatcattttgctcaagttcaaagttccacaaatctctagggcaggggcaaaatgccaccagtctctttgctaaaacataacaagggtcacctttgctccagttcctaacaagttcctcatctccatctgagaccacctcagcctggaccttattgttcatatcactgtcagcatttttgtcaaagccattcaacaagtctctaggaggttccaaactttcccacattttcctttttctgagccctccaaactgtgccaacctctgcctgatacccagttccaaagtcacttccacattttcaggtatcttttcagcaatgccccactctgctggtaccaatttactgtattggtccattttcatgctgctgataaagacatacccgagaatgggaagaaaaagaagtttaattggacttacagttccacatggctggggaggcctcagaatcatggcgggaggtgaaaggcacttcttaaatggtggtggcaagagaaaatgagggagatgcaaaagtggagacccctgataaaaccattggatctcatgaaacttattcactaccacaacaacggtatgggggaaactgcccccatgattcaaattatctcccactgagtccctcccacaacatgtgggaattatgggagtataattcaagatgagatttggtggggacacagagccaaaccatatcagccactgtggggtgggtggttgtgtgtgtgtgtgtgtgcacgtgcatgtgcacatttttctccctaattcagtaatgctttgttagctatacttacatggatttagcacctgaatgaacagaaaaacccatttgtttattgtcgaaatagtggggatgccatgacattgctgactgccatgatttgtgattcattaaggccaggatacttctagacaatcactgaaagttgaaaagcaggtaagtgaattaatctcttccctttgattttcacctttaatattataaccttagatatgacttcaatatcttccagcactgagtagaattggttaagggaaggccagagtggatgtagttaacaccaggaatggaattccttttgttttctgaaaattcagtttatagtttattagactgaagaatccacaggcctgcctcagacaaccaggccatatactagacaagagcactctcagattacactttgaaatgaaagcctattttggcataatatgcactgaaaggaaaagtgtgctcctaggtatgctctttactttgccttttggactgtcctcttgggtttcctcagcctttctctgatctgtatggctctaggccccactcccaataaccctctaggaggctctgttccatgtcatctacttatggcactgaaataccaggtgtcacatggtataaggtagtagtgaccacaaggggcccagaggaggatgtttgccgagggaagcagcctgtttccagatcctcaggtagagggtgtgctcaagcagctgagacagcctgaggtgggagaaggagcagtggatgataggtcagagctgccatttccattggttgttgagatggccagctgagggagacagttgtttgttcagtggtcctgaggaagtaaaatcatatactggtgttttttgattcaggcgacagattgatgttaagggaccataggcatttaggctgccaataataatacctgatcatcctatagctccttctaaaggactcaaaggactcctatattttatttcatttggcctcacaaacatcttcatggacttaggaaaggtaaatattgatagtcatgtaggacaagcttttctctctctctgggcctcagaattttcaaattgtgaaatggaggcttggtctagagatgatgatctctaaggtcgtttcccacagtaacagtttctatggtggcaacatcttccaggtggaggaattaagtctcagacactttaaagtgagttggacacaactacactctctatcaggtacagagtgatgattacaggcccaggccatgatcccttcccttagcttgccctattagtggtctctttgaacagtgaggtaaggggcgggggggggggtgctcttgcttctgaacacacaagggctttacttatctgtttcatttaacactctcccctcacctgaccaccttcccaaactacctcctgtcactcatcagcagggccttcaacttttcccttgatgttcctcgggattcatatcttgtttgactgtagctgttttcctggtgtattgtgtggctagatgcaaagtcattgctacccttagagagtaaagtctggaaccagcacttcagttacatcaggaaagagaggctgtgcctcctgggtgtggcagggggtcaaagtgagaagagacattcaaaaacatcatattataaggtgccctgaaaaagcaaggagggtctgtagattagggctggggaaaaaggactggacaaaggtatgatgggggaaatcagacagtgagttgatgaaagcaaatacattcaatgatcaattaatatgcagcaaagaggctaggatgcctgagatttctttggagttggaggataaacatggcatttatgactgtgacagggatttatcttgggagagggcagtaggggaaaaatgaaaagctttattttcagcaagttcagcttttgtagtaagatatttagcttaagaaatgcaagctaagtactgtgagggaataaattcagagaaccatattccccatatgattcctggaaaccagtaggaatttggctcaagaagggacggcagaaggtgatttgtggtgttataacagccgccttggaagccaagatggaaaatttgtccctgaaaggctaggcagttggaggagactcactggaaatttctgtccggagaaaataaatgaaccagagaagagcttaaaaacacatggtggagggtgaagtctgggacacccaggaacccatatcttgtaataggtccacttgttaaattcctggcttatggtctagaacaggattttgttcatttccttggaacaaaaaggtccccaggcacccagagcttctatcttatcccagtccacagcctcttacccgttctttcatttctcttttcttttcctttttttttttttaagagatggggtcttgctctgtcacccaagctggagtacaatggcacaaacacagtttactgcagccttgaattcctgggctcaagggatcctcctgcctcagcctcccaagtagctggcattacaggcgtgtgccaccatgcctggctaatttaaaaaaaaaattgtgtagagacagagtctcgtcatcttgcccaggctggtcttaaactcctaggctcaaacaatccttccacgtcagcctcccaaagtgctgggattacaggcatgagccaccctgcccagccttttttttcctatttctctcattttaagaataaattcatttatcatttatcaaaagaatccatgaaaatttcacaaatattgaaaaatagggaaaagaaatagttcaacgttttgtttttagaaattatttgtgtctttatttttgtttttgttttttgttttgttttgtttttgagacagatggagtctcgctctgttgcccaggctggagtgcagtggtgcagtctgggctcattgcagcctccaactcctgagttcaagcaattctcattcctcaacctcccaagtagctgggattacaggcacccgccatgatgcctggcaaatctttgtatttttagcagagacggggttctaccatgttggccaggctggtctcgaactcctgatctcaagtgatctgaccgctttggtctcccaaagtgctaagattacaggtgtgagccactgtgcccgacgtttgtctttattttgaataattataaaagtattgaaaagactaggaataatataagaaatacttggatctctacttggagaaataaaacattacagacaagttaaattatatcccctattttcagtcacattcctctccattcattttcagaagcaagcactaagataagcttggtatgtattcttccattttgttttatacttttgcatgaaagtatgtctctcctctcccctcttcccataaataatatatagagcttgtctgtgtgtttttaaaatttatgtaagtaataccttaatgtatgtgtcattctgcaacaagtttttttgttttgttttgttttgtttttacccaatatcttgttttggaatttattctattctcttttttacattccccttttctactcaaactgtaccctggagctgatgacatgtacattactttttcatatttttatgataaaaataatatgtaaccacattacaggaaagttggaaaatccaaccaattgatggctcttaggaccagagagctcagtgtcctactgtagacttgatttgcaaaggttctaggcagctgggctaacctagtggttctgcctgtaaaatactgaagagcaaaattggaagtctctagggacacttccttgcctgtctgttaccccattccatgaagtagtaaaacagaggcccagagaaggaaaatgacttaacaagggcacacattcattgaatattgtactcgagatttctggatccctgtcttgtacttgaaacgtttccaaggaaaaaaagagcggtggggagagagagagagggagagagggaaaggaaacctagaactgcaatttttcatcgtaaaaattatccattttaataaagcatgggaaatacagaagagtaagaaaaatgaagatatcaagaattgtccattttcctattttgaacttctgatcttttttcttgtacaacttttgtttctttgattgtaccctatcttgcttttttccacttaactttataatgtcataatgcacatctttttcaaaaagcagacttctacactgaaatcttgacagtaaatatttttaaggcacatatttgctatttagccatttaaaatggtataggcagggaattgtgtagagaggaaaacaatggcgtgggatattttccagcaagtttgttcctgtcctttggctagatctttttcttctaaaacaaaacaacaataacaataagatctaggtagacatttctaggattcctgctactaaagtattcattcagagaagtttcattactctctcaaatggcctagggtgtgaccaagggtcactctaatatactcccctccacttacaaggcaagggcaagtgttgcccttggggcccaaagggagccaattctggagctacctgggtcatggaagttgaccctgaggaaaagactgtggtagtttccccagtccatggagtgaggagtgaggtggggtgctcaatttttccagagcctgagcacaaagacagtgacagtcattaaaacttcttcagcacttactatgagaggcaagacatccattcccaacaaagccacaccacttcacacacacacacacacacacacacacacacacacacacacgattagaattgttgcctacagttttggttgcattgtttaattgtaatagtgcaaaagtgcatttaactatgaaggcttgctgggagaaaggaaagtgacggtttattattctagtcagttcaacatgtttgaaacagtgaagcaatgagagattaacctgctcgctcaaagtcacacagcaaaaaagtaacgatgctgagattaacaaataaaaaatgaaaacacccttattcttggtcttgggtcttgaaagctgggccttagcctgctgaagctcactgtacttctgctttaatcagtttaattcattgctagcttgcccttgccacctttgattctctttgcattggccaaataccaatttgcagtagttgttctgaagtgcttgccagtttcaatttttcaattccaggctctattctttctcacagggctagaaagccacaagtcacactagtggccagctgtatctatgacccaaacttgctcaggtctgtgtgtgtgtgtgtgtgtgtgtgtgtgtgtgtgtgtgtgtgtgtgtgtgtgtgtgtgtgtatgcctgagaatcagtgaggactccaggactgggaatgttcaaggttttgaattgaaataattgaacaaattcctctataaagaaaccttttcccctgccaaatgattttcttcttaatgatttctgcagttgattaacgtttagaaataggcagtgaagcctcagtgaacgtgtatttgctaggccatagggtgctcttgcttccaggttgtagaaaccaatgttgaaacaagtcccagctgtgtttacctccagattcaagtttcaatacaggggagctcctttccacatctattttccctccttcctgcaaaggcagctgagctaaagctgcccttaataaggagtggccttaggcactgcagtagcatttacccttcaaactgggcagacaacttctctgtggggagtctgagcctgccacacctatcacacaggctttgggaaatgtgaagtggcacttactgcaatctaacctccagagaacttgcctgcatgctggccagttgggctatgggaaaccttgccattttttgcctatccaaaggcccacacctaaacaggtctgaatgcaaatgcatgggtgaaaggggtaagcgaggggcactacagaaagctcacaactgtcctcagacccaggaggatggcaggccaagaagtccattattcatttgtttccagtgtctcaggtaagtgaagattgcagtcctcactggaaaagacaagaggggcaaggagatacatgagcccagaagagctacaatggacctcatttacagataagctagataggcacttcccagtctttttgtaccctccccaatccttctgttacctttttttgtaagacccaactttgaagagttgttttttctcctgaaaactgcacttattaaataatagcttttctgtgttcctatacatatgcatacataaaactgtaatatatatacatatatatgtatatatatacacacacataaacatacatgcatcagagctgatcagcacagagagccaatgttattctgcttggttgctataattccagggaaaggtaaaaacatttagctaactggggcagctgtatgaaaaaactctccattttctttaaagttctgaaatactgaaaatggtttgaggatcccatttattaccttttttttgttaagatgaccagggtcctcaggttggaaactactgatctagttaactcctcttccctatttttgagtcagaatgtaaggcaaattttggccaaatagaaagttagtctttgagctgggattaaaactcatcccactgggagccagtttgcatcccttcacttggtttcccctacgacatttctgagctataaatctgactcatccatgattaattttaaaaaatgtcctgaatgatacttttggcagtggtctttaatatatattaaaggcacatatggtggtttggaactgccttgagatttgagacaggacttcaatttctggtagaggtattaaaggagctctctccatttatttggagctgtaagtcatttgtagataaaatgtacttagggagtgcctactaagtgtgagatgctatcatagctgggagaagggaaggggtaggagtaacaatggaggagtgggttagtagaacagcccccatttcaggaaaactatattttattagggagatatatgtgcacaggactatttctatggcaaggcataaaacagcgcatgcctcagtagtaaattgcacatgtaacactttgtccagcagaattctctggaactgaaagatgtataatggaaccaagtaaaccagcaactgtaccatttctaactgtgaggagaaaacaagtggtgaaagttgtgcctcacaggtgctttgtgcaacaaattacaacaaaatttagaagcactaccatcctggctatttatatgtttatcattaaacctcacattgacatcttagctgcaattgttttctacctccaggaaacaacctaggagatcatctaaaccatctttatctgaaacattaattacttttgttagattatcttgcctagaaatatccatagacaggcagctacctctaaaggcaatccatgccagaaagcccattctttatattttcttttactatttttattgtggtaaaatacacataaaatttaccatcttaaccacttttaagtgtacagttgtgtggaattaaattcattcacactgttatgcaaccatcaccaccatccatctccagaattcttttcatcttgtgatactgaaactctgtacccattaaacaacagctccctattttcccttctccccagcccctggcagccagcattctattttctatccctatggatttgatgactctaaatacctcatgtaaatggaatcatacagtatttgtctttttgtaactggcttatgttcatcaccataatgttcttcagtttcatccatgttgtagcatgtgtcagaatttacttctttttaggctgaataatattctattgtgcatatataccacattttgtttatccattcatccatcaatggatacttgatttcctttcaccttttggctattgtgaatgacaatgggtgtacaaatatctcttcaagaccctgccttcaataattttgagtatatacccagaagtgggattgttgggtcatatggtgactatttttaatcttgtgaagaatttccacactgctttccattgtggttacaccattttaccttcccaccagtagtacacaagggtttccattttttcagatcctcaccaacatttgttgttttctgtttttcctttttctttttctttttctttttttttttttttttgagacggagtctcactctgttgccaggctggagtgcagtggcatgatcttggcccactgcaacctccacctcctgggttgaagcgattcccctgcctcagcctcccgagtagctgggactacaggcatgcaccaccacacccgtctaattttttgtattttagtagagacgggattttcaccatgttgtccaggctggtcttgatctcctgacctcgtgatccgcctgcctcaccctcccaaagtgctgggattacaggcgtgagccaccgcgcctggccctgttttttcaatagtagccatcctaatgggtgtaaggtgatatcttattgtggttttgatgtacatttccctaataactagagatgttgagtatctgctcttgtgcttatttgccattcatatatcttctttggagaaatgtctatttgactcctttgctcattttaaaacttagggtgttaggttttttgttattgagttataggagctctttatatattctagatattaatactttaccagatatatgatttgcaagtattttctttcattttctacattgcccttttacaatgttatttcacaataatgttgttcaatgcacagaagtcttagacttttatatactccaatttatctattttttctttggctgcctgtgctttgttctttccccccaagattactctggctattcagggtcttttgtggttccatgtgagttttaggattgtatttttctatttctgtgaaaaatgtcatcagaattttggtagggattgcattaaatctgtagatcactttgggtagtatggacattttaacaacattaattattctaatccatgaacatgggatatcttcctatttatttgtgttttcttccatttgtttcatcagtgtattatagttttccatgtacagatctttcacctccttggttaaatttattcttaacttattttattgtttttgatgctatcataaacagaattgttttcttaatttctttcttgggtagtccattattagtgtataggaatacaactggtttttgtatgttgattttgtgtcctgcagcttcactgaattcattgatcagttctaacagttttttttgggggacgatctttagggttttgtatatataagatcatgtcatcagcaaagagagacaatttaacttctttctttcctatttgatgccttttatttctttcttttgcctaatttttctggctagaacttccagtactatgttgaaaagaagtagtgagagtgggcgtccttgtcttgttcctgattgtcgaggaaagtatttcagcttttcattgatgagtatgatgttagctgtgggcttgtcatcattgggtttttgatagggattgcattacatttgtaaggtctctctggtggtatttacatcttaacattaagtcttccaatccatgaacgcaggatgtctttccatttattagtgtcttctttaatttctttcatcaacattttgtacttttctgtgtacaagtctttcttctccttgattaagtttattcctaagtattgtttgtgatggtactataaatggaattgatttcttcatttccttttctgattgtttcttgttagtttatagaaatgcaactaatttttgatgctgattttgtatcctgcaactttgctgaatttgttattagttataacagtcttttgtggaatcattaggatttttcctatttttaaaaaatagaacagtttattttagaacagttttacatttacagaattattttaatgataataaagaaaattcccacataccccacaccatcttctcctattattaacatattccaagagtgtggtacgtttgtcacaattaatgaactgatattgatatattataattaactaaagtctatactttatatttcttcagttttcttctaatgtcctttttctgttctgaaatcccatccaggataccatatgacatttagctatcacgtctccttaggctcctcttgactgtgacagtttctcaggctttccttgtttttgatgaccttgatagctttgaggattcatggtgaggtattctgtagaatgtcccttaattgggattcacctgatgtttttctcatgattagactggggtaatgtgttttgaagaagaccacaggaataaagtgcccttatcattacattgtattaaggatacatgctatcaacacgactttaacactgttgatgttgactgtaattatctggctaaggtagtgtttatcaggattctccagggtaaagttacatttttctcatttccataatgtactctctggaaataatcactttgggcagttcatactttaagactggggagttatgtgtcacctccttgaggatggagtatccacctacattatttggaattcttgtgcactggagatgtatctgttcctgctcatttatttatttgttcaatcatttatttatataagtatgtacacatgtatatcatgtatatttattttaaactttggattatagtccaatactgctttattttgtttctcaaattgtttcagctttggccattgggagctttttttggttgactcctgtgtccctttgacataccttcaccatgtggtttaatttgttttttcttttgagattgatttttgttttgccttctgccatgaaaaacttaagctctccagcatgtgacagcccttcagatttataaaaacatccaccattaccccctctagtgttctccagactaaacatttcccactcattcctttacacattcctcatgtgacagatttattgaccccttactcatctagcagctttcttctggaaacattccattttgtcagttacctgaaatacctcctttcactctccttaccctccacaacaattataaaatttaagagaaatcaaaggtagttcttctactagaaactatgtatgatagtaaatagtacccaggctgtgtcactgaatgaaaaaaattatccccatattagaattaagacccttagaaattagaggagaaatatgtttccattttgtgcagagcttactatttttcaaagctatttaggaaactattagtttgactctcctaacccatgtgggaggtaggtagggcagttagtggtatgcccagaaagccaaagcccagagaaggtgccttatccaaagtcaccatatgagttagacagactgggttctcttgactcttactccagtaaccttaaaattaggtttaaactttaactgtgtaggctaatttttgtttgtcagaccctcaaccattaatcagaattgccaatacattttcttttgagccgaacttagcctcccaatataatatgagatatgaaaggtaagtctgaaatgcaaacacttaagaaatgtttctagaaatcaaaatcatttttgtatgctagtagatatcaattgggtgatcaagccagaacttagaaagcatatggttagctttgggaacagaagtgtcaacagaacaaaaatgaatattttctaattgtccttgcttgctgcggatattaggcagctagctttgtgtctttttcagcacttatcaaattctaatggaaaggtgctgaggtgtggctaatcccaaacagtgtataatccccaaataatttatacagtaatatcctgtcacacatacacactccagtgcccagtctctgctcttctattttggaggttgcagagactgcactagatttggcagatggcaccagtttttattcctgggctgtctctgctcattcacacccagggtaaggaattagtgggagccttttcatgtattcctttataaactgagcaggagagaaaagaaagagctagaaaacttttctctcttactacctgaccactccttcaatcttaaaaccagttcgtgcaaaccagaaattgtagtatgtacagaatatttcaagtcacaactttctgggatgaatggtttccatacccaaagagcctcctgcctttaaggagtcatcagttgaaaagaaacagtcagatatctgtggcattacctactggccagagtgggatggagaaagtggtctgaagtttagttagcaaatgttgaatttcagggttgaggaaggggaagtatggtatctagataaggaagaaggcagcaaaggggctgagagcttttcaactttggtgacaaggatggggaggagtaagtgggaacagacactatccttacttggagagtggtggttgctgaggagaaggacttattgctttatattgaattttagcattaatactttctggatctctgagatggagagttgacagaagaacctaggaagcatgactaagtggttgaatctgctatggaaaaaggggaaacggggcaggcttttacttatttgaacctaggtactttgtttctttgccacctaaaagttctgggatgaactgaatgaggaatatgaattgagcagataagattccttttactggagaaaaactaagtcctttggaaacttgaacttttttctcattcaaattcatttctaggccttattcattcattctatgtttttttttttttttacacagtagccaccgcccccgcttcacacccctaccccctacccttcccagcctctggtaactatccttctactctctgtcttcatgacttcaattgttttgatttttaaatcccacaaataagtaagagcatgtgatgttcttggcaactttgtggaaaatgagttcactgtaggtgtgtggaattgtttctggattttttattctgttccattggtctatgcacctgttttttatgccagtaccatgctcttttagttactatacctctgtagtataatttaaagtcaggtaatgtgattcctccagttttgttctttttgcttaggaaggttttggctattctgagtcttttgttgttccatatacattttaggatttttttctatttctgtgaataatgtcattgatattttgatagagattgcattgaatctgtaaattgtttgagtagtatgcacattttaacaatattgattcttccaacccacaaacatggaatatctttccattttttggtgtccttttcaatttctcttatcagtgctttatatttttcattgtagagaactttcacttatttggttaattcctaggtatttaactttatttgtggctgttgtaattgggactactttttgatttctttttcagattgttcactgttggcatatagaaatgctattgttttttgtatgttgattttgtctcctgaaacatcaccgaatttgtttactatttctaacagttttctattggtttttccaaatataagatgatatcatatgcaaacaaggataatttgacttcttcctttccaatttggatgccctttctatctttctcttgtctgattgctctagctagggctgccagtactatgttgaataacagtgatgacagtgggcatccttgtagtgttccagatcttagaggaaaggctttctgtttctcccaattcagtgtgatactagctgtgtgtctgtcatagatggcttttattatgttgaggtatgttccttctttgagggtttttattatgaaggaatgttgaattttatcaaatgctttttcagcatagattgatatgatcatattgtttttatcctttattttgttgatatgatgtatcacattgattgatttgtgagtgttggaccatccttgcatcccagggataaatcccacttggtcatgataaatgatctttctaatgtattgttgaatttggtttgctagtattttgttgaggatttctgaatcaatatttatcagagatattggcctgtagttttctttttttgatgtgattttgtctggtttcagtatcagggtattactgacctcatagaataagtttggaagtattccttcctcctttattttttggcatagtctgagtaagattgataatagttgcttatagtagctactaatgatcctttggatttctgaagtatcagttgtaatgccgtctttttcagttctgattgtatttctttggctcttctctctttttaatttattttattttattttttgacagaatctcgctctgccacccaggctggagtgcagtgctgtgattggctcactgcagcctccgcctgccaggctcaagtgatcctctccctcagcctcctaagtaactgggactacaggtgcgtgccaccatgcccagatatatttttttttttgtacttttagtagagaagggttttcactctgtggcccaggctggtcttgaactcctggactcaagtgatctgcctgccttagcctcccaaagttctgggatttcaagcgtgagccaccatagcctggctctttttatctcagttagtctggctaatggtttgtctattttgcttaatttttcaaaaagtcaactgttttggaaactggaactttttaattctccctcacccacaaaaggattattcattgtaaattgaattaacatactcttccctagatggggtatctcagttaatgggaaagccaggtcatgactccaggtccaaatggccctgtctgatcctggtggttgggcagctttgcataaatttaggatgctataatttctgcaaagcgtcttatgattccaatattagactttcagaaaaaccttccacatcatccatgcactgtgtgtacatgtgtgctgaatatttttaaaatcttacaacttgcctaaatagagtttttccatctccatcttgggtgcttaatcacctcatcttcttttatctcttctttctctcctatgtttgttgaggaaacaagattaaatataacaatttttacattgcacacaaaataaaatggcttgtttagctgtgactttaaggccacgcatgagacagtctgtacaggacttacctccctcatcagaggaaccctttgagtctttaaaaaaggtgaggatgaaaaacaagaaaactcttttagattttcagctctccatttgctctgcagcatgagaactaagaagcaggtggcaaagatagacagtaaactagaaggaaacaaaacaaggtcattttcctccttgtaccttagcttcttgaatgataatttaagataccttcaattttctgttatctgaagtagtctgctttatggattacttagactcttgtttcttcatcctttaactgtttggtgtcacttcttccaaagctttttaaaatatattttctgattctactggaagagcagtcatagggtgtaggcatgtaggaggaaacaaaattatagggacagaaatcagtctattttctagtactttaattccttaagacctaagtcagtatccttatttttaaaaactactgtctagctccccatccttgcccatttctttttctatacatacatattctctctctctccatcctttccttctcagcaagtctggtagacagactagtctgatgcctcaaaaatactctaattcgtagaaagaaagtaaattctgcctctgacgttccattccccctgtggttttaattagggtaaattctcctatgctcactttgaaacatgccttgggatcttagggagatggcaggcagatggcgtattaatgcagggtgatgtttctcacttcatggtgcccatgcaacatttattgtcattaaaatagtgtcattcaaatgaggtggctgatgttggaaaatgaatgcaaagttgatcattgttctgtggatctgagctttgatgaagaaattgaattagaggcagcatttcaactctgtttaagtaataagtatatatgtatctataactcagtagtgaaacctttcagactgacaggagggcaaagcctctaagactatattagggtttacgggtataaaaatacgtgcctctcctgctttaccaggctgtggggagaatgaggaaaataatatctgtaaagtgacctgagcacccagaaagaaaaatttagatgttttattagacctacgcaagatctttggttagttccccagagccctgtaaagtcttggaagccctgtaacaaatttctcttttcccttgtcaggtttttgttttcccctggtgcccaggttaaagagaaattgatttctttccatcttgtgtttagcttttgtccctctgcattgaggctttgaattgagaatatttctttgggtctgtagggctgtccaatgatagttaggcttaaacattaaacaaccttacagaactaattaggctttattgcctgtggccaagtcaacgaattttgcttcatagaatttctgagagaaaaaaaaatacatatttaggacttggtaaaacttttcttaaaatgtctccttgtaaatgccagcgttgctgaccctgtgcaaatattttgtaatagcccggcttgagaacatcccccacatttctctgttgtattctttatgacttccctccaggttgagctgtgaaagggtgaggggaaaggagccatgtcggagaagtagaagagactgaatcaaatgtttagagaacatagcttgattaattcaaaactgaagccctggcctctctagtctcatgttccacagcaataatttctccttggccagaagcctaagcatctgtgtccaaatctcatactctttcctaaatggattcatcaagtcagaccttgagttgcttggttttttctgaaccaccccctaatttaagttaaacttaaaaatgggagccattaaatagcaaaacaaacaaatacaacaataataacaggacattatgtcctggccctcagaggtcaatttaatgtgattagcagcataaaacttcacaacgcctttcactggaagattaccagaagcaacatcattcagtatgttgccatgcactgccattctttcactttggcattatttattgattgtagcagaaacacaatatttgtacctcttaagcattttagtttcctttaggcttttctctagtaaatgtggaactgcatcattttgttaaactgttctgaagtctaaaaaaaaaaaaaaaccctcctgaatattgtttacatccctggttacaaaggccagtactgaggcggagctgctctgcctgctttgattcttatcaagggcaacactgtatgtgtgcatatgtatgtgtgtgtgttcacacaggagagggtagtaagtggagcaagagttttaaggaaggagcggggctggaaggaaaaaaactttcaatgaattgaaactgcataatgaaaagattctgaaatttaattacaaaaatggctctgttttttctctcacctcctcctcgctcccttttctcctctccatcctctccaaaagcactgaagtaaaatgagactgtcagatcaaagccacacacccactctaggtctgttttgagaaagggatttttttctccccttatttactttgtagcagtggcagcatgtctactgcaggatgcagtgacagtgtggagccttgtcactgttctgcttgatctcctcccgtgtgccactccctggtctggtgagcagggtcaaagtttcaaatgatgactgtggccacagttctcaccatctcttgtgttttcacacttggccattcagtatttaggcattgtccctctgacatatggcctgaaagagttgaagattaagtttccaagtttggaaatgcccaagcgtagccatggagggtgtatttgtcccatgtggctgcgggttctgttgagtatttttgcaaaaatattaaaatgtctacttaggatttaagaatatgtttgatgatatgtacataattcatagcgcattttagggcacacctgcattatttaatattggagtttctctttttaagtttttttatttttgtctaggactctttagagtgcctgtgcctgggttccttaatattctttcagaccagttgtcaatttccaagtgccttaaaatagagctattgggttttcttggccttttctggccctcattctcttctagttcatgatttttcctcaaaataaagttgtacctaattaataaaggtatataggtattcagttttaatactgtctataaagtatgactcatactttctctattaggaacatctttgttacattgaatgcatatctctcctgtagttggttgagagaaacatgtaggtctaggatcaaagtcctagaacaggatcagagtcactggaaatgcaaccaaaatggggatagaggctcatgggacaagaactggaatgtgtgttgtattgagctacagggagaaggaagaaactaagtaccgatttggtagagagaaagaggggcagagagagagagagagagagggagagagagaaagagaatgagagagaatgagagagagagagagagagagagagagacagattaggttaggattaggttaggaagaaccttgaaacatcagacaaaaagaagaaaactaaagcagactgaagagcagtgtgtctttgattatggctattcaccaaaccattcttattgctctttctgttattattaagctatctctgagatgtacacagtgtatatctcagtgcacaacagacctaccagtgtagatcttttaactcattcctttaatgaatttttatcactttcacagtccttattagctctctttttaatggtttttttggagcccataactagatatgccacctcaggaagaattttatcagtgctctgggaagatggatttactattttgagttgtatttgtacaccatgcaaccatgaaccacttagaaaccaccttagtgactcatactttctttatggtccattctgattctgaaatcctttgagtgttacatttctcaatctgattttaacaaggattaaaataaataagtaaataaataaaaagttttctaaggtttgcgaaacactattactgaaatttagaggacttgaggcctttaaatcaaacaatattttcattataatttgcctttccatccccatttggtcttgccacatctatgctgcgacaaaagaaaacctttagtacctaatatcggtacttggtgttcattcatctcactgtggttttcactttcaaagcacaatacattgcttccccatcccattccttttgtttctaccattctactttggccttggaaattaaatattgcatcctgtccctcacagcttatttctgcctctcaattttgcagatctgggcattaacggaaataataagcactttataattttatagtgctttataattttcaaggtattttcacatccattgtcttgagtgatcctctccacacctcactatataagcagggcatggattattaccccattctagctcaaggccatatagctaactaagggaagaaccaataaagtttctagatgaatttgtttcactacacttcttccaccatcagttccatggccaaatttttttcctgctactttttgaaaactgagtatatataggaattttctttttggtatataaattttgggaacaatgaactattcgtctaggtgagtaaaagtgtatgtctgcatccatttgtttatgtgaataatatgtgttcgctaaaacttgaaaatgtttgacatcattctttttgtttgtttgttttctttagtttttttattgtactttagattctgggatacatgtgcagagggtgcaggtttgttacataggtatacacgtgccatgatggtttgctgcacccatcaactcgtcatctacattaggtatttctcctaatgctatccctcccctagcccctcacccctcaacatgccccggtgtgtgatgttcccctccctgtgtccatgttttctcattgttcaactcccacttatgagtgagaacatgcagtgtttggttttctgttcctgtgttagttttctgagaatgatgttttccagcttcatccatgtccctgcaagggacatgaactcatccttttttatagctgcatagcattccatggtgtatatgtgccacattttctttttttttttgtttgtttgtttattattattattatactttaagttttagggtacatgtgcacaacgtgaaggtttgttacatatgtatacatgtgccatgtttgtgtgctgcacccattaaatcctcatttagcattaggtatatctcctactgctatccttcccccctgcccccaccccacaacagtcccaggtgtgtgatgttccccttcctgtgtccatgtgttctcattcttcagttcccacctatgagtgagaacatgccgtgtttggttttttgtccttgtgatagtttgctgagaatgatggtttcatccatgtccctacaaaggacatgaactcatccttttttatagctgcatagtattccatggtgtatatgtgccacattttcttaatccagtctaccattgttggacatttgggttggttccaagtctttgctattgtgaatagtgccgcaataaacatatgtgtgcatgtgtctttatagcagcatgatttataatcctttgggtatatacccagtaatgggatggctgggtcaatggtgtttctagttctagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttcttcatgtgttttttggctgaataaatgtcttcttttgagaagtgtctgttaatatccttcgcccactttttgatggggttgtttgtttttttcttgtaaatttgagttcattgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgctgccattgcttttggtgttttcgacatgaagtccttgcccatgcctatgtcctgaatggtaatgcctaggttttcttctagggtttttatggttttaggtctaacctgtaagtctttaatccatcttgaattaatttttgtataaggtgtaaggaagggatccagtttcagctttctacatctggctagccagtttttccagcaccatttattaaatagggaatcctttccccattgcttgtttttgtcagctttgtcaaagatcagatagttgtacatacgcggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattgtcatgatattgattcttcctacccatgagcatggaatgttcttccatttgtttgtatcctcttttatttccttgagcagtggtttgtagttctccttgaagaggtccttcacatcccttgtaagttggattcctaggtatttcattttctttgaagcaattgtgaatgggatttcactcatgatttggctctctgtttgtctgtttttggtgtataagaatgcttgtgatttttgtacattgattttctatcctgagactttgctgaagtagcttatcagcttgaggagattttgggctgagacgatggggttttccagatatgcaatcatgtcatctgcaaacagggacaatttgacttcctcttttcctaattgaataccctttatttccttctcctgcctcattgccctagccagaacttccaacactatgttgaataggagtggtgagagagggcatccctgtcttgtgccagttttcaaagggaatgcttccagtttttgtccattcagtatgatattggctgtgggtttgtcatagatagctcttattatcttgagatacgtcccatcaatacctaatttattgagagtttttagcatgaaaggctgttgaattttgtcaaaggccttttctgcatctattgagataaccatgtggtttttgtcattggttctgtttatatgctggattatgtttattgatttgcatatgttgaaccagccttgcatcccagggatgaagcacacttgatcatggtgggtaagctttttgatgtgttgctggatttggttttccagtatttcattgaggatttttgcatcaatgttcatcaaggatattggtctaaaattctctttttttgttgtgtctctgcccggctttggtatcaggatgatgctggcctcataaaatgagttagggaggattccctctttttctattgattggaatagtttcagaatgaatggtaccagctcctccttgtacctctggtagaattcagctgtgaatccgtctggtccctggactttttttggttggtaagctattaattattgccacaatttcagatcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgggatcagtggtgatatcccctttgtcattttttattgcgtctatttgattcttctcccttttcttctttattattcttgctagcggtctatcaattttgttgatcttttcaaaaaaccagctccagggttcactgattttttgaagggttttttgtgtctctatttccttcagttctgctctgatcttagttatttcttgctttctgctagcttttgaatttttttgctgttgcttctctagttcttttaattgtgatgctagagtgtcaatttcagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggactgctttacttccaagaatgtggtcagttttggaataggtgtggtgtggtgctgaaaagaatgtatattctgttgatttggggtggggaattctgtagatgtctattaggcccgcttggtgcagagctgagttcaattcctggatatccttgttaactctctgtcacattgatttgtctaatgttgacagtggggtgttaaaatctcccattattattgtgtgggagtctaagtcactttgtaggccactaaggacttgctttatgaatctgggtgctcctgtattgtgcgcatatatatttaggatagttagttcttcttgttgaattgattcctttaccattatataatggcctgctttgtctcttttgatctttgttggtttaaagtttgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgttccttttaattggagcatttagcccatttacatttaaggttagtattgttatgtatgaatttgatcctgtcactatgatgttagctggttattttgctcattagttgatgcagtttcttcctagcctgggtggtctttacaatttggcatgtgtttgcagtggctggtactggttgttcctttccatgtttagtgcttccttcaggagctttttagggcaggcctggtggttacaaaatctctcagcatttgcttgtctgtaaagaattttatttctccttcacttatgaagcttagtttggctggatatgaaattctgggttgaaaattcttttctttaagaatgttgaatattggcccccactctcttctggcttgtagattttctgcagagagatccgctgttagtctgatgggcttccctttgtgggtaacccaacctttctctctggctgcccttaacattttttccttcatttcaactttggtgaatctgacaattatgtgtcttggagttgctcttcttgaggagtatctttgtggcgttctctgtatttcctgtatttgaatgttggcctgctttgctagattggggaagttctcctggagaatatcctgcagagtgttttccagcttggttccattctgcccgtcactttcagatacaccaattagacgtagatttggtcttttcacatagtcccatatttcttggaggctttgtttgtttctttttattcttttttctctaaacttctcttcacacttcatttcattcatttcgtcttccatcgctgataccctttctttcagttgattgcattggtcactgaggcttgtgcattcgtcacgtaattctcatgccatggttttcatctccatcaggtcctttaaggtcttctctccattggtttttctagttatccattcatctaattttttttcaaagtttttaacttctttgccattggttcgaacttccttctttagctcggagtagtttggtcttctgaagccttcctctctcaactcgtcaaagtcattctccatccagcttcttccgttgctggtgaggagctgctttcctttggaggaggagaggcactctgatttttagagtttccggtttttctgctctgtttttttccctatctttgtggttttatgtacctttgttctttgatgatggtgacgtacagatgggtttttggtgtgtatgtcctttctttttgttagttttccttctaacagtcaggaccctcacctgcaggtctgttggagtttgctggaggtctactccagaccctgtttgcctaggtatcagcagtggtggctgcagaacagcggatattggtgaaccgcaaatgctgctccctgatcattcctctggaagttttgtctcagaggagtacccagttgtgtgaggtgtcagtccacccctactagggggcgcctcccatttaggctactcaggggtcagggacccacttgaggaggcagtctgcccattctcagatctcaagctgcatgctgggagaaccactactctcttcaaagctgtcagacagggacatttaagtctgcagaggttattgctgtcttttgtttttctgtgccctgtctccagaggtggagcctacagaggcaggcaggcctctttgagctgtgatgggctccacccagttcgagcttcctggacacttcgtttacctactcaagcctgagcaatggtgggcgcccctcccccaacctcactgccaccttgcagtttgatctcagactgctgtgctagcaatgagtgaggctccgtgggcgtaggaccctccgagccagttgtgggatataatctcctggtgtgctgtttgataagcccgttggaaaagcacagtattagggtgggagtgacccgattttccaggtgccgtctgtcacccctttctttgactaggaaagggaattccctgaccctttgcacttcccgggtgaggcgaagccttgacctccttcgactcacgcacggtgcactgcacccactgtcctgcaccaactgtccagcactccccagtgagatgaacccgttacctcagttggaaatgcagaaatcacccatcttctgcgtcgctcacgctgggagctgtagaccggagctgttcctattcggccatcttggctccaccccaccacattttctttatccagtctatcattgatggatatttgggttggttccaagtctttgctattgtgaataggaattttcttagcaaatatgaaaatttgctgagagaggaagtgtgcaaaatggtttggcaggaaatcacacatggaagggcccaactgggtcactttgtgtttgaacactacatgggagactatgttgaaatcctagatttcaacaatcctagattagaccatcacggaaaagactcactactaggtggcagaggccctttcctgttgctcagagggacttctagtcgtgaaaacccataacctcctccttgactgtgtactagaagcactgctaagtgaaactggttaattctgcatctatttttgtaatgtggcaatttacatgctgattggagccaggctgtgggaatgtttttggtctaaggccatggttctcatggtggagaattttgccatttaggacatttggcaatgcctggagacatttttagtcacaagtgggttggggggtgctactggcttctaatgggtagaggacacagatgcttccaaacctcctaaaattcacagggcagctcttccctacaccacacatacaaaaagaagtacctgacccaagatgtcaacagtacctggattgagaaacactggtttaagtgaagaagcctgggtctcagagaattatttgtatttagtctctgcctttttcccctgtatttgctctgtgtgtgtgtgtgtgtgtgtgtgtgtgtgtgcatgtgtatgtgtgtgtgtgtgttggaatttatccatttaagtaaatgtaggaaagccctcagagtaccttaagagtatcactgtgctatgaagaaatgattgtgctttacagtgaacttgaggggagattcacttggggtaccaggctccccaaaggttgtaggtacagcacacatgcctgaaaacacagaaacatctgccaacactcacctgggtgtgtctttttgtctctatctttcttttctctagcaatttccaaactttataggcctcaattcttacttgaggagtgagcagcaggggttactgtcagttttagggcatacatctggcgagaagtgcctcaaagctgtctgcagaagtgcttttggggtttgaggatggcttgggttctttcttttaaataggtggagctgagatgaaggatgagggacagtgttcatgatcgttgtttaggctcttctccaactgtcatatttcttatgtgtcaaaggatactgtgacaaacccagtcactgatgttgggaatgtgagggatctaaggagagagcagtgtatatgggaagaagaagtacagccatttgatgtgcagaaggaatgtctgagcatctgggtatgtgtttgcagttttgtattttggctccaattcaagcccctttcattttgtatgataaataatttcttttctacacctaatttccattgactaatggtgattaatcttcaactttgacattagagataacaagtgatgctcattccattaggctttaccaaaatgctggtatttgagtagaaacaaagactgggataacaattgcttgcattcattgtggccctaaagtaattgtgaacccttgtaaagcctctacttatggtgcacagaattgtaacgtttgtaatgtaggggtggggctctgagaattaccaaatgttataaccaagggcaggtgttggtaaagtcctggaaaactggccccagtttcctccttccctcttctcttaggccatcatcatgaagtcacatgaaattcatgagtggcacaatgctgagctacgagttccattgctggtgaaagagggtggttcagtctgtctgtggaagttatgtttgatttccacctctcctttgctcatccctctgactttgtgtggagtttctccactggggtgtagagagtgtttattcacaataagtgtaacgtaaggtgatgtggaaatgagtagtcctctaattatagagtgacttacataaaaactatgccattggaaatagatgcatttaagttcctaaaggtcaggaggtatggttgagcctggcagccattagcaaatgtgatacagttcaatggtgagtacttacgagtttatacatgtatacataatattggggatatgtcattggtatgttaattagagaatgcgtttgagtatcaatgtatgatcatttccccattatcgatgacaatggaaaaaagcagtagtacaaataatcccaagcgttaggtgattttaaaatattttctatcaagtttgagtgttttattatgatttttttaactgaggttcacctatatatgtcaacagactatggaaagtcatagtgaggttaaaaagaaaatatgaagtaattatatcaaatagtccacaaaggaaaacattctgaaaagtgaatagttcaattaggtggcctataaatgttaagaccagtgttcggcaacagctcagtttcagacccccattccaaatgtcagtacattcttgaaatgggagtggtctttactatgtatgctttgtacacctttcctgaaatttgcttccaggtgttcttgtatattaaataccacagccttgatctttaaatgatgacaaattgtccaaatgtattaacttttcccctttatttttctctttgctttattctcagtaacctcttttctctaattcttacattaacatataaataaaataattccagatgaattcatcatagatgataattataacgtgttcaggtgtggatctctttgaatctatcctacttggaatttgttgagctccttggatgtgtagattaatgtttgtcatcaaattttgaaagtttggctattattcaatacagtcatgcatcacttaaaaataggaatactttctgagaaatgtgttcttcggaaatttaacccttgtaccaacatcatagagtgtacttacacaaacgtagatgatttagcctactacacacttaggctatgtggtatagcctatggctcctaggctacaaacctcacagcatgttactgtactggatactgtagaaaattgtaacacagtggtatttgtgtgtgcaaacatatataaaaagataaaaaataatgcgagggaggagccaagatggccgaataggaacagctgcggtctacagctcccagcatgagcgacgcagaagacgggtgatttctgcatttccatctgaggtaccgggttcatctcattgggagtgccagacagtgggcgcaggtcagtgggtgcgcgcaccatgcgcgagctgaagcagggcaaggcattgcttcacacgggaagcgcaaggggtcagggagttccctttcctagtcaaagaaaggggtgacagacggcacctggaaaatcgggtcactcccacccgaatactgcgcttttccaacaggcttaaaaaacggcgcatcaggagattctatcctgcacctggctcgcaggatcctacgcccacggagtcccgctgattgcgagcactgcagtctgagatcaatctgcaaggtggcagcgaggctgggggaggggcgcctgccattgcccaggcttgcttaggtaaacaaagcagccaggaagcttgaactgggtggagaccaccacagctcaaggaggcctgcctgcctctgtaggctccacctctgggggcagggcacacacaaacacaaagacagcagtaacctctgccgacttaaatgtccctgtctgacagctttgaagagagcagtggttctcccagcacgcagctggagatctgagaacgggcagactgcctcctcaagtgggtccctgacccctgacccctgagcagcctaactgggaagcacacccgagcaggggcagactcatacctcacacggccgggtactccaacagacctgcagctgagggtcccgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgactctcctcctccaaaggaacacagttcctcaccagcaatggaataaagctggatggagaatgactgacaagctgagagaagaaggcttcagacgatcaaattactccgagccaggggaggacattcaaaccaaaggcaaagaagttgaaaactttgaaaacaatttagaagaatgtataattagaataaccaatacagagaagtgcttaaaggagctgatggagctgaaaaccaaggctcgagaactacgtgaagaatgcagaagcctcaggagccgatgcgatcaactgcaagaaacggtatcagtgatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcaggccaacgttcagattcaggaaatacagagaacgccccagagatactcctcgagaagagcaactccaagacacataattgtcagattcaccaaagttgaaattaaggaaaaaatgctaagggcagccagagagaaaggtcggttactctcaaagggaagcccatcagactaacagcagatctctcagcagaaactctacaagccagaagagagtgggggccaatattcaacattcttaaagaaaagaattttcaacccagaatttcatatccagccaaactaagcttcataagtgaaggagaaataaaatactttacagataagcaaatgctgagagattttgtcaccaccaggcctgccctaaaagagctcctgaaggaagcgctaaacatggaaaggaacgacctgtaccagctgctgcaaaatcatgccaaaatgtaaagaccatcaagactaggaagaaactgcatcaactaacgagcaaaatacccagctaacatcgtaaagacaggatcaaattcacacataacaatattaactttaaatgtaaatggactaaatgctccaattaaaagacacagactggcaaattggataaagagtcaagacccatcagtgtgttgtattcgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcgaacctaatagacatctacagaactctccaccccaaatccacagaatatacatttttttcagcaccacactacacctattccaaaattgaccatatacttggaagcaaagcagtcctcagcaaatgtaaaagaacagaaattataacaaactgtctctcagaccacagtgcaatcaaactagaactcaggattaagaatctcactcaaaaccgctcaactacattgaaactgagcaacctgctcctgaatgactactgggtacataatgaaacgaaggcagaaataaagatgttctttgaaaccaacgagaacaaagacacaacataccagaatctctgggacacattcaaagcagtgtgtggagggaaatttatagcactaaatgcccacaagagaaagcaggaaagatccaaaattgacaccctaacatcacaaaggaactagaaaagcaagagcaaacacattcaaaagctagcagaaggcaagaaataatgaaaatcagagcagaactgaaggaaatagagacacaaaaaaaccttcaaaaaattaatgaatctaggagctggttttttgaaaggatcaacaaaattgatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatagataaatttctggacacatacactctcccaagactaaaccaggaagaagttgaatctctgaatagaccaataacacgctcggaaattgtagcaataatcaatagcttaccaaccaaaaagagtccaggaccagatggattcacagccgaactctaccagaggtacaaggaggaactggtaccattccttctgaaactattccaatcaatagaaaaagagggactcctccctaactcattttatgaggccagcgtcatcctgataccaaagcctggcagagacacaaccaaaaaagagaattttagaccaatatccttgatgaacattgatgcaaaaatcctcaataaaataccagcaaaccaaatccagcagcgcagcaaaaagcttatccatcatgatcaagtgtgcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatgtttcaaaataataagagctatctatgacaaactcacagccaatatcatactgaagggacaaaaactggaagcattccctttgaaaactggcacaagacagggatgccctctctcaccactcctattcaacatagtgttggaagttctggccagggcaatgaggcaggagaaggaaataaaatgtattcaattaggaaaagaggaagtcaaattgtccctgtttgcagatgacatggttgtatatctagaaaaccccatcgtctcagcccaaaatatccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaagctactttaaagttcatatggaaccaaaaaagagcccacatcaccaagtcaatcctaagctaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagaaatggggaaaggattccctatttaataaatggtgctgggaaaactggctagccagatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattcaaccaaagagcttctgcacagcaaaagaaactaccatcagagtgaacaggcagcctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacatttctgaaaaaaagacatttatgcagccaaaaaacacatgaaaaaatgctcatcatcactggccatcagagaaatgcaaatcaaaaccacaatgagatcaccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgtttcctcagggatctagaactagaaataccatttgacccagccatcccattactgggtatatacccaaaggactttaaatcatgctgctataaagacacttgcacacgtatgtttattgtggcattattcacaatagcaaagacttggaaccaacccaaacatccaacaatgatagactggattaagaaaatgtggcacatatacaccatggaatactatgcagccataaaaaatgatgagttcatgtcctttgtagggacatggacgaatgtggaaatcatcattctcagtaaactatcacaagaacaaaaaaccaaacaccgcatattctcactcataggtgggaattgaacaatgagaacacatggacactggaaggggaacatcacactctggggactgttgtggggttgggggatgggggagggatagcattgggagatatacctaatgctagatgacgagttagtgggtgcagcgcaccagcatggcacatgtatacataagtaatgaacctgcacattttgcacatgtatcctaaaacttaaagtataataataataaattaattaattaaaaaaaaaccaaaacaattttaaaaaaaataaaaactaaaaaaataaaaaataaaaaaataaggcattgcactacagcattatggcagctagtgtgtcagtaggtgacaggtatttttctactccattataatatttttaaaaaattgtttatttttaaatttttgttgacacatagtaggtatgtatatgtttatgggttacatgagatattttgatacaggaatgcagtgggtaataaccacatcagggtatatgggctagccatcacctcaagcatttatcctttgtgttataatttaattatactgttttagttatttttaaaatgtataattatgtacatttaaatatagtaaatattgtgactgtagtaaaacataatttactacagtcacaatatttactatatttactaagtgactatagtaaattactttttactatagtcagtctgatgtgctagcaaatactaggtcttattcattatttctgattttttgtaaccactaactgtcatttccccccaccaccccccacccacacactacccttaacatcctctgataaccatccttctgctgtctatccctatgtgttaaattattttgatttttagcttccacaaataagtgacagcatgtgaagtttgtctttctgtgcctggtttatttcacttaatagaatgacctccagttccatccatgctgttgcaaatgacaggatctcattctttttatggcccagtagcactccattatgtagatgtaacacatttttgttgcgggaagtcagggaccctgaacggggggaccggctgaagctgtagcagaagaacataaattttgaagatttcatggacatttagcagtttccaaagttaatacttttatcatttcttaggcctgtctttactgcagtctctgaacgtgaattgtgaagatttcatggacatttatcacttccccaattaatactcttataatttcttatgcctgtctttaatctcttaatcacattatctttgtaagctgaggatgtatgtcacctcaggaccctgtaatgattgcgttaactgtacaaattgtttgtaaaatgtgtgtttcaacaatatgaaatctgattgtgaaacaagggtgtttgaacaatatgaaaccagtgcaccctgaaaaaacagaataatagcaattttcagggaaaaagggaagataaccataagggctgactgcctgtggggtcgagcagaatagagacatatttttcttctcacagaaagcctatagatggatgtgcgagtaggagaaatattgctgaattattttcccagcatggagtaaccctcaggaaggaatgcattcctgggggtaggtctatagatggctgctctgggagtgtctgtcttatgcggttgagataggactgaaatacgccctggtctcctgcagtgccctcaggcttactaggattgggaaattccagcctggtaaattctagtcagaccagttgtctgctctcgaaccctgtttcctgttaagatgtttatcaagacaatgtgtgcacagtgggacacagaccttcatcagtaattctaatttttgcctctgccttttgatcttttattgccctttgaagcatctgatctctgtgacctactccctgttcgtacaccccctcccctttcaaaatccctaataaaaacttgctgattttgcagcttgaggtcaccatcatggtcctaccaatatgtgatgacacccccggaggcccagctataaaatttctctctttgtactctttttgtttatttctcagaccggccgacacttagggaaaatagaaaagaacctacattgaaatattgggggctggttcccccgatacattttctgtatctattcatctattgatggacaggtaggttgcatccaaatcctggctattgtgaatactgctgcaataaacacaggagtaccaatatctcttcgatgtaccattttcctttcttttgggtatacacccagcagtgggattgctagattttgtggtagctctatctttagttttttgaggaccctacaaactgttctgcatagcgattgtactaatatataatacattcccaccaacagtgtaagaggattcccttttctccatattctcaccagcatttgttattgcctgtcttttagataaaagccactttaactggtgtgagatgatatcttattgtagtttgatttgcatttctctgatgattgatgatgttgagccattgtacctgtttgccatttgtatgtcttgttttgagaaatgtctgttcagatctatggcccattttttattcagattattagatttcttcctgtaaagtcgattgagctccttatatattctggttattaatcccttgtcagatgggtattttgcaaatattttctcctgttctgtgggttaccctttcactttgttgattgtttcctttgctgtgcagaagcttttcagcttgatgtgaccccatttgtccatttttgctttggttgtcagtgcttgtggggtattactctagaaatccttgcacagactgatgtcctggagagtttcctcaaggtttttagtggattcatagcttgaggtcttagatttcagtctttaatctattttgatttgatttttgtatatgatgagagatggggggtcaagtttcctttttctgtatatggatatccagtttccccgcaccgtttattgaggatactctcctttctccaatgtatattcttggcacctttgtcaaaaatgagttcactgtggatgtatggattttcttgaggttctctattctgttccactgatatatgtatctgttttttatgacaatacagtgctcttttggttactatagctctgtagtataatttgagaaattaatataatgtgattccttcagatttgttctttttgctcaggatagctttggctattctgggtctgttttggttccagataaactttaggatttttttttctatttctgtgaataatgtcattggtattttgatagggattgcattggatctgtagatttatttgggtagtatagacattttaacattattgattcttgcaatccattaacatggatatatctttccattttttggtgtcctattcaattttttgcatcaacgttgtatagttttcattgcacagatatttcacttctttggttaagctaattcctaggtatttaattttatttatagctattgtaaatggaattattttctttatttcattttcagattgctgttggcatataaaaatatgactgatttctgcatgttgatagcatattctgcaactttactgaatttgtttttcagctctaattgttttttgtggagtcattagtttttccaaatataagatcatatcatctggaaataaggatattttgacttcttcatttccaatttggatgccctttagttctttcttttgtctgattgctctagctaggacttccagtaatatgttgaatatcagtggtgatagtgggcatctttgtcatgttccagatcttagaggaaatgctttccatttttcctcattcagtatgatactaacttttggtctgtcatagatggcttttattattttgacatatgttccttctatccccagttttttgagggtttttatcatgaaggtatgttgaattttgttaaatgctttttcagcatccatggaaatgatcacatgatttttgtcctgtattctattgctacaatgtatgatattgattgatttgcatatgttgaaccaccctttcattcctgggataaatctcagttataataaatgatctttttaatgttttgttgaactttgctagtatattgttgaggatttttgcatcaatattcatcagtcatattgttttatagttttcttttttgatgtgtcattgtctagttttggtatcagggtaatactggccttgtacaatgagattggaagtattttcttctcctctatttattggaatagttggagtagtattggtattagttcttctttaaatgtttggtagaactcagcagtgaagccatcagggtcattggctttgctttgctgggagactttttattatggcttcgaactcattacttttttttctaattttaatttaattttattttattttaagctctgggatacatgtgaaggatgggaggtttgttacataggtaaacatgtgccctggtggtttgctgcacctatcaacccatcacctaggtattaagccccacatgtattagctatttatcctgatgctcttcttcccccccaccccccaacaggccccagtgcatgttgttcccctccctgtgtccatgtggtctcattgtccagctccaacttataagtgagaacatgtgatgcttggttttctgttcctgtgttagtttgctgaagataatggcttccagctctatccatgtccctgcaaataacataatcttgttcctttttatgcctgcatagtattcaatggtgtatatataccacattttctttatccagtctatcactgatgggcatttgggttgattccatgtctttgctattgtgaatagtgctgcaattaacacatgcctgcatgtatgtttataatagaatgatttatattcctttgggtatatacccagtaacaggattgctgggtcaaatggtatttctggtttctaggtctttgaggaattgccatactatcttccacaatggttgaactaatttacattcccaccaacagtgtgaaagtgttcctatttctgcacagcctcaccagtatctgttgtttcttgactttttaatagtcaccattctgactggcataagatggtatcttattgtggttttgatttgcatttctctaatgatcagtgctattgagctttttttcatgtctcttggccatgtgagtgtcttcttttaagaagtgtccatgttctttgcccactttttaacgggattttctgtttcttataaatttgtttaagttccttgtagactctggatattagacctttgtcagatggagagattgcaaaaaatttctcccattctgtaggttgtctcttcactctgatgatagtttattttgctgtgcagaagctctttagtttaattagatcacacttgtcaatttttacttttgttgccattgcttttgatgtctttgtcattaaatctttgcctgtgtccaagtcctgaatggtattgcttaggttgtcttccaggttttatatagttttgggttttacatttaagtctttagtccatcttcagcatattttgtatatggtgtaaggaaggggtccagtttctatcttctgcacatggctagccagttatctcagcaccatttattgaataaggattcctttcttcattgcttgtttttgtcaagtttgttgaagatcagatggttgtagatgtgtggtcttatttctgagatctctattctgttccattggtctatgtgtctgtttttgtaccagtaccatgctgctttggttactgtagccttgtagtatagtttgaagttgggtggcatgatgtgatgcctccagctttgctctttttgcttaggattgtcatggctatacgggctcttttttggttccatacgaattttaaagtagttttttctacttttgtgaagaatgtcaatggtagtgtaatggtaatagcgtggaatctataaattactttgggcagtgtggccattttcatgatattgattctttctatccatgagcatggaatgttttttcatgtttgtgtcctttctgatttttttgagcagtggtttgtatttctccttgaagaggtccttcacttcccatgttagctgtattcctaggtattctattctctgtagtaattgtaaatgggagttcatttatgatttgtttctccccttgtctattgtttgtgtataggaatgcttgtcattcttgcacattggttttgtattctgagtgtattagtcctttctcatgctgctataaggacatacccgagactgggtagtttataaagcaaggaggtttagtggactcaatagtttcacatggctaaggaggcctcacaatcatggcggaaggtgaagggggagcaaaggcacatctgacatggcagcatgccagagcacatgttcaggggaactgccctatataaaaccaacaggctttttgagacttattcactatcatgagaacagcatggtaaaaacccactcccatgattcaattatgtcccaccaggtccctcccaccacatatggtgattatgggagctacaattcaagatgagatttgcgtggggacacaaccaaaccatatcattccacccttggccccttccaaatctcatgttctcacattttgaaaccaataatgccttcctaacagtcccccaaagtcttaactcattccaacattaacttaaaattcacagtccaaagtctcatctgagacaagacaagtcccttccacctatgagcctgtaaaatcagaagcaagttagttacttcctagatacaatgggtgtgcaggcattgggcaaatacaccccttccaaatgggagaaattggccaaaacaaaggggctgcaggctctatggaagtccaaaatccaatcaggctgtcattaaaccttaaagttccaatgtgatctcctttgaccccatgtctcacatccaggtcacactgatgcaagcagtgggatcccacggccttgggcagctccatccctgtggcttggaagcatatagccccctcccagctgctttcaccgattagctttgagtttctgtggcatttccgggaacatggtgcaagctgtcggcagatctaccattctgggttctggagtacagtggccctcttctcacagctccactaggcagtgccccagtggagattctgtgtggggacttccaccccatatttgccttccacagttctctagcagaggttctccatgagggccccaccccggcagcaaacttctgcctggacatccaggcatttccataccaccactgaaatctaggcagaggttcccaaacctcaatccttgaacttctgtgtacccacaagctcaacaacacatggaagctgccaaggttttgggcttgaaccctctgaagccatggcccaagctgtactttagccatggctagagaggctgggatgcaggtctccaagtccctaggctgcacataacagaggggccctggacctgacctaagaaaccatttttcccttctaggcctccaggcctttgatgggaggctctgccatgaaggtctctgacatggcctggagatgttttccccattgtcttggtgattaacattcagctccttgttatttatgcaaatttctgcaggaggcttgagtttctccccagaaaatgggtttttcttggcaggctgcaagtttttcaaacttttatgctcttcttccttttgaatgctttgcagattagaaatttcttctgccagataccctaagttatctctctcaagttcaaagttccacagatctctagggcaggagccaaatgccacccatctctttgctaaatcataacaacagtcactttccctccagttcccaacaaattcctcatctccatctaagaccacctcagtctggatcttattgtccatatcactatcagcattttggtcaaagccattgaacaagtctctaggaagttccaaactttcccacatcttactaccttcttatgagcactccaaactgttccaacctctacttactaagcagtacaaaagttgcttccacattttcaggtatcttaatagcagtactccactctactggtaccatttgactgtattagtccattttcctactgctatgaagaaatacctgatggccgggtatggttgctcatgcctgtaatcctggcactgtaggaggccaaggtgggcagatcacctgaggtcaggagttcaagaccagtctggccaacatggtgaaacccagtctctactaaaaatataaaaattagctggaggtggtggtgggtgcctatagtcccagctactcaggaggctgaggcatgagaattgcttgaacccaggaggctgaggttgcattgagccaagatcataccactgcactccagcctgggcaacaagagcgaaactccatctcagaaaaaaaaaaaagaaatacctgagactgggtaatttataaaggaaaaaggtttaatggactcacagttccccatggctgggaaggcctcacaatcatagtggaaggcaaaggaggagtaaaggcacgtcttacatggcagcaggcaagagcacatgtgtagtggacctgccctttataaaaccatcagatcccttgagacttatccactattataacaacagcatgggaaaaacctgcccccatgattcaattacttccaactgggtccctcccacatggggattatgagagctacattcaagatgtggtttgggtggggacacagccaaaccatatcactaagactttgctgaagttgcttattagcttaagaagctttggggctgagacgatggggttttctagatatagaatcatgtcatttgcaaacagacagtttggcttcctctcttcctatttgaataccctgtatttctttctcttgaccgattgccctggccagaacttccaatacgatattgagtaggagtgatgagagaggacatcctcgtcttgtgccagttttcaaatggaatgcttccagctttcatgaattgctcttattatattgatgtatatcctttcaatacctagtttattgagagtttttaacatgaagggatgtttaattttattgaaggccttttctgcatctattgagataatcaatgtggtttttgtctttagttctgtctatgtgatcagttatgtttattgatttgcttatgttgaaccagccttgcatccaaggaatgaagctgacttgattgtggtgaataagctttttgatgtgctgttggatttggtttgccagtattttactgaggatttttgcattgctgttcatgagagatattggcctgaagttttctttttttattgtatctctgccaggttttggtatcaagatgatgctggcctcataaaatgagttatggagaagtccctccttttcaattgtttagaatagtttcagaagaaatggtaccagctccactttgtacctttggtagaattcagctctaaatccatcttgtcctgggcttttatttattactacctcaatttcagaacttgttattggtctattcagggattcaactccttcctggttcagtcttgggagggtgtatgtgtccaggattttatccattttgtctagattttttagtttatttgcatagaggtgtttatattaaatagtattctctgatggttttttgtatttctgtggagtcagtggtgatatctttatcatttttgttgtgtttatttgattcttctctctcattagtctagctagaggtctatctattttattatttttttgaagaaaccagcctctggattcattgattgtttgaacagttttttgtgtctctatctccttcagttcactctgatcttggttattttttgtcttctgctagctttgaagtttgtttgctcttggttctctagttcttttagttgtgatgctatggtgctgattggagacttttttttttttttgagatgtagtcctgctctgtcacccaggctggagtccagtggcatggactcagctcactgcaacctctgcctcctgggttcaagtgattctcatgcctcagcctcccgaataggggggactacaagcacatgccaccacacccggctaagttttgtatttttttgtagggaccgagtttcaccatgttagccaggctggtctcaaacccctgacctcaagtgatccatccacttcagcctcccaaattgctgggattacaggcatgagccactgtgcctggctttctagctttttcatatgggcatatagtgctataaatttcccttttaacactgctttagctgcgttccagagattctgatatgttatctgtttgttctcgttggtttcaaagaactttttgatttctgccttaatttctttatttacccagtagtcattcaggagcaggttgttcaatttccatgtagttgtgtgactttgagtgagtttcttaatcttgagttctaatttgattgtgctgtggtctgagcgactgtttgttatgatatcagtccttttgcatttgctgaggaattttttactttcatttatgtgatcaattttagagtaaacgccatgtggcacagggaagaatgtatattctgttgtgttttggtggagagttctgtagatatgtatcaggtccacttggtgagctgagttcaagtcctgaaaatttttgttaattttctgtctcgatggtctgtataatattgacaatggggtgttaaagtctcccactattattgtgtgggagtgtaagtctctttgtaggtctctaagaacttgttttacgaatctgggtgcttctgtattgggtgtatatatatttacaatagttaactcttcttgttgaattgatccctttaccattatgtaatgtccctctttgtctttttttatctttgtcgttttaaagtctgttttgtcagaaactaggattgtcactcctgtcttttctgctttccattggctgggtaaattttcctccatccctttattttgagcctatgtgtgtctttgcacgtgagatgggtctcttgaatacagcaaagcaatgggtcttgactacccagcttaccattctgtgtcttttaatttgggcattagtccatttacatttaaggttaatattgttatgtgtgaatttggtcctttcatcatgatgctagctggttattttgcagacttgttgatgtagttgcttcatagtgtcattggtctttgtaattcagtgtgtttttgcagtggctggtattgatttttccttttcatatttagtgcttcattcaggagttcttgcaaggcaggtctggtggtgatgaattccctaagcattttcttgtctgaaaaggactttatttcttcttcacttatgaagcttagtttgatcagatatgaaattctgggttggaaattcttttctttaagaatgttgaatattagctcccaatctcttctggcttgtagggtttctgctgagagatccactcttagtctgatggacttctctttgtaggtgacatggcctttctctctgactgcccttaacatttgttttcattttgaacttggacaatctgatgattatgtgtcttggggttgatcttctcatggagtatcttattgggtttctctgggtttcctgagtttgaatgtttgcctgtcttgttaggttgtggaagttctcctggatgatattctgtagtatgttttccaacttatttccgttctgtctctgtctctttcaggtaccccaattagtcgtaagttcagtctttttacataatcccatagttctcagaggttttgttcattccttgttattctgtttcttctaatcttgcctgcctgtcttatttcagcaagatagtcttcaagctctgaaattctttcttctacttggtctattcagttactgatacttgtggttgcattatgaagttcttatgttgtgttttcagctctatcaagttatttgtgttcctctttaaactggttattctggttaacagctcttataatgttttatcatcgttcttagcatctttgctttgggttaggacatccttttttagctccgattttgtttatttgtgcgttctctctttttctgagttattctaactaaaggtttgtcagtttcatttatcttttcaaatagccaggttttggttttgttgatcttttgttattgttttctttatttcagtttcatttgtttctgctctgatctttcttatttcttttcttctactaattttgggtttggtttgctcttctctagttcattaagatgcatcattaggttgtttatttgaagttgttcttcttttttgatgtacacacttatagctataaacttccctcttagcactgctttggctatatctcattggtttttatatgttgtatttccataatcatttgttttcactctatatttgaattttttcttaatttattcattgaccattggtcattcaggagcatgttgtttaatttccatgtgtttgtatagtttccaaaattattcttatttatttctagttttattccattgtggtggagaagatgcttgatataatttcaatttttgaatgttttaagacttgttttgtgacctaacatatggtctctttgagaatgatattcatgtgctgaagaaaagaatatatattctgcagccattggatgaaatgttctgtaaatatctgttagagccatttggtctattgtgcagaataaatcagatgtttctttgttcgttttttgtttgggagatatgtccaatgctgaaagtgatttgttgaagtctctagattttattgtattggagtctatttctttccttagctgtaataatatttgctttatatatctgggtgctccagtattgagtgcatatatatttaaaattggtatatcctcttgttgaattaaccctttatcattttatactgactttcttataggtgaagtatgtttcttgtaggtcatagatcattgggcctttttaaaaatttattcaaccactccttatcttctgactggagagattagtccatttacagtcaatgttattatcaataagtaggaacttactctaccattttgttacttctctgctggttgttttgtggccttctctttcttccttctttccttcctgtcttgcttttggtgaaggtaattttcttaggtggtgttatttaattcctttctttttattttttgtgtatcaattatatgttacttgatttgaggttaccacgaggctttttaagctgacaacaacatagcattgtttccataaacaaacaagcaagcaaaatgtaaactaataaacactctaccccttaacttcatcctcccgctttttaactttttgttgtttctatttatatcttattgtattgtgtcttgaaaagttgttgtagttattatctttgattggctcattgtttagcctttctacttaagagtagtttacacaccacagttatggtgttataatattctagtttttcagtatacttactattaccagtgagttttgtaccttcaagtgattatttattgctcattaatgtccttttctttctgattgaagtactccatttagcatttcttgtatacaggtctggtattgatgaaatctcttagcttttgtttgtgtgggaaagtctttatttctccttcatgtttgaaggcaattttcacgggatatactattttagggtaaaagttattttctgtcatcactttaaatatttcatgccactctctcctggcctgtaaggtttctaccgaaaagtctgctgcaagatgtaatggagctttattgtgtgttgtttcttttctcttgctgcttttcggatccttctttatccctgacctttggaagtttgatgactaaatgctttgaggtattcttttggtaaaatctgttgggtgttctataaccttctcgtacttggatggtgatatctttctctgtttggggcagttctctgttattatctctgaataaactttctacctcacctctttctctaccttctctttaaggtcaattactcttagatttccccttttgagactattttctagattttataggcatgcatcattcttttctatttttttcttttgtctactcttactgtgtattttcaaataacctgtcttcattcttactaattctttcttctgcttgatcaattctgctattaaaagactgatgcattcttcagtgtgtccattgcatttttcaactccagaatttctgcttgatttttaattatttcaatctctttgttaatcttatctgatagagtgctgaatttcttctttgtgttatctttgaatttcctcaaaacagctattttgaactctctgtctgaatgttcacatatctgtttctccaggattggcccctggtgcctaatttagtttgcttggtaatttcatgtttctcctggatggattttaagcttgtggacattcatccgtgtctactaattgaagaattaagtgtgtattgtaatcttcgtagtctgcgtttatttgtacccatccttcttgggaaagctttccaggtatttaaaaggacttgcatgttgtgatccatgctgtatctgcatcagggggctccccaaacccagtaatgctgtgactcttgtagtcttatagaggtaccaccttgctggtcttggataagaatccacagaaattatctgcattaccagacagagagactcttgttttcttcccttactttcttccaaacaaatggagtctctctctttctgtgctgagctgcctggagcttgggatgaggtgacacaagtacctctgtggccaccaccactgggactccactgggtcagacctgaagccagcacagcactgggtctcacccaaggtcccctgtaatactgcctggctactgcctgtgttttcttaaggtcgcagagctctacagtcaacaggtggcaaatcgagtgacaattttgttcttcccttcagggcagcaagtttctctaggtcccaggcagctcttgagatgccatccaggccaggaactagagtcaaaaatcctagaaatctacctggtgttctattatattgcagctgagctggcactcaaatcaggcgacacagttcttcttcccactcttccactctattcttttcacaggcagaagagactcactccatggcttccaccagcacaggcccacagggagttctgccaggctactgccaatgttcacttgaagcccaagggctcttcaatcagcttgtggcaaatgctgccaggcctgggactcattcttcatggaagtcagcctccctttggcccagggcaggtccagaaatgccatccaagagccagggcttagaatcggagaccccaagagcccagttggttctctacacccctgtggctgagttggtacctaaagtgcaaaattccctttacttttccctctgtttttctcaagcaggagtctctcactatagccactacaattgagaatgtgctgggtctcacccaaagccagcacatctcagagtcttacccaaggcccacagtgtactacctgagtatcactactggttattcagggcccaagtgctctttagtcagcagatgatgggtccttccaggaccaggtccttcccttgaaggcaacgggtacccttctgtttcagaatgtgtctagaaatgttgttcaggagctagggcctggaactggggtgctaagactctgaccagtgccctattctgctttggctgagcagggagccaagatgcaagaccaagtcttctttactcttccctctcctctcctgaagaggaaggaaggggtctcttttggagccatgagctgtgcagcctgggatttgggtagtggtggtgcaagcactcccttcactgccctggcttgtgtatgttacatgccctccaagcccactagctctaagcccagctcagcatacatactcacctaggagttgcagttcttgtgtcctagaccgcctttcaaatttacttagagcccagagcactttagcagatgatggcaaagcttgccagaactcacattccaactgctgggaaatgggattcccttctagttagggctgctctacatgcgttctccatgggtaagtgtcagctgcattcagtgcagttttgctttccactgggacaaggcagcactgagtttaatgcagtctcacaattgcttcattctccttctcctaagcacagagattctctctccatgccacacagccactgctgggggaatgggggaggggtcatgtcagtggttcaagactgtctttcctaccctgtttagtgcctctttcagaaatattaagttaaaacaggtactgtgggggctcacctgattttcagctcttatgaaggtgcttttttgtgtgtagatagttgtcagttttggtgttcctgtgggataggagagatgatcagtagagccttctattcagccatcttgctctgccctctcccctccattataatcttatgtggccactgttgtatatgtggtctattgttcactgaaacattacgcagtgcattactgtattcttttcgtcctttttctctctcctccgcttctgggcatatcatcatgtgtatgttggggcactagatggttcccacagttctcttaggctctctttgtttttcttcattgtctgtgttccttagactggttaatctcaatcaatatatcttcaagttcactgatgctttcttctacctgctgaaatgtgcagtcatcttgctcttctagtgaatttttcatatgatttatacttttgagtctagaatgtctactttgtctttacaacttatgtgtctttattcatagtctgtatttggtgagacattgttttcctactttagttctttagacatggtttctttcagtttatgaacatatttataataactggtttaaagtgtttgtctagtaagttcaatatttgggcttcctcaggaacagtttctattgattgctttttttctgtgtttgggccatactttcttgttttttgcatgtttcataatggtgttttgttgaaaactagatattttgaataatacaatgtagcatatctgcaaatcagattcttttcctatctccccaggtctttttgttgctcctgtagtttgtttagtgactttcctgaactaattctgtaaagtctgtattcttttgtcatatgtgtccactgaaatctttgcttggttaggttagtggtcagctaatgaatgaacagagatttctttaagcacctggaaccaataaatctcccagtctttgtgaagggactctgtgtgcatgttggaagtatgccttcaatgctcaggcaggtagttgacagctttgccttagccttcacttcccacttgcttagaacctcagggtcagtcacaggtgggagcttaggcctttttcaggtatttcctgtgcatgcacccagcctcgagcaacaacacagccctacacatgcatgtggccatggagaattccaggaatatgtgagtttttcaaatcgccccatagaaatttcattcctcagctttaagctatttggttaacctattgttggccccatctattatgcattgcctcagacagccatgataatacacaattgccactgattgttttcagcaaatgccactggagggatagggatccagtttccttcttctacatatgaatatccatttttcccagcaacatgtattgaagagagtatttttccccaatgtacgttctttgtgccttcatagaaatcagttgactgtaaatatgggctttgtttctgggttctctgttctatttcatttatctgtgtgtctgtttttataccaatatcatgctgttttgggtactacagctttgtaatatattttgaagtcagatagtgtgatgcctccagttctgtaccttttgctcagaattcttttggctacttggactactttgagttccatataaattttagggttttttttccatttctgtgaaaaatgacattgatattttgatagggactgaaattattttttacattgctttgtgcagtatggtcattggaaaaatattaatttttctgatccatgagtatgggatgtatttttatttgtttgttttctgtttcatttctttcatcagtgttttgtagttttctttaaaagaggtcatttatctccttggttaaatataatactaggtattttatttttgtaactcttttttataactattgtaaatgggattgccttcttgatttcttctcagctagttgattatttatgtgtagaaatactactgatttgtgtgtgttgattttgtgttctgtaactttactaagagtttttggtgaagtctttaggtttttctagatacaagatcatgttgtctgcagaggtggatagtttgacttcctcttttccaatgtgaatgccttttatttctttctcttgcctgattgctttggctaggtacagaaagacctagccaagtggtgagtggtgaaagtgggcatccttttcttgctccagttctcagaggaaaggcttccagcttttccccatatcattacctgtgctctttattatgtttacatacggtctttagtatgttgagttatgttccttctatgcccagtttctgagtgctgttatcataaagggctgttgaattttatcaaatatttttcctgtgcctattgagattatcatattattgttgtccgtcattctgttgatttgatgtattgtgtttattgttttgtatatgttgaaccatccttgcatccctgggatagatcccatttgatcatggtgtattatctttttcatgtgctgttggatttgatttgctagtatgtagttaaggagttttgcatctatattcatcagggatattggcctgtagtttttgttgttgttgtatacttgtctagttttggtattagggcaatggtgcctcatggaatgaattagggagaaatccatttgcttcaatttttttgaatagtttgaggagaagtgatgttagttctttttaaatttggtagaattcaacagtgaagccatctggtcctgggcttttctttgttgagagactttattagtgattaaatctcattattcgttattagtctgttaaggttttctacttcttcctgattcaatcttggtaagttgtatgggtccaggaatttatttttttcctctaggtcttccagtttgttaatgtatagttgttcttaataggctctgatgatcttttatatttctgtgctatcagttgtaatatctccttttctatttgtgattttgagtcttctctctctttttttggttagcttaactagtaatacaggagttattaagaaattatttttaggcagctagaaagggtgaaaactcccagtgtaatttttctttaataaaaagcagtccccaaaccatttcttctctaacaggaagcagcctgagaagtcaggcatagatatgcaaactaggagcttttatatgtaaatgatggcagctgtacctggaagccaggtacattcaatgtggcatctcccatcctcttttgcttgtcactatgttaatgggtatcatggcagcctccaggtaaaaccgtgtgtacaggcatcatggcctccaccaggtggaggccgcatttgcataataaaagactagggtcagagggccagtctttttgcaagctatgtaaatggcacacctggtaaacccaatcccctgagccctatgtaaatcaatcactgcctcctcaagcctctgtacaaaaccgattatgttttgccacaaactagagaccctcttttgggcgacccactttttcagcatgaggaagctttttttctctttcttctttttctattaaactttccgctcctaaatccactccttgtgtgtgtccatgtcttgaattctttctcaactgtgacaaagaaccagggtatataccccagaaaatggagccatttcactagcagtttatcaattttatctttttttgaaaaaaaacttttcattttgttgatgctttgtaaattttttagtctctatttaatttagttctgctctgatctttattatttccttcctcctactaattttgggtttgatttgttcttgcttttctagtacttggggtgcatcattagactatttatttgaaatctctctgcttttttgatctagatgcttattgctataaacttccctcttagcagtgcttttgtgtgtcctgtaagttttggtgtcttgcgtttccattttcatttgtttcaggaaatttttaaaacattttttccttaactttttctttaatccagtggtcattcaggagcatgttgtttaatttccatgtgtttgtagtttccaaagttcctcttattattgatttagagtttcagaccattgtgatcttgatatgattttgattttttaaaaactgttgagatttgttgtgtggcctatatcttggagaatgttccatgtgctgatgagaataatgtgtattctgtagctgttggatgaaatgttctgtaaatgtctgttaggtccatttggtctaaagtgccgtttaaatccaatgtttctttattaattttctgtttagatgatctgtcttatgctgtgagcggagtgttgaagttcccaactattattgtattggagtctatctctccctttagatctaaaaatatttgctttacatatctgggtggcctggtgttgggtgcatatgtatttggaattgttatattctcttgctgaattgatctctgtatcattatatattgaccttctttgtttctttttattgttttcaagttaaagtatcttttgtcttatttaaacatagctacccttgctcatttttttatttcaatttgcatggaatatctttttttcatccctttactttcaatctatatgtgtctttacaggtgaaatgagttcttatagggattctatacataggtcatttttttttaaatccattcagcccatctatatcttttaagtggaatgcctcatttgtttacattcaagattattattaatatgtgagggcttattcctatcattttacttggtttcttgttgtttgtatatcttttgtgtctttctttctgtcttattgtttattcattatggtttggtggttttccgtagtcataacatttgagtccttttttgtccttgtttgtctgtttgctctaccagtggttttatacttttgtgtctttttgtgatagtagatagtgtccttttgcttccaggtgtaggactaccttaaacatttcttgtaggattggtcttatgctgatgaattccctcagctttggcttgtctgggaaagactttatcttttgtttatgaatgttaactttgctgggtatagtatccttggctggcagttattttttttttttcctttaagcactttgaagatgtcatcccattctcttctggcctgttaagtttctgctgagaaaccaactgttagtctgttaggggttcccttataagtggctagatgcttttctcttgctgtttttaaaattatctctttgtctttgacttttggcaatttgactataatacacagtggataagacctttttagacgatatgtatttggagatctctgagcttcctgtgtctggatgtctaaatctcctgctagacttgagatgttttcagctattattttgttcaataggttttctaccccctttgttcttctattcaccttttggaacactgaaggtcaagtatttggtcaatttgtggtctcctttatgtcatgtaggttttgttcatttttaaaaattatttctttaaaaaaaatttgactgactgggtgatttcaaaagacctgtcgtcaagtcctgaaattttttcttctgcttgatctagtctattgttgaagctttagaatgtatttttttttcattcagtgaattcttcagttccaggatttctgtttgtttctttttttaataatatctctttgataaatttctcattaatatactgaattgtttttctgatttttttgtgctgtttatgaggttctcttgtctctcactgaggtttttaatatcaacacttttaataatttttctaggatttcataaatctctttttttggggatcttttgctggagaataattatttttatttggaggtgtcatatttccttgctttttcatgtttcttgtgtccctccattgatatctgcacatctggtgtgccagttgcttcttccaaaattttggattttctttcatacgggaggacttttcctgaagatgtatctgttgtgttggctgggtagggcaccttggctttgattctgggtacgtgcaatagtgtattctctatatgatttcttcagttgtaaacagcttcagtagtgtttgtgatttcctcagtagcttagggtgtggttgttagtgaaggctgtggtgaagctttgctgggcactgggatgccaggtaggaatgtcatcaggcccactgtggtaatggtaggcctagcatacctgtcattgggcctcagggcaacataggctggcaacaatgttagttggtcctggcaggccaatggttgcacctccatgtggctcaggtgccagaagtggtagtggtggtcctcgggtccctgggcagtgggcttggaaagagtgatggcagtagcagtggcagaacaactctttggccccaaaatggtttgtgctggtgttagcagtggctgtggaaggctgggtgggccagtctcaggtctgcaagtcacacatgcaggtgagtgtcagctgctgtagttgtggcaggttgggtgggtctgtcctcaggcccctgggagaagtgctcaagtgctaatggtggtagatgagacagtgaaatccccaggcctccaggtggcatgctcagacactgggagtgggacagagctggaccaggtcatcctttcctcaatcctcagtcatatgtgtgggcactggctgtgttggcagagccagggtgattccaaagtttctagtggaatgcttggatgggaacagcagtgactgtgctgtggctctactgttggagcgtgcaaggttgctttcattggtagcagtaataggcaggaagctgtggagcacatgccttggtctcaggtggtagctgtaggcagggtagcctgtcctcagagtcactaccagtagctcacacttcagccctggcagcatcagccagcagtggcagtgactgcagatggagaaatctgtcttcagggagtgggaaaatgcaccctatagcagggtcacgccaacggcttatggttctgctctggatgcaccagacagcagtggtggtggctacagatggatgatgtgaattcagctccagggatgtggagatgcaaggcctgctgggctccagtgcaggatgcagcctggtggggcctggcctttcaaaatggagacatgctgcagcttcttaggagttggagggtgtgtgggtctcagtgtgatctccctctctggagcatgccatcatgcagtctccaggcagatccctatgttagtctcaggacccaagagggtggatgggctctttgaaggctgagattgcaggagtctgcagtgggaatgtggactgctgagggtttctcacatacccttttcctgcactggagagcctctctgggctcccacccaatctggctgagcagagtgcctttcttccctctccttccttgccttaggtgtttcctgtctcttctctgttgaattctagtgttgtcttttggatgatcaattcaaagtgtgattctaatactattttggttcctctttctggaggaggcaagtaccggatgcttccagtcagccaccttgaacagacatactggaagaccaagttgtaccatctttataggcagatgtggctgaagagatgaaatttatgccctctctccatcagtttgggctgctataacaaatcaccacagactggctggcttagaaacaacagaaatttatttttcacaattctggaggctggcaagtccaagatcaagaaatcagtagattcggtgtctggtgagggctcacttcctggttcacagactatgccttcttgctgtttcttcatgtggtggaagaaatgagagaactctctggggtctcttttatgaaggcactaatctcattcatgagtggtccactctcatgtcctaatcacctcccaaaggaccccaccttcaaataccatcacattggggattagatttcagcatatttattttggagggacacaaactgctcttttaatattcattttttttaccaagacctacttattaatttctcagctattttgatctttataggatattctaataagtgtttttatgttttaagtattaatcattgtagtgggctgaatagtggccctctaaaaggtctgtcaatgtcctaatccctggaacctgtgaatgttaccttatttggacaaagtgcctttgcagagcctccagaggagggtacagacctactgacactttgattttacagtctggcctctctaactatgagagaataaattactgttgttttatgccactgactttgttgtaatttattacagcagccatagaaaactaatacaattattaatgtgttttaaatccatggtgttttgagaatacaattcaaatacaggttcaatattaaccatctggcttccttgccagctagcttgaaattcatttgtttatcatggaggagtaggtcatttgtgttaattactagctcaactagtagttttgctaaaagtaattttcattttttaaataaacaaggacacattttttgaccaaggagaaaaatcaagcatagagaataatcataacctttgaatactattcaacaggagggatttttttgtctatgggaatacagaagaaaattggtaaacaagcagtctagaccagacataagctgtatgtcagtgattataaggcaagtaaataattgtgccttagaattgatcaattcagttagaagaagggggaggagtcagccaagcctctaactagatggtctgaccatttacttgactaaagagtcatttgatgagatgagtgagatgaatatttatgctcagcaagtgtctgacatagtatgtactcaaaatttaatttaatattattattattactatcattaattaactcacagccttgagttgacatggatactttttaaaaataatgaagaaggtgttaaagactgcatgctgccacttgaaaatgtccttgccaacaggcccttataattgaggtagagagacaacatatgtgggctgcgattacaaagtaataaatatttgctttaaaaaatcagtagttacatatgaaaattcatgctgtccctttccaaattggctactttaggaaacttacattattttcacaaaaccgatgttacttaaaagtgtttttgagatcatctccagaccctccagtatgttgcttagaacctactttgaaatgacagtcctttttcctttgagggtggagcagctatgtcatttggaactaagttcacattttctaggttaacgtctttaaagtagaatgcttatatgtatgcatgtacttgagtttgtcttcttttggggagaaactatatttattttgttatcaaggaatccacttctatgactcgtgaagcccaggctgagttaacagtgatgagttctagagggacctacttcccagtctgaattttctggtttcaattcatcttctctcttaacctgaactgaaaacccagacttatgaagcctcaatccttgccctcttattcctggaaaattgcaaagccaaatatgtaggaggctttttcagaagagaaaatgactttgtgttttcagaaaacaaacccttcactttgctttatgaggcagatagcagccccaaaccatgtacaggttgggtcctgcacagatcttaattggtttcttttctaaagatgaatttatgtcattacttaatgggcacaccccatatatcatcagcattaaaatgggacattttgaatattctagttccatccccttcacccagcatgggatccttgcctccaacagttctgaggaaaagagcttattactttataagacacactagtacattgtttgaatcagttatactgttagaaaaacctattatagttaaatgatacaagatatgggtatgtgcccaatatagcacatagaacatagtaaaatacatgatagatatttataacctgctcatgtagccctaaaatgtgcttccttcaaactctatcttctggagcaacaaaggttaattcttaattcttcttctatatgacaaagcttcaatcgtttaaaaatatatttacctaatgtgtccttgaaacatctcccctccaggccaagcaccctcaagttcttctgtcattctcatatgtcaggatttctagacaggatacacttgaaacaggtaataatactaaataatatatgataagggagaaataagtggtattgagagctagttaaatagtccatagacaggatatccataggctagagtggtcttgagaaggtttagtggtgggagtggaatttatgcaaggccttaaaattcaagtagaatttggaaggactgagaacagactagaatagatctcctaagtgaggtaaagggccttttaatttagtccagtacagtgataggtgtttttattatttgttctatcttcctggagatgaaggttttaaaacaaaccctaaacaaaaaggaggagataaaattaaagatggtttcactctttaaagctgggcccttcggcaagtagctgtactagttgagggtggctgggagaagaaccagtggtttctgacaaagtagagcctttagcattgggaaagaagatattaattacaatggatgctaatagtttctatttgaaaattattgtagtggtttttctgaaaacacaataagtaagcattaggtgggtaactaaatcactgctgataaagaatcttctttactactagtgtgggaagacagttgcataaggaaatgtgcttggtgcctccatttctgttatacctttctcaggagctgataattggaaatgttttaagagaggttataattagggcttgggggcttcatgtatagttttttttttaattctcttggatttttatgtttattttcaaggcaaataagttgtggctcacttgtaggaggaaagactcaacttttgtcagtgttcaaaaaaagttgccattatacattgtccacttaaattattgaattatatcacaaataggtttgtatattagagtagcactatgtatactgagagcagtagagcttgcttcacttgttattatttgactagccatataaacccatgtacttagcatctacactctccctttctttctttctcactgtctcctttgcaccctcccgtaaatataccttgagttcttgaactatatctattgtataccaacatgtttgaatcttttggttggggtttctaacccccaccccaaacaaagacatagaatatgagttatttgaacaatgagaatttgtttttttggaaacagcacctttatttttgtttatttttgatccatgtgtatcctcagagtagactattttctaaaaagggtaaacaacacacagtataacagtggcagtgcaaggtgtgtggggtattttttattccacaggggagactatgatggagtcatctttatttaagatggcttctaatactctatgtcactcctgccactcagcatgtattactgagtcatgcacctagtagatactcaaataaggtctaattcagggcttctgtttcctggagcctaggagcacctaatagttaagaagtgatatatgtacataatcattaattctctttaccaatagcttccctggttgggtttgtttagtaacattatttatttagctaaacccattgctctatatgtgaacactaatcaatcagggcaagccctagcccagttaaaaaatccatgtctagttagttttgttgaaaaaaatggtgttggatgtattaatagatataattaagggagtatcctagttctctcatgtttgtattgcttctcaccttgtacataggaggctctctgaaaatgcttgttgaattattgagctggattgcaggacttaagtatcacaattattagcattacctcttccaaaatgttttgcagttatggtacagttaaagccaaaagtatagagacgatttgttattatggtttagatgagtaacagaggctccttagctcacttaaagagaaatcaggcaagtcacctgtggactagaaatctcctcagtctctcctctctagcccccctgtattaggtgttcatgaggctcgccaggggagttgaggaggtttactgcaaacaactgttcttttttcttttggggtaaatggtggtgcaaggagtaaggggacctggaagatggagaaagtgttgaaaacccaaagcacaacccattagttttgagagtataatgattaatcatcatttaaaatcccaggttggctgggaaacatatttcagaatatcatccatgaaaatttccccaaccttgctagagaggccaacagtgaaattcaggaaatacagagaactcctgcaagattctacacaagaagatcatccccaagacacacaatcatcagattttccaaggtcaaaatgaaagaaagaatgttaaaggcagctagagagaatgggcaggtcacctacaaaggggttatcagtctaacagcagacctctcagctgaagccctacaagccagaagagactgggagcctatatttaatattcttaaagaaaaaaatcttcaaccaagaatttcatatccagctaaactaagcttcctaagtgaaggagaaataagatccttttcagataagcaaatgttgaggggattcattaacaccagacctgccttacaagagatcttgaaagaagcactaaatatcgaaaggaaaggctgctactggctaatacaaaaacacacttaaacacacagaccagtgtcattgtaaagcaaccacataaacaagccaacatcataaccagctaacagcacaatgacaggatcaaatccacacatatcaatactaaccttgaatgcaaatgggctaaatgcccaacttaaaaggcagagagtggcaagctggattaaaaaagcaagacccggctgggcacggtggctcacgcctgtaatcccagcactttgggaggctgaggcaggcggatcacgaggtcaggagatcaacaccatcctccctaacatggtgaaaccctgtctctactaaaaatacaaaaaattagctgtgcgtgttggcaggcgcctgtagtcccagctactcgggaggctgaggcaggaggatgatgtgaacctgggaggtggaggttgcagtaagccgagatcacaccactgcactccagcctggggaacagagcaagactccatctcaaacaaacaaaaaaaaaaagcaagacccaatagtatgctatcttcaagagacccatctcacacataatgacacttacaggctcaaaataaagggatgcatgaaaatctaccaagcaaatggaaaacagagcaaaaacaagggttgcaatcctaatttcagacaaaacagatttcaaacgaagaaagatcaaaaaagcctaagagcattacataatggtaaaggtttcaattcaacgagaaaatctaaccatcctaagtatatatgcacccaacacaggagcacccatattcataaagcaagttcttagaaacataaaaagagacttagattcccacacaataatagtgggagacttcaacactccactgacagtattagacagatcatcaaggcagaaaattaacaaaggtattcaggacctaaactcaacattggaccaaatggatctgatagaccatgacagaactctccacccgcaaacaacagaatgtacattattctcattgccacgtggcacatactctaaaactgaccacataattagacataaaacaatcgtcagcaactgcaaaagatccacattcataccaaacacactctcaggaccacagcacaataaaaatagaaataaaaactatgaaaattgctcaaaaccatacaattacatggaaattaaacagcatgctcctgaatgacttttgggtaaataatgaaattaagacagaagtcaagaagttctttgaaaagaatgagaatcaagatacaacatgccagaatctctgggacacagctagggcaatgttaagagggaaactaatagcactaaatgcccacgtcaaaaagttagaaagatctcaaattaacaacctaacatcgcaactgaaagaattagagaagtaagaacaaatcaactccaaagctcgcagaagacaagaaataaaaaaaatcagaactgaactgaaggaaattgagacatgaaaaatcaaaagatcagtgaatccagaagtttgtttcttggaaaaattaataagatagataggcctctagctagactaataaagaagaaaataagatacaaataaacacaattagaaatgatgaaggggatgttactactgaccccacagaaataaaaacaaccatcagaaactactatgaacacctctgtgcacacaaactagaaaacctagaagagatggataaatttctggacacatactctctcccaagactgagccagaaagaacttgattccctgaatagaccaataacaagctccaaaattgaatcagtaacaaatagcctaccaaccaaaaaaatcccagaacctgatagattcacaatagaattcaaccagattacaaagaagagctggtactattctcacagaaactattccaaaaagttgaggaggaagatctcctccccaactcatcctgtgaggccagcatcatcttgatttcaaaacctggcggagacacaacagcaaaagaaaacttcaggtcaatatccttgatgaacattgatacaaaaattctcaacaacagacttgcaaaccgaatccagcagcacgtcaaaagctaattcaccatgatcaaccaggcttcatcaccatgatgcaaggctggttcaacataagcaaatcaaaaaaatgtgattcatcacataaacagaactaaaaacaaaacccacatgattatctcaatagatgcacaaaaagcctttgataaaattcaacatccgtttatgttaaaaactctcaataaactaggtattgaaggaacatacctcaaaataataagagccatctatgacagtcccacagccaacaacatgcggaatggggaaaagctggaagcataccccttgaaaaccagcacaagacaaggatggcttctctcaccacttctattcagcatagtaaggggaagtcctagacagagccatcaggcaagagaaagaaataaaaggcatccacatagaaagagaggaagtcaaactatctctgtttgcagacgacatgattctacatcaagaaaaccccatagtcttggcccaaaacctccttcagctgataaacaacttcaacaaagtttcaggatacaaaatcaatgtacaagaatcactagcattcctataaaccaacaacagccagaccgagagccaaatcagaaagacaaattcattcacaattgccacaaaagaataaaatacctaggaatacagctatccagggaggtgaaatatctctacaatgagaattacaaaacactgcaaaaaaaatcagagaggacacaaataaagggaaaaacatcccatgctcagctgggaagaatcaatgtcattaaaattatcatactgcccaaagcaacttacagattcaattctattcctatcaaactaccaatgacattcttcacagaattagaaaaaactattttaaaattcatatggaaccaaaatagagcctgaatatccaagacaatactaagcaagaagaacaaacctggaggtatcacattatctgacttcaaactatactacagggctacagtaaccaaaacagcatgatactggtacaaaacaggcacatagaacagtggaacagaatagaaagcccagaagtgaggcctttcacctacaaccatctgatcttggacaaacctgacaaaaacaagcaattgggaaaagacttcctattcaataaatagtgacgagataactggctagccatatacagaagattgaaactggacaccttccttacaccatatacaaaactaacaagatggattaaagacttaaatgtaaaacccaaaactataaaaaccctggaagacaacctaggcaataccatcctagacataggaatggccaaagatttcataacaaagacaccaaaggcaattccaacaaatgcaaaaattgacaagtgggatctaattaaacttaagggcttctgcaccacaaaagaaactatcaacagagtaaagaaacaacctgcagctgagcatcccagcggagcatgggatgtttttccctttatttgtgtcctctctgatttttttgcaacctacagaatgggagaacatatttgcaaaccatgcatctgacaaaggtctcataatcagcatctatagggaacttacacaaatttacaagagaaaaacaaccccacttaaaagtgggcaaaggatatgaacagacagttctcaaaagaagacatacatgcagccaacaagcatatgaaaaatagctcaaaatcactgatcattagagatatgcaaatcaaaaccacaatgagatgccgtctcaccccagacagaatggctattattaaaaagtcaataaatactggatgttggcgaggttgtggagaaaaggaaacacttatacactattggtgagtgtgtaaattagttcaactattgtggaaagcagtatggtgattcctcaaagagctgaaagcagaactgccattcaatccagtgatcccatgactgggtatatacccagaggaatataaatcatcctaccataaagacacaggcatctgaatgttcattgcagcactattcacaatagtgaagatatggaataagtctaaatgtccatcaatgacagattggataacgaaaatgtgatacacatacaccatagaataccatgcagaaataaaaagaacaagatcatgtcttttgtgggaacatggatggagctggaggctattattcttagcaaactaacgcaggaacagaaaaccaaataccgcgtgttctcacttgtaagtgggagctaaatgataagaacttatgaacacaaagaaggaaacaacagacactggggtctacttgagggtgaagggtgggaggacagagaggagcagaaaagataactattgggtactgggcttaatacctgtgtgatgaaataatctgtaaaacaaactcccatgttacaacctcctatgtaacaaaccatcacatgtacccccaaacctaaaataaaagtttttaaaaatcccaatttgggcaattaaaaatgctacagttgtagttagaaggctcttctagtgataccacctaaggaagagtatgggtctgggatatttctctcatatctctaggaaaggaccaaatgtcatttttaagtaggcattgaatacctacaatatgaaaagttctgtgtggaatgcagtgatgaactggattcccaccctttttccacctactggtttatagtgttttaggtaaagataaataaaggaacaatggaaggcagaatgtattaactgttctaagtggtacaaggtgcgagaagaggaaagagtgatttgtaatgattcagtaagtgagattatcacaaggtaggggatgcatgtttacttttccagggtaattatttttaatggcaactgaacttagttcacactgacaattgacagcactcctttgagaaaaggataataatttatatcctaagtaaggactgagcagattactagaattttaccataaaactataaagaggaattaaaattgtaggcttatactcacatatttgcaggttttcattatatatttttctcattctatgttttctttataccataatgatgtacaaggatgataataaatgatgtataagaatcatgttttccttataactggggatggtagggtgcagtttgatggggagagatcttcagtttcagcaagactgagtggttaaagcagagccttaaaaaccaacaatttaaataaaaagaagggaccttggagcacagcaaaagctgtgtacactgcctgaagtttaaaaagacatccctgtattgttaccatatgttgttaatagcactcattcaaggaaaagcccattggcaaactggttgatgaggctggccagttcaaatatagaggaaacttcacagggagcataataaaatggtaatcaaaagatattattgtatgctttaaaaacctgatttaaaaaatcaaatttaatgtaaatttaccccactttgattcagttgcttcaaactaattttctatttaacttaatatctagtaatatcagaatttttctttggtaaaaagctcaatttaaaatgtttttaaattaaaagttgggggttctaaaccctttgctttccccaagttcagggtagttagaattatcacccagattgtttggatcaggttcgcccatatacaggcttagcacattgtacatacacacatacctacattaagtcatgaggattttctggattcaatattttattcttttaataaaaatttgtaattgctcagattccaatttattctggactgaaactagtttttccttcaggttcagggcttgtaagtccagggcacttgctgtttgaggcctatttttattatttcctccatccacaatgggcactatgttcttctttttcaccacttacttataaaagacacacatgcatgcacacacacatacatagaaacatacgtatttatagacaggaaactgctatgccgtttaaataagaaatcactgcgcctttctcataagctcagttttttttccttttgatgcctgatttattctttcttataagaatctgagctgttagttacatataacaattgtcccccttgatgactactttctgatagcctgaccctttcattttcagacctgtattgctgttcttgttttcttttactaacagtggtctcttctcttcagctcttctctggtgtttgcagttctgcctttgtagatgacaaagaatcttggaaaaaatgcagaaatggtaggaataaagaggagcaggacaagatagtgaagagattcttattctgctattcattactcttctgttggaggggctgaattgtaaaatgtgacaaaagcagggaacaggaaaattataatgatacggtcttctgttaggaggtaatatttacttattgggtaaccaaaatgagtatctggttagtgtaaggaagatgagaaagacagtccttatgtttgctggtatataaaactattgggaggggcagaacaagatggcagaatacaaacctgcaacgttagtactccccacaggaacaccaaattttaacaactatctgcacacagaaagcactgtcacaaaaaaacaaaaatcaggtgagcaatcacagtaccggactttatattgttgaaagaggtattgaggagggtcagagagacagtcttgaatcaccagatccacccctcccctatcccccagcagcagccatgcagcacagagtgtctgtgcactttcaggagggagagtgaagtgactggggacattatattgatttcagtgctacactgtcacagtggagaaaaaagccatgctgggctcagtcagcacctgtgcacagagggggcatttgcagcagccctagccagagagggatcaatcatccatcccatcagtcagaactccactctctcagcaagcctcaccaccacaggcaaaagagctctggggtcctaggtaaacttgaaaggcagtctaggacacagtgactgcaatttccaggtggcccttagtgctgggctaggctcagagccagaggactagggtggcacgtgacctagggagacaccagccagggcagctaaaggagtgcttgccccatgcctccccccaaccccaggcaatgcagttcacagcaacgaaattgtctccttccttctgcttaaggggaggaaaacaaagatgaaagaggacttcgtcttgcatcttggataccagctaagccacaatagggtagggtaccaggcagagtcgtgaggcccttattccagggcctaggtcctggacaacatttctagctataccttggtccaaaagagaaactgctgccttgagggaaggactcactcctggcaggattcatcacctgctaactaaagagctcttgggacctgaataaccagcaccaataccctagtagtatgctgtgggctttgggttctaagacgttctgaccacagatgtgatccagcacattcccagctgtgttgtctacagtaaacaactccttctgtatgagaaaagcagacagaaaagtaaaggggacttcgtcttgcaccttaggtaccaacttgaccaaagtggggtagagcaacaagcaggctcttgggttccctgagtctaggcctaggctcctggatggcatttctggacctgccctgggtcagaccatagccctgaagggtgagtcacaggcctggcagtattcagcacaagctaactgaagaggccttaggctttaagggaacattggcagtggccaggcagaagcccgccctcctccttcccccaccatgggcaagtggtggtgatggtgacagggagaggcctctctgcctgtggaaagaagaagaaagagtgggaaagactgcatgtcatggttttagcaccagcttagccacttatctatttagtaggatagaacatcaggctaatttctgatgtttttttaactccaatccctggcacccagacaacatctcctgaccagcttgtggcatggaggaacttgtcaccctgaagggaaggacaccaaacagtctgactttgccacctgctggttgtagagcccaaggacttgagtaaatgtgggtggtagccaggtagtggtttcagcagaccttgggtaagatccagtgttgtgctggcttcaggtatgaacaagtgcagtctcagggatggtggccacaggagtgcttccatcaccatacccccacctccagacagctcagctcagagacagagactgtttgtgagaaagtagggacaaaaaaaaacaagagttcctttctggtcatccagaaaattcttccagattttatttaagaccaccaaggtggtacctcttatgagtctgcaaaaaccacagaaatattgggcttggggtccagtctcttaaaatacttgtaaagcctcctcaagaaaggcagaagcaaataagcccagactgtgaagactacaataaatacctaactcatcaatgttcagacaccggtgaacatctacaagcagcaagatcatccaggaaaacatgagctcatcaaacgaactaaataaggcaccaggacctatcctaaagaaacagcgatatgtgacctttcagacagaattcagaatagctgttttgaggaaacttaaagaaattcaaggtaacacagggaaggaattcagaattctgtcagataaacttaacaaagagattaaaataattaaaaagaatcaagcagaaattctagagttgaaaatgaaattgacgtactgaagaatgaatgcatcagagtctcttagcagaactgatcgagcacaagaaagaattagtgagcttgaagacagactatttgacaatacacagtagacgaaagaaaaaagaatgaaaaacaatgaagcacacctacaatatctagaaaacagcctcaacagggcaaatctaagagctattgcatttagatgggggatagagaaacagatagaggtagaaattttattcagggggataatatcaaagaacttcccaaacctacggaaatatatcagcattcaggtacaaggttatagaacactaagcagctttaacccaaagaagactacctcaaggcatctaataatcaaacctcctaaaggtcaaggataaagaaaggatcctaaaagcagcaagagaaaagaaacaacataacatactatggaactccaatacctgtggcagcagtcttttcagtggaaaccttacaggccaggagagagtggcatgacatatttaaagggctaaaggaaacatattttaccctagaagagtatttctggtgaaaatatccttcaagcatgaagcagaaataaagaccttcccagagaaacaaaagctgggcatttcaacaccagacctgtcctacaacaaatgctacagggaattcttcaatctgaaataaaaggatgtcaatgagcaaaaagaagttgtctgaaggtacaaaactcactggtaataataagtacacagaaaaacacagaatattataatgatataattatggtattttaactacccttatcataagtagaaagatgaaatgatgaaccaatcaaaaataatatctacactacaacaacttttcaagacatagacaatacaacaagacacaaagagaaacaacaaaaagttaaaaagtggaaaggatgaagtttaagcgtagaacttttattagttttcttttcttttctttctttttttttttttttttgagatggagtttcgctcttgttgcccaggctggagtgcaatggtgcaatcttggctcaccgcaacctccgcctcctgggttcaagcaattctcctgcctcagcctcccgagtagctgggattacaggcatgcaccaccatgcctggctaattttgtatttttagtagagatggggtttctccatgtcggtcagactcccgacctcaggtgatctgcctgcctcggcctcccaaagtgctggaattagtcatgagccaccgcacccagccttattagttttctttttgtgtgtttgtttgtttacgtaatcagtgttaagttgttatcagttgaaaacaatgagttataaaatcgtatttgcaagcctctcagtaacctcaaatcaaaaaacatgcaatggatcacacaaaataaaaggcaaacaattaaatcataccaccagagaaaatcacctttactaaaaggaaaggaagggaagtaggaagagaagaccacaaaacaactggaaatcaagaaacaaatgacagaaataaatcactacttatgaataataccagtgaatgtaaatggactaaactgtccaatcaaaagatataaaatagctgaatggatgaaaatacaagaccccatgatccattgcctacaagaaacacatttcaactataaagatatacatggactgaaaataaagggatgaaaaaagatatttcatgccaatggaaacaaaaaaggagcaggaatagctataaacactctaagaagacacaaagaacatcattatataatgataaagggttcaatccagtgacaggatagaacgattgtaaatatatatgcaacaaacactggaacacacatatataaagcaaatattattagagctaaagagagagatagacctcaatacagtaatagctggagacttcaacactctactttcagcattaggcagatgttccagacaatcaacaaagaaacatggaacttaatcttctctatagaacaaatggacctaatagatatttacagaacatttcatccaaaggctgcagaatacatattcttctcagcacatggatcattctcagggatagaccatatgttaggtcacaaaacaactcttaaagcattcaaaaaattaaaataatgtcaagcatcttctctcatacaatggaataaaacaaaaaattaagaacaaaacgaattttggaaactatacaaacacatggaaactaaacaatgttcttcctaatgaccagtgagtcagtgaaaaaattaagaaggaaattggaaattttcttgaagccaatgataatggaaacacagcatacaaaaacatgtgggacacaatgaaaacagtactcagagggaagcttatagctataagtgactacctcaaaaaagaaaaagaacttcaaataaacaacctaccaatgcatcttaaagaattaaaaaagcaagagcaaaccaaacccagaattagaaggaaagaaataatgatcggagcaaagataaatgaaaatgaagaaaacaatacaaaaaatcaatgaaaccaaaccttggttttttttattttgttttcattttgttttgttttgagaagataaaattgacaaactgtaacccagactaactaataaaaaaagagagaaagtccaaataaataaaatcagagatgaaaatggagacatataactgataccacgggaatgtaaaggatcaccagtggctactatcagcaactatatgctaataaactgaaaaatgtagaagaaataaataaattttgagacacatacaacctaccatgtttgaaccaggaaaaaattcaaaacctgaacagaccaattacaagtaatgagatcaaaaccataataaaagtctcttagtaaagaaaagcccaggaactgatggcttcactggggaattattccaagtatttaaagaggaactaataccaatcctactcaaactatctggaaaaaaagagcaggagggaaactcattctgtgagggcggtattactctaataaccaaaacaaacaaagacacaacagaaaaagaaaactacaggccaatatctctgatgaatattgctgtaaaagtcctcattaaaatactagcaaactgaattcaacaatacattagtatgatcattcattgtgaccaagtgggatttatcccagggatacaaggatggtacagcatacacaaatcaatatgatacatcatatgaatggagtgtagcacaaaaaccgtgtgatcatttcagttgatactgaaaaagcatttgctaaaatttgaaattccttcatgataaaaattctcaaaaaactagggatagaaggaacatatcttgataaaataaaagccatatatgacagaccacagctagtattataatgaatgggataaaactgaaagtctttccttcacccaaaggattataaatcatgctgctataaagacacatgcacacgtatgtttattgcggcactattcacaatagcaaagacttggaaccaacccaaatgtccaacaacgatagactggattaagaaaatttggcacatatacaccatggaatactatgcagccataaaaaatgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaagggggacatcacactccggggactgttgtggggttgggggaggggggcgggatagcattaggagatatacgtaatgctaaatgacgagttaatgggtacagcacaccaacatggcacatgtatacatatgtaacaaacctgcacattgtgcacatgtaccctaaaacttaaagtataataataattttaaaaaatgttcattatgggaaatttggaaaaatatataaaagttgaaggcataaaaaaaaagaaagtctttccttcaagattggaaaaaacaaggatgctgactgtctccactattatttaacatactagtggaagtcctagctagagaaaggtattaaaggcattcaaattggaaaggaagaagtcaaagtatccttgtttgcagatgatataatcttacatttgaaaaaaaacaacgatgccaccaaaaaactattagaactgataaacaaattcagtaaagttggatgataccaaatcaacatacaaaaatcagtagcatttctatataccaagagtgaataatctgaaaaaggaataaaaaagtaatctctttcataatagccaccaataaaatcaaatacctaggaattaatttaaccaaagaagtgaaagatctctacaatgaaaagtacaaaatgctgatgaaagaaattgaagaggacaccaaaaaatggaaagatattccatgttcatggattggaagaatcaatattgttaaaatgtttgtagtacccaaagcaatctgtagattcaatgcaatccttatcaaaataccagtgacatttttcacataatttttttttaaaacctaaagtttatttggaaccacaaaagtctcagaattgccaaggctatctggagcataaaggacaaaactgaaggaatcacattacctgagttcttcaagttatactatagagctatggtaaccaaaacagcaaggtactggcatgaaaacagacacattgatcaatggaacagaatagagaacccagaaataaatccatacacctatgatgagctcgtgttcgacaaagatgccaagaacatacaatggagaaaggactgtcttttcaatgaatggtgctgggaaaactggatatccatatgcagaagaatgaaacttgatccccatctcttgccatatactaaaatgaaatcaaaatggattaaagacttaaatcttagacctcaaactatgaaactactacaagaaaacattggagaaactctccaggacattggtctgggcaaaaatttcttgagtaatactccacaagcataggcaaccaaagcaaaagtggacaaatgggatcatatcaagttaaaaagattctgtacagcaaaggaaacaatcaacaaagtgaagagacaactcacggattaggaaaaaatatttgcaaactacccatctgacaagggatcaataaccagaataagaagctcaaacaactccataggaaaaaaaatctaataatcagatttaaaaactgacagaagatttgaacagacatttccaaaaagaagaaatataaatggcaaacaggaatatgaaaaggtgctcaacattattgatcatcagagatgatcaaaggtacaatgagaagatatcatctcaccccagttaaaatggcttttatccaaaagacaggcaataacaaatgctggtaagaatgtggagaaaagggaactctcctacactgttgtgggaatgtaaattagtgcaagcactgtggagaacagtttggaggttcctcaaaaaaatgcaaatagggctatgatatgatccagcaattccactgctgggtatataccctaaagaaaggaaatcagtatatcaaagtgatatctgcactcccacgtttgttgcagcactgttcacaatagccaagatttggaagcaacctaagtgtctatcaacagatgaatggagaaagaaaatatggtacatatacaccatgaagtactattcaaccataaagaagaataagatcctgccatttgcaacaacgtagatggaattggaggtcattttgttaagtgaaatcaaccaagcacagaaatacaaacatcacatgttctgtcacttgtttgtgggatctaataatcaaaacgattaaactcatggacataattgcacatttaaaaataactaagagtataattggattgtttgtaacacaaaggataaatgcttgagtggatggataccccatttaccattatgtgattattattcattgcatgcatgtattaaaatatctcatgtaccccataaacatatgtacctactatgtacccacaaaaattttaaaaatttaaaaacttggaatgtgtagaagaatggaggaaaattaatttgtcctgcttagacctattatgtatcgccttttctagataactgtgcaaggtgtattcccagcatgtgcaggtgttgtcggtcatgagtgctttagttttagatgcaaagcagtaaatgtggcccctaataaggtttgttgactgctgattccgtagcacaaatgagcaaagaagagattagataagggaagatttcagaggctgtagtgaaaatgaaattttctttgcttttttaaggctaggatgacaaaacctcaaagtaacactgctttcaagcagtgacttgttgccctgagtgatttcaacttaatttgttgtttcacggttgcctggtaggcaagaagaccactaaaaccagaagctatcataggctattttatcaataagatacagcatattcctattgcttaaagtctgctatttttgagaaggcatcctatgccaagaagcaagggactgacctgagattgcacagcaagttggtaacattcattttatgacaacaccaacctagacttccacttttttcttattgaaaccttggataggttgatcaattttatggttaattatatgataataagcatgaatattttaacttttactggatacctgtagcacagcaatagagttggagtctttgaagtgttgtagtacttggaactttatgtagtgtgtattcctacaactgctgtatcatgtattcaaacataatactccaaataccttccactgcagtttaagccctgttttcttttccaattccccttggagattattcgctcatcatactccctcctcttttccttttgtctcttcctaaacaaatgaacagcctttccaattaaataatgatttttctctctacaaacccacccatccaccttctttctctactccatgctgaaagatgccagtaatttagacccatcttcatcccttgtttccattatctttgtagtttgctttctctcttcttaactccttattgatgtggtatggggcatgctattttttccactacataattaggaaactatatgcaccaattttatgggatatctgttttcatctggctcctgtgctctccacccatgaaggcaacaagacaaaaatatcttgggaatcacttttctttctcacagggatggggtgggttggagaggggtcttttctgatttgtttctgctctatatccagtggtgtactagaattggtttgcattggcttttgacaactaattgtacacatctcttcccaacttcaagttcatgtttagtgattggtagcttgaaattgaccatggtggaattgtttaatccatggaaatcagcaaagctaacaaataagggctccccacccatcaggcttgttgttaaacatttaccagcatattactgcctgtttcaaaattagtcttgataagaaagtctatcttaagtacctgtccagttggaatcaactaggcaagaacctgggcaatgaaactaaggcatcatggtagatcagaggaatactatatctgttttggttctatgcttctgagttctcagtccaagaatacttatttaccctacctaggggatgaaatgacccaacaactggaatggagttgggcccacctgctggagcttgactttagctgtgggaattagaaggtggtagtgaggtggaaatcaggactgactgtacccttcagcagccagattctcttgttacatgtttcaggcctacctcccttgttgatttatcaagcaacttgctggtagaggttggtgcatctgacccttcacaagaactagatatgaaatatgcaaactagtatttacttcagctttagtgctgacaggcttgggggtcatttaggttgtctgagcctcagctgttcttgtcagtgaaagggaaaagctagagtggacattaatttgcatttatgtaaaagtgattacttataattagtgggtagataagtagaagctatagtctgtagtggcaaagatgtgacttagctttcttggcaaataagtccctgtaggtcaaggtctatgtctttgactaattttatactgtaccatatttggagagggatttattaagtatatttcaagaggaattaatcctcccaacaataaatttaatattagaatcataacacttcagaattgaaaggaacccttagaaattcatctagtccaatatcctttagtttaaaacatgcatggctataaaagtcaactcaaaatggaataaagacttaaatgtaagcctgaaactataaaattacttgaaaaaaacacagggggaaactacaatacattggtctgggcagtaattttttggatttgaccccaaaagtgcagacaacaaaagaaaaaaggacaaaggggattgtatcaaactaaaaactttcttcacagcaaaggaaacaattaacagtgtgaagaaacaacctacagattgggagaaaatatgtgtaagccatacattcgataaggggttattatccaaaatatataaggaactcagacaacttagtagccaggaaacaaatgacccaattaaaaaatggacaagaaacaatgcatctgacaaaggtctaatgtccagaatctataaggaatttcaacaaatttacaagaagaaaacaaacaaccccattaaaaagtgggcaaagtatgtgaacagacacttttcaaaagaagacatacatgtggccagcaatcatatgaaaaaaagctcaatatcactgatagagaaatgtaaatcaaaaccacaatgagatgccatttcatgctagtcagaatggctattactaaaaagccaaaaaataacagatgctggcaaaattttagagaaaaaggaacacttatacactgttgttaggagtgtaaattaattcaatcattgtaaaaaacagtgtggcaattcctcaaagagctaaaaacagaactaccattccagccagcaatcccattactgggtatatgaccaaaggaatataaattattctattataaatacacaagtacacctatgttcattgcagcatgttcacaatagcaaagacatgggatccacctaaatgcctatcagtggcagataggataaaggaaatgtggtacatatacactatatgcagccataaaaaagaacaagatcatggccgggtggtggctcacacctgtaatcccagcactttgggaggccaaggctggtggatcacgaggtcaggtgttcaaaaccagcctggccaacatggcaaaacaccatctctactaaaaatacaaaaattagccagacatgatggtgggcgcctgtaatcccagctactcgggaagctgaagcaggagaatcacttgaacctgggaggtgaaggttgcaatgagccgagatcatgcctttgcacttcagcctgggcgacaagagcaagactctgtcaaaaaaaagaacaagatcatgtactttgcaggaacatggttgctggaggccattatccttaccaaactaacacaggaacagaaaaccaaatactacttgttcttactgataagtggcagctaaatgatgcaaacacatgggcacaaagaggaacaacagacactgaggacttccagatggtggggggtgggaggagggagaggatcaggagaaataactaatgggtactaggttcaatacctgggtgatgaaataaactgtacaacgcaaccccatgacacgagtttacctatttaataaacctgcacatgtatctctgaacttaaagtaaaagtttttttaaatgggcaagggacctgaataggcaattctcaaaaggacttgtaaaaatggccaacagaaaagatatgaaaaaatgctcaatattgctaattgttagggaaagccaaattaaaaccacagtgaaatataacctcatattcatcaaaatagctattatccaaaagatgaaagttaacaagtattggtgaggatgtgaagaaaagagaacccttgtatactgttgataggaatgtaaattagtacagccattatggaaaactgaatagggattccttaaaaaactaggccgggctcgggggcttatacctgtaatcccagcactttgggaggccgaggtgggcggatcacgacgtcaggagatagagaccatcctggctaacacggtgaaactctgtctgtactaaaaataaaaaaaattagctgggcgtggtggcgggtgcctgtagccccagctgctggggaggctgaggcaggagaatggcgtgaatccgggaggcggagctttctatgagccaagatcgcaccactgcactccagcctgggcgacagagtgagactctgtctcaaaaaaaaaaaaaactaaaagcagaattaccatatgatccatcaatcccacttctgggtatttacccaaaatatttgaagacagtttgtcaaagaaatgtctgcactcccatgttcattgccaagttatagaatcagcctaagtgtccatcaaggaataaatggctaaagaaaatgtggtacatatacacaatggaatgctattcagcctttaaaaagaaggaactgctgtcatttacagtaacatagatgaacctggagttatgctaagtgaaagaagccaggcacagaaagacaaataccgcatgttttcacttgtggaatctaaaacaatcaaactcatggaatcagatagtagatggtggttacacaggctggggcttgtggggaatggggagatgatagtcaaaagacacaaagtctcaggtaagagaaatacaggtttttttgagatctattgcacatcatggtgattatagttaataataatatactgtgcatttcaaaattgctaagacacatacatcttagattttattgttccttggagagctgttgcatcttgaacagaacacttttttcatactgaatatagaaacttgccctgagacttgaatggtatgaggaccaactggaggggaagcaattaaactttggtcgagaagactgaatatttctctagatattcaaatacagtctctgaaatacaactctaaatgtatacagttgatataagttggttttcctttaatttttaattttgaaataatttaggacttacagaaaatttgcaagaataaattgtaaaacgaactcctgtatacaccttccccagatttcccaaatgttaacgttttttacatttactttatccttctctcccccatctattttctcattcatagtcttacacagtgttcattttgccctatctatctatctatctatctatctatctatctatctatctgtctttctctgtctctttctgcttctctctctttctctccttttttttctgaagcatttgagaacaaatacatagtgtccccaatactatagtgtatatttcctaaaaacaagataattctctttcataacaacggtactacaatcaaaatttggaatttcatcaattgtcacaattatgtttttatagaaaatgaaaagctcaaattgtgtttagcattcagatgtcacaatgttttagtgccctttaactcagaatagttcctcagtctgtcttttaaggcattgacttttttgaagagtatagaccagttatttttagcagctttatcaagatgtaattagcatactatacaattcactcgtataaggcatttaaggcatacagttcattgttctttagtatattttcaggactgtgcaaccatcaccacaatctaattttagaatatttttgtcctcgataaaagaaaatcattactcattagcagttactccccaccatttctgatcctaggtaaccactaatttactttctgtttttatatatttgcctattatggacatattttataaatggatctgtagcaatatgtggccttttgtgtctggcttcttttagttggcataatgttttcaaggttcacctatgttatagtgtgtacttcgttcctttttgcagcggaataatataccattgtatgggtatgctacattatttatttattcataatgtgaggaacatttaggtttttaacacattttggctattgtgaaaaatgctgctatgaacattcatgtacaagtgtttctgcggacatatgttttcaactgagtggaattgctgggtcacatggtaacctaactttataagaaattaccaaactgttttctaaagcagttgcaccattttacattcccaccagtcagagggaccaatttatctacatccatgccaacattattatcttttttataatagccatcatagtgggtatgaagtggtatctcattgtcatttttatttgcatttctctgctgaccagtgatgtgaaacatctttgcatgtgcatattggccatttgtatatcttctttgaagaaatgtctattcagactctttgcccatttttaattgatttacttgacttttttattgttgagttgtaggtattctttgtatattctagatacatgttccttatcagatatatgatttacaaataccttattacattctgtgagttgtttctccatttttggtggtgtcttttgcagcacaaaagattttacttttggaaataattttcttaaataccttattgaaacttcaaagaaaaaggttttaattttgaagttcaatttatctatttatacagttggtgcttgtgcttttgttgtcatatccaagaaaccattgtctaaccaagatcaagaagatttacttccatgttttcttctgagggttttgtagttttagctcttccgtttgggtctttgattcactttgtgttaatttttaagtatggtgtgaggaaggggtgcaactttattcttttgcatgtggatattcagttttcccagcaacatttgttgaaaagactcttctttccctcattgaatgatcttggcactcaaaaaaatcaactgagaccgggtgtgatggctcactcctgtaatcccaacactgggaggccgaggcggaaggatctcttgagccaaagagttccagacctgcctgagctacgtggcaaaacctcgtctctacaaaaaaatgcaaaaattagccgagcgtggtggtgcatgcctgtagtcccagctacttggtagcctgaggtgggaggatagcttgatcctgttaattagcttgattaaaccagaggtggaggctgcagtgagccaggattgagccacggcgctccggcctggttgacagaaatctttgtctcagaaacacacacacacacacacaattttcaaccccttaaaattttattaacttttttgtttttattattcctctgtccttgcttccagttaatcttgctacttaggtaaaagagggaaagggaggagattgaaaactaatgaattaaattaagttttgatgcagtcgatattattcattttctctctgtcccccatcttaggatactgaaaattgttcatctataggagtaatggaaaacctgatagtgctaaagaaatatcccatggcagaaacaaaggactttttcccctttcaggaatcattgacccaaaattcagtctgagacaaaataaaagtcaaaaagaacctatttgagttataggtttttgtgatttttttccctcataaaacctccacagggacaaactcacctgatttttaaaatatagaacaggagtcaaggtgagtataacaaataattgaaatgttctttacttttatgtcatgggtagttagaggatagagaagaaaaagaaaagggtgagagagagaaagaagataatgttggaaaggaatgggagaggtataagaagagagggcaggaaagggtccatctcagaagagacaaacagttgttttctactaaagtatgagagattttttttttctggacagcagcctggacaacatagtgagactctctctgcaaaaaaaattacttatttcttatttttttccttcaaagttttattttaggttgaggggacacatgtacaggttggttacattggtaaattgcatgtggctggggtttcagttgccaattatttcatgttcacccaggcagtgaacatagtactcgataggtagtttctcaatgttcaccctccttccaccctctgccctcaggtaggccccagtgtccattgttcccgtctttatgtccatgtgtttagctcccacttgtaagtgagaatatgtggtatttggttttgcattaggaaattaggaacagaaatgttcctgcattaatttgcttaaggtaatggcctccagctgcatccacgttgctgcaaaggacatgatttcattcttttttatggatgcatagtattccatgatgtacagcacagtttctttatccagtccaccgtcgatggacacctaggttgattccttatctttgctaagtgaatagtgctatcatgaacatactcatgcatgtgtcttaatggtagaatagttaatattcctttgggtatatacccaatagtgggattgctgggtcaaatggtaattctattttaagttctttgaaaaatcatcacattgattttccaatggctgaactaatttgcattcccaacaacagtatataagctttcccttttctccacaaccttgccagcataggttattattattattattattattatactttaagttctagggtacatgtgcacaatgtgcaggtttgatacataggtatacatgggtcatgttggtttgctgcacccatcaactggtcatttacattaggtatttctcctaatgctatccctcctccaaccctcaccccccaacaggccccagtgtgtgatgttccccaccctgtgtccaagtgatctcattgtccatttcccacctatgagtgagaaaatgtggtgtttggttttctgtccttgtgatagtttgctgagaatgatggtttccagcttcatccatgtccctgcaaaggacatgaactcatcctttttcatggctgcatagtattccatggtgtatatgtgccgcattttcttaatccagtctatcattgatggacatttcagttggttccaagtctttgctattgtgaacagtgccgcaataaacatatgtgtgcatgtgtctttatagtagcatgatttataatcctttgggtatatacccagtaatgggattgctgggtcaaatggtatttctagttctagaatcttgagggatcgctacactgtcttccagaatggttgaactaatttacactcccaccaacagtgtaaaagcatttctatttctccacatcctctccagcatctgttctttcctgactttttaatgatcgccattctaactggcgtgggatggtatctcattgtggttttgatttgcatttctctaatgagcagtgatgatgagctttttttcagatgtttattggctgcataaatgtcttcgtttgaaaagtgtcttttcatatccttcgctccctttttgatggggttgtttgatttttttcttgtaaatttgtttaagttctttgtagattctggatatcagccctttgtcagatgggtagattacaaaaattttctcccattctttaggttgcctattcactctgatgatagtttcttttgccgtgcagaagctctttaagtttaattagatctcatttgtctattttggcttttgttgccattgcttttggtgttttagtcatgaagtccttgcccatgcctatgtcctgaatggtattgcctaggttttcttctggggtttttatggtttttggtctaacatttaagtctttaatccatcttgaattaatttttgtacaaggtgtaaggaagggatccagtttcagctttctacatacggctagccagtttttccaacaccatttattaaatagggaatccttttcccatttcttgtttttgtaaggtttgtcaaagatcagatggttgtagatgtgtggtgttatttctgaggcctctgttctgttccgttggtctatatatctgttttggtaccagtaccagcagcattggttgttttttgacttttgaatgatagctattctgactggtctgagagggtatctcattgtggttttgatttgcatttctctaatgattagtgatgttgagcattttttcatatgcttgttggccacatgcatgtcttgttttgaaaagtgtctcttcatgttctttgcctactttttaatggggttgttttttgctcattgatttaagttccttatagatgctagatattagacctttgtcagatgcatagtttgcaaatattttatcccattctgtgagttgtctgtttactttgttaatagtttcttttgctgtgcagaaaatctttagtttaattaggtcccacatgtcaatttttgtttttgttataattccttttgaggtcttcatcatgaaatctttgccaggacctgtgttcagaatggtattttctgggtttttatagttttaggatttacatttaagtctttaatccatcttgagttgatttttgtatatggtgaaaggaagaggtccagttttaatcttctgcacatggctagccagttatcccatcaccattttttgaatagggagtcctttccccattgcttgttcttgttgacactgttgaagatcagatggttgtaggtgtgcggctttatttctaggttctttaacctgattccttggtctatgtgtctgtttttgtaccagtaccatgttttggttactgtaaccttgtagtatagtttgaaatcaggtagtgtgatacctccagctttgttctttttgcttaggatggcattggctatttgggctcttttttggttctgaattttataagttttttttataattttttttataatttttttttaattctgtgaaaaatgtcattggtggtttcataggaatagcattgaatctttaaattactttgggcagtatagccattttaacattattgagtcttcttattcatgagcatggaatgtttttcttatttgtttgtgtcatctttcatttctttcagcagtattttgtcatttttttgtatagatcttcaacctctttggttagctgtattcctaagtattttattaatttttggctactgaagcatggcagactgaaagttaatatttctactgtgtaaaatcacctagaagtaaagagaataagactattatgaggaaaatggaattgtaggaagattagagatgctagaattgtttatcccagagaagagaagactaggggaaggtggcatgattactgcctttatctaccttaaagccctaaaggaaaagagtaaatatacttctattttaaggcagaagctatagggaaacaaagtttttctcaacataggtgagcaatggaatgggatggtaggaaatctattttcaggaggcaaggatggtagtattcactaaagttactttaacatcgaatgcaactttagtttagatgattattaaggtcttcctgaccctttagtatatggactgtatttaaagaactttagtgtatttttttcactattcataaatgatggtttggaaagtgtttgttgccttgccttagtcttccggaagatgggtcatgattgtgcagtttgtgcaatggctagtgtagaatgggcctccttcaataggaaccggcagtttaagacttaggccatggcattaatgctatagtaaccttccattcttgtcgggctctttgaagtagctaaagaccaatggcataaaatagcaaattcaaattcaagaattgaatttctgtttagcttgctatttccaatactaattattcatttcacatagggcttttgtctaggttagaagccttacttaaaaaaaaaatctgaatctctcaagtccttttatttcacaccagtgaacttccatattctaatagtgcaaacgaagacaaaatagggtgagtggatgaataagaatcaatagtataaatggagaaatccgatttcaaattggactttcaagtgtattgaaatgcattgtgtaagaaatctatgtaagatgcttcttaatatgttactactcacagattataacatgatttaagttgttggaaaagtttaatagatcacagcagatggtatactatctcagacccattttcctgccaagtcctcaactgctgaagaaaaggagttacttgtgataggggtattttcctgtcatcccttcatacaaaagtaagaaatttcagggttaaggataactcattcaggaatctatgtttactgatgagattttaaaggaagtcatgccatgtgaaggggatgcacttaagcataaggattattgaaaagcattaaaatattaatctagcttttaaaagcaatgcttttatctctgagtgtaaagagagtgtttgcttattcattatcttttcattctaaatagaataaatcacttaagaattaaaaaagaagcaactcatctttttcaatctataaaggaaatggttgaataaattaactacaaaagccaatattttcatttctttttatatttactgggcttcaattttttatttagagacttaccttagattcttaatattcaaagatgtgttaatttaacctaacacatagataattttgctctaaataaaaacagcataagtgtgcattgtttttgatgacaggaatattcccagtataaatttgtgaggatctgtccacttgggaagactcaacttacacaaaaagaaaaacaatataaagtaactaagatatatgaggttcaaaggtagtacgtactctggagtttaaagaaagaaagaggttgttgtgagctaggttagtggagaaaactttttgagaaatgtaggatttcaacaagatggtaaaggaagaccaatacttaaggaaaagaatggaatttcctatgtagttaataagcagtgttaagttgtggacaggaatggaaatagtgtcatatgggggaaacagtaagtggaccagtttgttagagaacaagaattcatattaaaaagtagttgtaggccaggcacggtggttcctgcctataatcccagcactttgggatgccgaggcgggtggatcacgaggtcaggagatcaagaccatcctggctaacacgatgaaaccccatctctactaaagatacaaaaaattagccgggaatggtggcacgtgcctgtaatcccagctactcaggaggctgaggcaggagaatggcatgaacccgggaggcggagcttgcagtgagccgagatcgcgccactgcactccagcctgggagacagagcgagactccatctcaaaaaaaaaaaaaaaaagtagttgtagaaaatgttaaaatatactagggtcagatcatgaagtgctttaatgcaagtaggcagtaagaaccactggttttttaataggggaatgagaatatgtggaaaggaatatttttcaagagagtgttctgctggcagtgtggaaaatgttttggaggcacggagagcaactagaaagttcttgccttaacccaaatgtgacaatgagggaataacatagggtattgctagcatcgtattaataaaaagatgcaagagagataagacttggtagctgtactagatttaggggaaaaggaatagcttaaggatgactctcagtcacttagacttaaaacccatgatccattcctttgacagaaataagatagtgaccttaattctagctattctccagtgatcttgaaaggatttatttcaattagctttgatacataaaataaaaaattcatcattcacttttctgatgaagctggaaaattaatctaaataatgtaaaatataaatcactactttaattacatacctatgtgtcttctaaaaataaatcctacatctgtctgagttatgaagaatatgtattaagggtaaatcaaacaagtatacattctttacagaaatattgattaaattgactcttcctgattagtgatttaaattgacatgatttattccattcatgcaaagattctgtgccctctggggggtctgtctggaatagcaaagcagctcactgacagcagtgactggaatattgccaagctagtcccagagctcagcctactttgtttagaaattaagcaaatggaaagtttcctgaggttctcttacaatgcaagaatgtatggggtttcatttgtgaaccaacagggagttaaaaagcaggaagtcaattatatattaagtctcacattgttctgtaattgttttcatcaattatatttttagttgtatatttttggccaattcgcttgtgtcaattacatatacttccttatattgttgtcaaattgtttcatgtgcatcagtcatagcattcctatgtaaactggaaattccccagggatagggaccatgattctcttttgtttcccccaggaaatagcaagagacctggcacatgttttgagtgttgaactagaataaggtatttcagaatacttaagtctaggtctgtagtactattgtggatcccctaaaacactttagattccacaatagcactgtgaatgttgacttaaagcagtagcatgactttatattccttatagagttgtttccagggacactgttaatgtatacagtcattcaggatacaaactagaaagtagaaacatacacttatctttaaaatgagaggatctaactgattcatggcctgttcttggcttttccacttgtgtctaccaattaaactctttggactcaagagtttttctacctgcaaaatgggatagtaattcctacctcggcaacttgttgtgatgattaaatacaatatcatgtcaatatcctggcagtaccagttccttggagtgagaacaggtaacctgttgtccattttcttggaatgtgctacagggatgacaatgaatctttctgcaaatctattcagaaattctggttctgaggagtagtatccatgactgatatgataatactaaagttctgtcaagctctaaaattctgtgattataattttcattatcccttttcatgtgtattatatattgccatttagagtaaacaaaatgttttcccaaccccttatctcatttgaccctcacaactgaaagaaatgcatgaaaagctttagcttattcattgagtccttaatatatactacatgagtacatgtgttcaataaaaccactgagtattggtgatactggtaatacatcattgatacatacagatgaaaatttctgctttcatggaattcacatactggtggattgaaatctgagtgaagaaacctggattctagttctgttgtagctactagctcactagttgtgagagaaaatgtgtatatgggtattcatgtgtgcacatgctcttacctagatgctttcacaggatgcttattgtcttgaagagaacactggtttcaactttacccattgtcagagtttacaaaacacatttttaaaatgcgtacaattgcactgggctctgtttggtggcaactgtgggcagctcttggaaaagcttcttttctaaaggaaggacctggggacaattatttacccttttttatagcatgttttttttcttaatttccttttcttttattgaatattggatataggtatatcttttttgtgtgtagcatgttattttatatatctgccttatgttttgtttttgttttatttaaatgttggacttaatgcagagtaatgtggaggctctaaattgtttgcttccttttgtttaattaaggctatgccatctacttattccacctccttaaagaatctcaattaactaaaatatttcttttccaagtgttttctcacctctcttctttaacctcacatcatccctaggaattttgtgcctgttattatgatttctgtttgacagagaagaaactaaggtataaagaaagtaaacagctaggccagtattctctgggataaaaagcagtcaatgttactcttagacttgtgctttttttcactacagcaggttttccaagttcagcaccaatcacattaggagaaaaggctgcagttgcactgatcttggaatcaaaagatttggtctgtgcccctggttctgcctctcttatgaccttggacaagcatttaaggtctctgagatcctacaaaattgggtaaatgccagcttttcttgaaactgtctctcaaacttttctactcttcagatatctttctctaatatcatcttctttcctctgattttcttgtacttagcttttctttcttctatttttcttcctgagactttctctgtctgttgcagccctgactatcttttctggcctgcccctcctcctattggtatcatgttatcctatgtaatatttatctgatcagtttcttgcattatctttggatgaagagaaagtaagcctcatttggcatctttataaaggatacagtaccttaattgattacttgtcagaaagaatataaaatattaaacacgatgaagattaaagattccaaataagttggtaaaaatctattttactttaaggaactaacaaagaagtttatttaaataaatttttttaatgaagaggccatcaagctagggaaactatgtgttaatttggtgttgggagagatatatgtatatgtgtgtatagtttcaattaagtttggatagtgtttgtatatgatatataaattgtgtgtaccaaatgagttattgctagtgattaacagtgaataaaataacttctaagatgtgttagttactatttactgaggctgaatgctagaaatactgatagcatgaaactctatttcctaattattctcagagtccaattctgccttctgtctaatcttcactaaatcacagcagcatatttttcagcaaattgtgaaactcaggtaacctggttagaggagaaaagattaattgaatcacataaatattctctttgaagctagacttttcttcctcttatgttcagatgggaataaatcatatccacccaccccaccttacttagagagttttctccatgcctggaaggcaagggcaaagaacacagagatttcctgtctacagtcacttaggagtttagcatcctgggacactgtgaggaacaagggaatcttgttactgtgctgtagggagcccagaaagggggaacctagttttatgatgcaactggtttcctccccaagtttagggcatgtaggttcaaagaatgtaatagcctacaggctcagaaagatggctaggtaaatccagcttgtttagaagaatgattgacttttgcccacagcaggtaaactcagtctcgttcctgactgctagtctcttcagtctagactgtgtgacagttgctactagctaaggaatagagctacaagtgaatattttaagctgataaaggatttgggtttgtctgtaagattacgctaaatatgtgaattgtggttttaatgttagacataagagaataccatcaacaatgagaccttgaaatgcagacttcaactttacttcaagtgggacgttttcttatgttcttatgggaaggagccagtcccacgtcacatagcctacagatggaatgcggaaggaaagggaaaatggaaggggaagtcatatttggagatgagattggaaggtagacaatgtaagccttatcttagaagacctttattgccaggctgaggggatctaaacttcattgtatatacaaacaattggagaaagccttgtgatctggactgaaaaggtgtagaataatgcagctttagggtttaaacaagcctggctttgaagtcctctttctgatacttactatgggctcttagctatgttgccccttctttcaaatgcctcacttttctctcttgtagaatatggatagtagtaatttcccttgcatagctgttaatactaaatattgtaaatattaagtgagataatatatataaagtccagtgcctagcgttgtaggtactcagtgaatagtagctattatgagtaatccttggacctcattacagccctttgattccagtttggtaattgagctttagaagaaacaaatgaggttgctctctgtttagtcgttaagtcactttcaatttgtacagcagttggtaaccttcattcatattattccatttgatctttagaatgattcttcgaagttgttaagatcattgtacacaagaaaaacctgaggcccgtacaggaaatggattacttaaggtgacgtaacaatgtcagagctaggactagaacccagacagatttcctttttttttttttttgtagagggagggttttgccatgttgctcaggctggtccctcactccctgactcctaacctcaagcagtccacccgcctcggcctcccaaagagctgggattacaagcgtgagccacctcacccggcctagaacccaggtttcttaatgcttttactcccaattcagtgctcttactcttaactggagtttaggtaactttgacttttacttttttctgtcaaacctatggtagaccacattgtgtagcttttaaagttaaagctacttgaatgacaaaagattaggctacacagtaatttacataccaatgttgtatgttacttatggtaaatccactagaaagcccccatccctacatctccctatgttttatccttgaagtctagcatttattaaaacttaaatataaataaaaaggcttcttactcctgagataagctttctgcagttgtaatttgctaaaaaaatattctaattacaaaggattgcaactttcaagtagtacaaggatgattccatttataatttgcaatcattaatcttactctgtctagagaagaaaacacgtggaagtttccttttttcaagaataccaaagccatattaatatattttgtttcttcctcttggtagatcttgctctcatagaactattttgtaatcctatttaaaacccagttgtactaataacggtcctttgagtttcccgggttccactgtttattactcagctcttatttctgctcctttgcatgcagtaaaccaaacaccctcattattcagccaaataatgagtatctactgtgtgctaaacatcacacaagatgcaagtatgattgatactggactgtgttgaaacccaagtactctgggtatgggtgttggcaggggctgcagaagcagtttgtatcatagtaaactagaaagagcaatggatttggcatcaggaaacacgaattcaacctctagcatgtcatatgactcagtttcttcatctattaagtgaggctactaaactaaagtctttgcttagcaatttttgggccaacattggcccaaaattcttggttgggtgcatcaaaacttttaagctaaacattgtagttctgaaggtgaccagttcctctgcaggttttgtaaatgaataaagaaacacaatgcaaagacagttctctaatttgtctagggatttcatgttcagatttcctatgagtgcaggatcagccaggctccatgcttgacagattgcagctcatattccctaaagtagacagttgcctttgccttcatctgggcacaagacatggttctacaattttaattgcattatgacttttactttttatttttattcctaatggaaataatggtctgggtgtgacaagggaatgttaagacttatttttttttaagcagtgttttagtctgtgctgctataacagaataccagactgggtaattgagtaggaaaagaaattcatttctcacacttctggaggctgggaagtccaagatcaaggtgctgctctctggtgaggcccttcttactgtgtcttcacatggcagaagatcagaaaagagcagacccactcctgcaagctctttttataacagcactaatccattcatgagagcaaagcctagagccccaatgaccaaaacaccttttattaggccccacttcccaacactgttgcattggagattcagtttccaacacatgcattttggaaggaacaaaagcattgaaatcatagcatgcaaaaaccgcttccctcctccagccgttaaagctcctttccattccattttaagttgaagggatcatctttatttagaggtgagatagctttggaatgttatcagtaaaagctaatagagcctatatatgttaaagaaattgaatcaacaattaaccttccaaaacagaaagcaccaggcccagactggatcaccagtgaattctaccaaacttttaacgaagaagttataccagttctctgtaatcgcttccagaaagttgaggtagatggaatacttcctaacttattttataagaccagcattacactaataccaaagccagacaaagacattacaagaaaggaaaactacataccaatatctctcattaatacagatgtagaaatcctcagtaaaagattatcaaattaagtctaacaatgtacaaaaagaattatacctcacaccaagtagatttttttttgagacagagtctcactcactttgtcacccaggctggagtgcagtggtgcaatcttggctcactgcagcctctgactcctgggttcaagggatcctcctgcctcagcctcccaagtagctgagattacagtcttatgccaccacacctggctaatttttgaatttttagtagagacagggttgtaccattttggccaggctggtctcgaactcctgacctcaagtgatctgcccaccttggcctcccaaggtgctgggattacaggtatgagccactgcacccagccccaagtagaatttattctaggtttacaaggctggttcaacatttgaaatacaattaatgtaatccatcatattaacagaaaaaaatcataagattatatcaatagatgcagaaaaagcatttgacagaattcaacacctattcataataaaagctcctagcaatctaagaatggaggggaacttcttcaatttgataaaggacatttagaaaaaaacctacagctaaaagtatactgaatggtgagaaactacatgctttccctctaagactgagaacgagacaaggctattcactcctaccactcctattcaatattgtactggaagttctagctaattcagtaagacaaggaaaagaatgtcagcatggtggctcacgcctgtattcccagcactttgggaagccaaggtggaagaatcacttgaggccaggagttcaagaccagcctggccaacatggtgaaaccccatctctactaaaaatacaaaaattagctgggtgtggtggcacgtgtctgtaatcccagctacttgtgaggccgaggcaggagaatcgcttgaacctgggagatggaggttgcagtgagccaagatggcgccactgcactccagcccaggcgacaaagcaagactccatgtcaaaaaaaaaaaggctgagcactgtagcatatgcctatagtcccagctactcaagaggctgaggcaggagtattgcttcagtccaggagtttttggtatgatcacactactgcactccagcttagatgacagagtgagaccctcaaaaccaaaacaaaagaaaaacaataccatttacattagcatccaaaaaaggaaatacttaggtataaatctaacaaaatatgtacaaaatctatatgagggaaactacaaaactctgatgaaaaaaatcaaaggagatctaaataaatggagatatttcacgtacatggataaaaagactcgatgttgtcaagatgtcacttcttcccaacttagtctttagattccacacaatccaaataaaaatcccagtaagttattttgtggatatcaacaaagtaattctaaagcttatatgggcaggtaaaagatagaatatccaacataatgttgaagaggaaaaacaaaattggagggctgacactatgcaattataagacttactataaagctacagtaatcaaaacgttgtggaattggcaacagacaaatagataatggaacagaatagatacacaaatacagtcaactgatcttccagaaagctgcaaaggcaatgcaataaggaaaagatagacttttcaacaaatagtttctgggacaattggacaaccatatacaaataaatgaatcgagacacagaccttacacctttcacaaaaattaacataaaaagtatcatagacctaaatataaaattaaaactattaacctactagaagaaaacataggagaaaatctacgtgatcttgggcttggtgatgacttttatttttaaaaatagattttatttttttgattagtttttgatttacaaaacaaaataagcaggcagcacagagtttctatataccctgcacctggtttcccttatagtatgatacatttgttacaattaaggaaccaatattgaaacattattattaattaatagctatagagtagtcagatttcctgaattttttataatttcaacttttatttcagattcatagggtacatgtgcaagtttgttacatgggtatgttgcatgatgctgaggtttgggatacacttgtctcatcacccaggtactgagcatagtacccaatagttagtttttcaatccttgccccactccctccgtcccacctcttatagtccccagtgtctattgttgccaggtaataactttttagataaaacatcaaaggcgtgatccatgaaagaaaaaaaacggtaagttgaacttcatttgagtttaaaacttctgctctgagaaaaacactgttaagagaataaaataacaaaccacagagtgggaaaaaatatttgcaaatcacgtatctgataaaggactggtatccaaaaaatatatagaactgttaaagctcaacaataagaaaacacacagcccaatgaaaaatgggcaaaaaaaaaatgaatagccaaagcaatcctaagcaaaaagagcaaagccagaggcatcgccttacccaacttcaaactatactacaaggctacagtaaccaaaatagcatggtactgataaagaaaacaacaacaacaaaaacagacacattgaccaatggatcagaatagagagccaagaaatgaagccaaacacctgtaatctctgatctttgacaaagttgacaaaaataagcaaaggagaaaagactccctattcaataaatggtgcttggaaaactggccacatgcagaagaatgaaactggacccctacttattaccacatacaaaaattaactcaagatctcaaactacaaaaatcatagaagaaaacctaggaaaaacccatgtcaacatgagcactggcaaagaatttatggctaagacctcaaaagcaattgtaacaaaaacaaaaatttacaagtgggacctcattaaactaaagagcttctgcacagcaaaagaagctatcaacagagtaaacaggcagcctacagaatgggtgaaaatatttgcatactatgcatctcacaaaggtctaattcagaatctataaggaacttaaatcaacacgcaaaaagcaaataacccattaaaaagtgggcaagggaggggtggagcaagatagccaaatagaaggctttaccaatcattccccaccacaaggacaccaatttaacaattatgtacacacacacacaaagcaccttcataagaaccaaaaatccggcgagcactcacagtacatggttttaacttcatattggtgaaagaggcactgaaaagggcaggaaatacagtcttgaattgcagatatgacccctcctctatgtcctggcagcagccatggggcatgaagaatctggggtttgaaagagggagagcacagcgattgtgagacattgcattgaactcagtgcttccccatcacagcagaaagcaaaaccaggctgaattcagctgattcccacccacagagggagtatttaaattaatcctagtgagaggggaatcgcacatctagtggttggaacttgagttccagcaagcctctgcaacacaggctaaaatgctctggggctctaaataaacttgaaaggcagcctaggtcacaaggactgcaacacctaggcgaatccttgtgcagaactgggcgcagagccagtggactgggcagtactgagacaccagctggggtggttaaggaactgcttgcaacaccccaccctcaaccccagactgcgcagcttgtggctacaaaagagacccattccgtccacttgaagagaggagagggaagagtgggaaggactttgtctagcatcttggataccacctgagccatagcaggataaggcagcaggcagagtcatgaggcacctggatgacattttgaaacacaacctgggccaaaaggaaacctgctgccttcaagggaaggacacaatgctggcatgacccatcacctgctcaggaaagagcccttggaccttgaataaccagcagctgtacccaggtactatgccattggccttggatgagactctgagactagctggcttcaggtaagactcagtacattcccagctctggtggctatgggaagagacttcttttacttgagaaaagtggaaggaaaagtaatgcagactttgtcttgcaccttaggtgaggcttgcaaatactatcttttaacccattattttaagctgataacaagttaacactgcataaacaaacaaatgagcaaaaagaaaaccaataaaaactctattccttaacttcatctcccgagtttttaactttttgttcttttatatcttattgtactatctatatcttcaaaagttgttgtagttattattttttgatttgctcattgttagtcttctacttaatagtaatttacacaccacaattacagttctataatatcctgtctttttctgtatacttactattatcagtgagttttataccttcagatgatttattcttgctcattaacacccttttctttctgattgaagtactccctttagcatttcttgtaggagaaatctggtgttgatgaaattcctcagcttttgtttgtctggaaagtctttatttctccttcgtgcttgaaggatattttcaccagatatactactctagggtaaaagtgtgtgtgttttttttttccttcagcactttaaatatgtcatgccactctctcctgacctgtaaggtttccactgaaaagtctgctgccacactatttgagctgcattgtatattgtttgtttcttttctgtttctgcttttaggaccctttctttatcattgacctttcacagtttgtattatttatttatttatttatttatttatttttttgagacagagtctcgctctgttgcccaggctggagtgcagtggcgcaatctctgctcactgcaagctccgcctcctgggttcacgtcgttctcctgcctcaccctcccaagtagctgggactacaggcgcctgccaccacgcctggctacttatttatttatttatttatttttgtatttttagaacagacagggtttcaccgtgttagccaggatggtctcgatctcctaacctcatgatctgcccgcctcagcctcccaaagtgctgggattacaggcgtgagcccggcccacagtttgattattaaatgccttgaggtagtctttgggtcaaatatgcttggtcttctataaccttttgcacttaaatgttgatacatttctccaggtttggggagttctcgttattttccctttgagtaagctttctacctttatctctgtctcttcctcctctttaaggccagtaattcatatttttcctttcgaggctattttctagatcttgtaagtgtgcttaattgtttttcattcttttttcttttgtctcctctgactgtgtattttcaaatagcctgtcttcgagctcacaaattcttccttctgcttgatcaattctgctgtgaaagagtctgatgccttcttcagtatgccggttccatttttcagctccagaatttctactttattctttttaattattttaatatctctgctaaatgtatctgatagaattctaaatttcttctctgtttgcttgaatttatttgcatttcctcaaaacagctattttgaattctctgtgtgaaacgtcacatatctctgttgctccagcattggtccccggtgccttatttagttcatttggtgtggttatgttttcctggatggtcttgatatttgtagatgttcatctgtgaacattgaagagttgtatatttattgtagtcttcgcagtctgggtttgtttgtacctgtccttcttggaaaggctttcgagatattcaaaaggacttaggtgttgtcacctaagctctatctactttaggagacaccccaagcccaataattctgcggcttttgcagactcttagaggtaccgccttggtgatcttgaataagaatctgaaagaattctctggattaccaagcagaaactcttgttctcttcccttactttctcccaaacaaacagacactctctctctgttctgagccacctggagctgggggtagactgacacaagcaccccgcgtgaccaccaccactaggactgtgctgggtcagatctgaagccagcacaacactgggtcttacacaaggcctgctgtaaccactccctggataccacctatgttcagagtacctgggactccacaatcaatatgtggcaaaagcacccaggcctgtgtcctacccttcagggtggcgagctccccacaggacccaggcaggtccagaggtgctgtacaggtgccagggactagagtccaaaaccttagaagtctacctggtgttctgttgttgcagctgagctggcactcaaatcacaagatacagttcttcccactcttccctcccatttccacaggcagaggagcctcaccccatggccaccacaaccacaggcccacagggagtactgccagactagcaccaatgttcccttaggcccaagggctcttcagtcagcttgtggtgaatactacctggtttcagactctcctttcagggcagtgggctctgctctggcccagtgcaggtccagaaatgtcatccaagagccagagcctgtaattggggaccctgatagttggcttgatgctctatgcccctgtgggcaagatggtatctgaggtgcaagacaaagtccccttcacttttccctttgcttttctcaggcaggagtcttgccctgcagccaccaaagctgggaatgtgatgagtctctcctgaagccagcaagtctcagagacccatcaagaccttcagtgtagtaccagggtaactcaagggctcttcagttagcagctgatgaatgtcaccaggactgggttcttcctttcaaggcagcattttcccttctggccttctagacatctggtggatgtctagaaatgtcatccaccatcttgctctgacccctccttggtgtggccattttggaaggcagtttgacagtttcttacaaagcttatcatattcttaccatatgatccagtaatcatgctacttgtatttatccaaatgagtggaaaacttgcatccacaaaaaacctgcacgagtgtttatagtagcattattcataattgctcaaacttctaagcaaccgtgatgtcttctaataggtgaattgataaatacactgttatatccatgcaatgaaatattattcagcactgaaaagaaatgagctatcaagccacaaaaagacatggagaaacttgaaatgcatattgctacatgaaagaagccaatctgaaaggctacataatgtatgattccgactatacgacattctggaaaaggcaaaactatggcgacaaaaaaaaattcagtggttaccaggtgttttgggggaagagagagagggatgagtaggtggagcacagagcatttttagggcagtgtaactattctgtatgatgctgtaatagtggatacatatcattatacattcctcaaaacccatagaatattcaacacaaagagtgagtcttaatataaactatagactttagttaacagtctatcaacattagtttggggtgggggaaaagaaaaaaattgctaaataaataaaatttagtaataacttcactaaataaattctattgtatggcctatctatacaatagaatatatttttaattttaattttttaaaaatagaatattttgcagctattaaaaaaggatgatacattatggaaagacaaaactatagggacagaaaacaggttagttgttacttaagaactaggggagggattgactacaaaggggtagcttgagggaatttttgggatcacggaactgttctgaattgtgattgtggagtgattatcccactgcatgtgtctgtaaaaactcatagaactgtacaatgaaaaattatttttactatgcgtaatttttaaagtaaataaaaataggatggggaattttaaaaagctttttataaaaaaaaaagctagtagtagccttccaattgtgaaagttctcacagcacgcaagggcattattttcagttaacaaatgtttcacttagactcagattactcaggatagaagggtccttcaagatcactaaagcccctacatgcaccctcactttacagagggagaaacaggcccagaaagaagggagtttcccaaggttacatgcaaattagtggatactttgtgtagtttcagtcttttgacatttattgagaattattttgtggcctaacatatatggcttgtcttggagtatgtgtattctgctgctgttgggtctggtgttctttgtatgtctgttaggtcttattggtgtttaggctttctattttctcattgatcttgtatttagttgttctgtctatcattaaaagtggggttttgaagtctccagctattattatagaaatgcctatttctcccttcaatactatgagtttttgcttcttatattttgggcctctcttgttaggtacttaacaagagaggtgtttataattattatgtcttcttgatgaattgactcttttatcaatgtataatgttcctggatgggcacagtggctcatgcctgtaatcccagcactttgggaggctgaggcaggagtatcccttgagcccaggaggtcgaggttgcagtgagccgtgatcgtgccggtgcactccagcctggacaacagagcaagaccctgtctccaaaaagaaaaatgttctgttacttgttttgagagttcattattgttcattatttgagctagatccctcaatttgaggaagtatgtatttgtttgtgtatatgtgcatgcatgcatgtgctgctgaccagtgtggtaaatagcgtggggctactctacttggtctttaattccatggaaaatgagaaacttttttttaatttttaatttgatgtatgtatgtatgcatgtatttctttatttattttgctggcagctctaaaaccagcacaaattgggatcataagctccctattctaataagatcttgtagttgagaatgagtcaggggactcactgtgaaggagaccaggtctttattgaggcctttgtgaaaatctctgctacacacagataacaattgaaatccaatttacttcacactcaacaggaagtcttagttttattgactcaacaactagtcaataaaattaaaaagcattagtggccaggtgtgatggctcatgcctgtaattccagcactttgggaggctgaggtgggaggatcacttgaggccaggggttcaagaccagcctaggcaacatggcaagaccccctccctacaaaaataaaaaataaagcagtaccaatttgagaattttcttcattgttcccttgtttcactgtcatcttttttttttttttactttattcctttttctttctctggtttttctccaactgttctattttccctgttttctttacatctttccttttttcttctctacttccccttctctttaccctttcctcccatgtatctttctctctgatttctccttttctgtattattctctttaccctgtgactgttgcattactggacactggcagtgagactaaatattttaagttagcatcaatagggatatgttaatagaagacataactataattttgtttctttgtgggagaaatatacacattaaaataaaaggcctatactctattgccatctaattggagcttctgtgctggcagaaaatgcactggaaaaaaagtaaaccaaaattacttgataagaaaagcatagtagctaggcccaaatgtccaccttgctctttattagaattatctaaatacaaagatgaaagcaagactcttctccaagaaacaatctctgcaaaaagcccctttggcatcaaagctatgaactttacgggaaagccagagtttctcaggttgtgtgccatatggatagtttggcctattataagttttgattgagagaagaatgcaatataaaagcagctattgggtttaagcacagctaagtgtggtggttgcagtgatagtcttgagtgcctttctgagttaggcactcttttattattttgttttggttttttgttttggtttggtttttggtgtttttgagacaggatttcaaaccatgatggtttgctgaatagatcaacctgtcacctagttattaaagccagcatccattagctattcttcctgatgctctcactccctcaagaatggcattttgaaggtacttgggtttactggcaatgtgtccttgcttagccagtgtggctggatggccagggcttgacaagaagtaacatttcttggccatagaaattcaagtttttgttcactttctgttcttcttaaaccccacctttagattggctttcacgttgccctcatttcccggagaacactgaatacttcccaggaaaagaggcttatgccatgcacagttccatccttcttcttactgaacccatctctctgggattgctggtgattggaattcacatggaacattctacgttgagcttggtaaagcagctggttttgttaagaaagcccaaggaaagctttggcctctgttcccacctcccacacagtcaaaaagaagcccagtctaggtagagctgaaagggcatttgaacaccatctagttccactcctcatggtacagatggaaaattcaagcctgaagttgaaaaaaggaacttgcttaaggtcacacagttagataatggttaccttctgacttcagaagactgttctcctccctaattgtatgttaaggaagaatctgacagacatctgtttaaactattaactctgtgtgtgtgtgtgaacatggtttaatttttaaactttatttgagatgacttttgtacttacagaaaagttgcaaagctagtacaaagagttccaatataccgtttgcccagtttcccctaatgttatcatctgtacattactatggtacatttataaaaactaagaaatcaacactggtatattactattaactaaactccagacttcattcagatttcaccagtttttccattaattatcatttttctaaaatatcaggatccaatccaagataatacattgcatttaatcatcatgtgtccttagtcttctctggtctgtggcagtttctctgcttttccataacgttaagatttttaagagtactggtcaggtattttgcagaatgtccttcaatttgtggtagtttgatgtttttcttatgattgcactggggttatagattttggagaagaatctcacagaggtaaagttccattttcattacattatttcaaggcgcacataatagcctttaacaagacatcactactaattatcacatttaactttggtcatttggttaaggttgtgtttgccatgtttttgcagtgtaaagcaactactttttcctttttcattctctattctttggaagtaagtccagcccacacccaagctctacctccttgaaaggggagtatctacatacattatttagaattcttctgttaggacgatatgtcttttctccaccatttatgcatttatttgatcatttatttatgctgtatatgtgggctaatatttatttattttatactttgggctttaatccgatactaccttatctattttgttactcaaatgctcctgctttagccattaggaattatttcaggttggttcctgcgtccctttaaacacatgccctcttccttttatctttttagtacttgctaattttctggtactacaagatactccaggctcatcttgtgttttccctgacctagccctagaatgaaccatttatccaaataactctggttccttttattggaaaatgttatttagaaaccaagatctaggagtggtcatttttaccaagctatcattgcttccagactttctcagtggacataactgggtaatatatgtttgtttatgtactaacctttgtatacatatatatctataatcatttgtgtgtctatccattgtgtgtgtgtgtgtatatatatataatatatataatatatatgtatatatataatatatataatatatatgtgtatatatatatatattatatatgtatatatatataatatatatgtatatatataatatatatgtatatatataatatatataatatatatgtatatatataatatatatattatatataaatatatatataatatatataaagctaaacatgagtttatattgatgtctctaactctaatccaatactacagggttcattctagccttcctttctttttatctgtaacttccccctataacaatgacaaacttagcttccactacccaccatccatttacttacttgttcaaacccagtacattcaaaccagtctcacaattgttcatctataccaccatgacaacagctttatcaactacagtacagtgtttatgtatggttatttgtcttttatctttatactttctagctaaaacacaatttttcaaagttaaatcagcttcgtacccccttcctcagtgcacttatgtcacacatttgtaatacagttagattcatttgtcacagtctgcatttcatcctgggatcctctgacatctggttgatgtttgcatttgcatatgttaaggctcattctttgtaaattacaggtctataggttttgacaaatgcataatgtcatgtgctcaccaccccaataccatacagaagagttccatcactctcaaaattcctctgtgaatcccctctgttatcaaccagttcccccacccctaatattcagaaactactgataagtatcccatccctatagttttatattttccagagtgtcatatgaatggaataatacaatatgtagtctttgggtatggcttctgtctcctagcaaaatgcatttaagactcattcatgttgtgtgaatcaatagctccttttatgtaagtagttccttttaaacactgaatagtattccattgtaagaatacttgtttatccattctcttgttgaaagacatcttgattgtttttagctttgagaaattaggaataaagttgctagagacatccacaagcaggtttttgtgtggatgtaaattttcaattcacttgggtaaatacctagaagtgtatttgctgtatcatatggtaggtctaacttttaacacaattcctttccaagaagtctgggttgagtatgtatgtatggtgcagtagaatatctgttcctgagctggactgaaatagtgatcactctcacaccatattccatgtggacggaaaatagaatatcaatgggatgggaggagccaagatggccgaataggaacagctccagtctacagctcccagcgtgagcaacacagaagacggtgatttctgcatttccatctgaggtaccaggttcatctcactagggagtgccagacagtgggcgtaggtcagtgggtgcgcgcactgtgcatgagccaaagcagggcgaggcattgcctcacttgggaagcgcaaggggtcagggagttccctttccgagtcaaagaaaggggtgacggacggcacctggaaaatcgggccactcccacccgaatatggcgcttttccgacgggcttaaaaaaaggcgcaccacgagattatatcccgcacctggcttggagggtcctatgcccacagagtctcgctgattgctagcacagcagtccgagatcaaactgcaaggcagcagcgaggctgggggaggggcgctcgccattgcccaggcttgataaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacacggcagggtattccaacagacctgcagctgagggtactgtctgttagaaggaaaactaataaacagaaaggacatccaaaccaaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacgaaacaaagctgggtggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaataagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcagtccaaccttcagattcaggaaatacagagaacaccccagagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacatgcttaaagaaaagaattttcaacccagaatttcatatccagccaaactaagcttcataagtgaaggagaaattaaatactttacagacaagcaaatgctgagagattttgtcaccaccaggcctgccctaaaagagctcctgaaggaagcactaaacatggaaaggaacaaccggaaccagccgctgcaaaatcatgccaaaatgtaaagaccatcaagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtactgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcagacctaatagacatctacagaactctccaccccaaatcaacagaatatacatttttttcagcaccacgccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactgcatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagggggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaacaacccttcaaaaaaatcagtgaatccaggagctggttttttgaaaggatcaacaaaattgatagaccgctatcaagactaataaagaaaaaaagaagaatctaatagacgcaataaaaaatgataaaggggatatcaccactgatcccacagaaatacaaactaccatcagagaatactaaaaacacctctatgcaaataaactagaaaatctagaagaaatggataaattcctcgtcacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggattagctggtaccattccttctgaaactattccaatcaatagaaaaagagggaatcctccctaactcattttatgaggccagcatcattctgataccaaagccaggcagagacacaacaaaaaaagagaattttagaccactatccttgatgaacattgatgcaaaaatcctcaataaaatactggcaaaccgaatccagcagcacatcaaaaagcttatccagcatgatcaagtgggcttcatccctgggatgcaaggctggttcaatatacacaaatcaataaatgtaatccagcacataaacagagccaaagacaaaaaccacatgattatctcaatagatgcagaaaaagcctttgacaaaattcaacaaccattcacgctaaaaactctcaataaattaggtattgatgggacgtatttcaaaataataagagctatctatgacaaacccacagccaatatcatactgaatgggcaaaaactggaagcattccctttgaaaactggcacaagacagggatgccgtctctcaccactcctattcaacatagtgttggaagttctggccagggcaattaggcaggagaaggagataaagggtattcaattaggaaaagaggaactcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcaggagtgaactcccattcgcaattgcttcaaagagaataaaatacctaggaatccaacttacaagggatgtgaaggacctcttcaaggagaactacaaactactgctcaatgaaataaaagaggatacaaacaaatggaagaacattccatgctcatgggtaggaagaatcagtattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactgtactacaaggctacagtaaccaaaacatcatggtactgttaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagagttaaacgttagacctaaaaccataaaaaccctagaagaaaacctaggcattaccattcaggacacaggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcatcatcactggccatcagagaaatgtaaatcaaaaccacaatgagataccatctcacaccagttagaatggcaatcattaaaaagtcaggaaacaacaggtgctggagaggatgtggagaaataggaacagttttatactgttggtgggactgtaaactagttcaaccattgtggaagtcagtgtggcaattcctcagggatctagaactggaaataccatttgacccagccatcccattactggatatatacccaaaggactataaatcatgctgctataaagacacatgcacacatatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagaacacatggacacaggaaggggaatatcacactggggactgtggtggggtggggggagggggagggatagcattgggagatatacctaatgctagatgatgagttagtgggtgcagtgcaccagcatggcatatgtatacatatgtaactaacctgcacaatgtgcacatgtaccctaaaacttaaaagtataataaaaaataaaaataaataaataaataaataaataaaagaatatcaatgggatgtcttcttctcctacctggaagatgaagtttctgcaaatgaccattagatggcggggtacttgctggcactctgagctggaagtctgggagattgtgggagactgaaaattatatcactctacccccttcccttttcttggcaaagggatattctagccacactcaggaaataaaatacctgatttatgactcctggcatgtacctttatactgcttcaggaagttaggcttgggtttcatgttggcaagtatcccaacagctaaatttgtgtaatggtaaactttaggttagataatgagttttgacctgaaatggggtaagcaacatcatgtcatgtttgtgccccttgctgacctcattgcaaagtaaaggaagcatagaaccttgattcctgggttctaatgccagccatctattgtcccaactctcttggcctcatattcatcatctttaaaataaggataatacctgcccattcatgctcacagggctgttgtcagagatcaacctaagatacataatgtgaaatatattgaaggactttataagtttaacatcatacaaatatgaatgattattaatgatcaaaccaaatagaatatgaaatactattgatattaggtggcatcatacattaataaatctgacttaaaaatacaatctgtttaccttgatcaggagaggtagatatttagtctctgaagtgatgcagtattttcctcagaacttagtgggtgggtaatttattattatctacttgtttaatttttggtgtagcagttacagaaaatacttgattccagattgaacgattttatagggtaattcctcaccctcataaaatccacattatttcaatttaccaagtaaatactggcacattcagtagatgttactattttgggttccaactggtactcatgattgactctggtgctctggatccagatcctttggtatgtaccaggggacagcaaacctcagttatagaggtggctttacctttaccctagaaatcatctgcagttgctctggttcaaagcttaaaggaaggtttgaggagtgtactttcaaggtttgaggagtgtactctctcttcccagcagtgcagaaaccaataatcatcaaaacattgtcaccataactgttgtcaggtttttttcaaccttgcccttgcatctcagcacagctctctcgcccaaagaggtaagctggggaaaacagaatctactcattgtaatcttttcagcttatttatctgcatttagaaagtctcaaccctctgggctcccctgcctgtcagagtcaaaaagaaaggccccatgtgtatgtgtgggcctgtatgtaagaagtaaggcttgaaggcatccttggcatctgtcatgtgacacatgcaatggtttgtaatagagtcagggaatcataggatatgacctgaggtgggaggtccagtttctacccttcattttacaattggggaaactgaaacccagaccaaaaagtaacaactaattagctatgtaggtcttgctttattattactggtcacggagagtgcatcttaacagtagccaaagaaggtattgatcaagtagagaagggacactgtcattcccatagcttcaatcttttttttttttcttttttcttttgagatggaatctcgctctgtcgcccagactggagtacagtggcgtgatcttggctcaccacaacctccgcctcctgggttcacgccattctcctgcctcagcctcccgagtagctgggactacaggcacccaccaccacgcctggctaattttttttcttttttttttttttttttttgtatttttggtagagacagggtttcaccatgttagccaggatggtctcgatctcctgacctcgtgatctgcccgcctcagcctcccaaaatgctgggattacaggcgtgagccactgtgcccggcccatagcttcaatctttatttttctccagtggaaggggcttagcctaactgaaaacagttgatgtaatttagggcatgggagggactagtgataggggtgtgtgtgtgtgtgtgcacacacgcacatgcacatgtgctcacgtgtgtgtgtgtgtgtgtgtgtacaaccttgttttcagttatctacttctctttggcctctaaattctacatattttccccttctcctgtcagaatcatttagtcaatatgtgcctttttgagtttgtaagtggaggctaggttaaagagtgtccttagtttaggaatgtcatgtgctcatttggctaggtgtgtggtgattgtgtgtgggggaatgtgctggattcagaatagtaatagttgcttaaaactggaactttttaatgagggagaatggtctaccttttttcttgcagagctcagttttattaatgtgatatgctgtgtgctagtctgtgccagaaagtatctctgtaggtaattgatctgcctcttcttcctttctctttagatattcccttccatgtatgataaaaaccaatcttggtgtgtttatctcttttttaagcactttatcaagggttttttccagctcttgaaaagacaacttgtatacccaccctccacactacactgtacaaccaacccaacattctctgcatagacaatcagtcttcttttctgtgtgatataaatctatgaaaactcccacacattatagtacaactggacttgctgattccaaaccctgagcagaaaaaccctctaggaagccattgccaaggataagattgattgctacactggcaggtgcctgcccatttccctcgctcagtggaaaatctggcccaccatgacaaaaaatagctcatcccagggccttaaaacccaccgaatgagattttagtgttggggataaaagcaaggctgtagactaactcattcatttgctttagtgttctctataaaatataaaacatatatttcataaacaccaaatttcatgaaagcagatttatttcataagttttgtctattaccttatctaagcacagtctcttcctccaccattctcaggacatatggcttagtcagacagactacacagatgaatgcagagtgttgagtgacaaagccagccctttaggcgtttggagcacagcaaggttatgttggcaaggccaggtcagacaaggctataaactttgcctttcatctttaccctaataatgccactgaacaaacccaaccaggatctttctcaaatccatgtgtacagtttttatttgtcagagactaagcagaatgcctgggggaaggcatgcataatagaactaatcattctttaaagtgtaattttccttgcctatgcattcttgtagagtttcagtagagcccttgacaccctaagatagaagtgaactatgcaaagggggaatgagtggagataacttgaaaaaaaattttttttttagttttacatcctcctttttttcatatggactttagacataaacagttaatgtctgtcagagctaaaaggtacctctgataccattttatctaccccttaaccacaaaaaaagattatatagggagcagttcagtatagtagaaagaacatgggatttggaaagaactgaattctacttccagctcaagccatttgatctcagtttctttatatgtaaaatggaggtggtaatcctcataatgacattgtaaagcaatgtactggtggcccccaatactatccccaggttcactgatttgctagaaggactcacaggactcataaattgttacaatcaggctacagtttattatatcaaaaggacagaaagcagaatcaataatgggaaaacgtacatcagtcagagaccggaggataccaggtgcaagcttccaagagtcttctcccaatagagtcacacaggttgtgcttaatcctccaacaatgaagttcagaaacatatgcaaagtgttttctgccggggaagcgtacttgagcctgaaactccaggatttttattggggtaactagtgactgaaactccatatcccttggaaagaaagcatgcattcaccataaatcatattttttgcacaagatacctagacaggctgttacagcatggttgaaagggcatacacaatgcccttaccagttactagaatagagaacattctaagacctcagttcccaggagctggccaaggaccagtcacacaagtgggcccttctaaaaatgtatacgatttgagcaactcaagactgctgggttaactctttctttcacagataggtattaaattattgtatgtgtgtatatatatatatatataaaatattgcatatacatacacacagtataaagcagtacattaaatgtgagggattattatacatatgagtaaagagagctagagctattctggggtgtgattaagtgcagtaagaatggaagtatctaagacaactctccagggcaatgaatggggaagctgtaaacaatcccactgaggattttatttttctctatgattagagataatttcgtcaccactaccattctgtccctcatcagtttcacattgtactttcttatcatagctatatatttcttgggatttttgcataagccaaattgtttcactacgcactgtggagttttggcaaggatgtgatcctcttaaggaaagtgcagaattgagcctttgcagaaggcataggcaggtgcttcctagaaaaccctgagcaagtcccaatgaaagactatggttaattatactataatcgtggtaactaataccaacagtgaattttagtctgaattgaattgaagtgaatttatgtgaacctaaatactattgaaatacgattttgagctaaatactgcactagatgcccagcctagcccaatcattttataaaaatttgccctctaaggatgacggaaatgactatagaaaggaagctcaggcattgtatgctaggatgtggaggggaacatcctgaggaagtgcacatactcatacctaaaactactgaaagcatttgccaagggtagcctgtactgcctgaactcaggtggtaatggcaccaagtagactggagaacagcttgagaaagtgggcatatcttacagatggacaataaacctcctgatggaactttggtaatggagtatttgttaatagcattttagctgctgtaagcctctttgtctgctttatacccccagagctgctgtagctctccccaaactcatgaatggggcctaaggcagctgcctttattctgcatgtaagctagagctggctcatttgtctacctggtatgttcttttaccctttacgttggagccatgtcaatggttctcctcaaattgaccctctgctgccagactttattgagccctatctgagactttttctgagccctctgctccaggtggccctaaaaacttcatatacaatgtaatgtaggctctttaatgtgctagcagaaaatgacagagattaaatggtggccctgccatcaagggaactcattgcttcttttgaaataaagtatttggcaggttttgcctagaattgagggatggaatcactcctttccctaccttatcttttcttaaaacagctcctacatttcaccccatttaaaatactagcccttgcatttgtatcacattctatacttttctaacactttcttatttattattttattcttacatattttcattcatgctccgaggccaagctcagatgctattttctacagagagattaattttaacttcctctgacctcttaaggaactttccatgatgctctcgtggtttttaaccatttttcctatttttattctaattatttatatatatatcatttattagactctaagatcctcaatggcaagatctagataggattcatcaacaacttacatatagcaggcaagcaatgaataataaagatgaaatagaatagaaaacaaacaaatgcttgaagcttagataactgcctctcatttactctaattactggaaggcctagaacttgaatcttcttctagtcctgtactgctatcttaaattctccaccacactgcctcccttacccaggccagatagcatttactcttcagaaggaaggaaattagctaagtctctaataatcaggaaaggctttaaggaggaggtagaccttgacaaatgagtataatgttactaagtgaaatgcagagcgaagggtattccagaattagcagtgaaagcacataaagagggtgggaggaagaacatggtctgtagagtaatgaggccaagcctaagaaccagggcagcaagaattgtttggggcaagtcttgaaaaccatacagaaatgttggaatgtgttgtagcaggaagtaagggccccatacagaaggccttatatgaaggaagggtctgtagtagggaggacttagggctttctggtctactggctcttttggaagtttgaaatcatggcagggacctaagaccctgaacctcctgcctcttgatttggtcaactctgaatgtgaagtatattttattaagatattctaacttgctcactagcatttaatgttagttgccaaatttccaaacctgagctcaaagggaactctcttacaagtttgaaagcatttcagaactctttttcatggtaataaggattttgcctggcctagaagaagctgccaactccagaggtctctctggcactctaactcagagaagtttaaagtaaatgtagctcctgagagagagtatgagtccttaaaccaccaacccctcatccttttaaatctctgggtttatcctctgggaaacactgtcattcagctactgttttgttcaggtctctcaagttcttgcctaccatccagcccttcagatgtctgtgtcatctggttagttccctatattgtgaggacttaacaaattttcagtcagtcattcagtcagtcagttcctgtcttgtcctccagaatatcaaatattgaaaaaccactggcctcaactaaactgagctacaccacaccctggtaaaagggaaaatcttagtataaatttcacatacacctaaggctttcacatacatttcacatacacataaaccactggcctccactaaactgagctacaccacatcctggtaagagggaaaatcttagtataaatttcacatacacctaaggctttcacatacacataaatcactggcctccactaaactgaactacaccacaccctggtaagagggaaaatcttagtatacatttcacatacacctaaggctttcacatacatttcacatacacataaaccactggcctccacgaaactgagctacaccacaccctggtaagagggaaaatcttagtataaatttcacatacacctaaggctttcacatacacctaaggcttcacatacacctaaggaaacctaaggcttccctcttgttctttctccctcttctcctccttcacctctccctccactcttcctctgatctctctttttcaaacgttatggtttgttgttccataccaactgcacatttggcaatagacaaaaatacaaaactcctgccctcatcgatttatgccactaacctgattcagttctctctaaaggagatcgtagcaacctctctcaatattcatttccagctaacattctcttactatttctccggagagcagtgaaactttatcaaagtctactttgtaacgatgccaaaagctggcctctgaaagctaaaaggagaagagctagaatgtggtaagtgggagctgggccctagcaacagaactgtgggaggcagtgtggaataatggaaggaccataggtctgaagacctcattttggacttaacagttgcccaggctttctatattctcacacatttatgtacctttagggtaaggataatcactcatatttgtctcatctgacagtacctatcacacagctcatgttcaggtgagtccccagggcccccactgtgctgtactctcccttccctgcccaacttctctgcaccttggattcatgtcttgtttctaccacttcctagccttgaggctttggtaggtttcttaacttctctgactgagtttgtttcatcttccctagaagagataatacatgcttcatagctttgttgtacagatcaaataaaataacagatatgaaatattttatagcctataaggtgctgtgaaaattttaagatggggctaggcgcagtggctcatgcctgtaatcacagcactttgggaggccacagcgggccgattgcctgagctcaggagttagagaccagtctgggcaacatagcgaaaccccatctctagagaaaatacaaaaaaaaaaaaattagccaggcatggtggcacacgcctgtagtcccgggagggactgaggcaggaggattgcttgagcccaggaggtaaagcccagtgagccatattcatgccactgcactccagcctgggtgacagagccagaccccatctctaagaaaaaaaaaaaaaaacagtaagatggttttatcagattagtcaacaaatgtcaaaaggcacacaatttttattacatccatgaaccatgcctccaactagatcatgtggtatatagagttccaggcctatttatagacccacatttgcttaggttcagttcatctgaacactgattaaagttaacattaggaaagacaaaaacctaacctttatctgtgtttgatacaaagaccagtagcaattacatcacttgaatgtggttagattttattttcctttggtattttggtgaagttcccaaacgaatgcccaggaataattacagcagactggctttggcggaggaagtatataaaggcaattagtaaaatgtaacaaacttaaatgataattgaacctacattcccccagccatttccaagtataaactatataaatctgtgtcccagattcaccaaatgaaatatttttgagggaatcaagcagcaaggatctagtgatcccttattgcagcccagctatgtgtttaggggcagggtatggtggtagatgtaaaatcctaaaagcctgctttccaggagctcatattctggttgggtctacaaaacagaaaaattaagtcttttgttagaagaaatgaaacaatctaagacaaaatagcatcaggtgtcaaatagtgtggagcaaaaggcattcagaaaagtagaggtcaaggtgggctgggcctttcagcttaagaaagacagaggaagaaggcagggagatcttgcctatgttgggaaagtaagggcaggagcctctgagttggaaagaacatgtcaggtgttgtgcatggtgccacgtaagactgctgaggtatgatagagccagattatagatgtccctgaaggcctggcaaaggagacttgactgtatatagtaagcagtggtgactcattgtgagttcttgagccaggagactgctgaaaaagtagtgtgttaaaaagcagcatgcagggtgaattagaacagagacagacacctactaccagaaacccatttgttagcttccattgtaagatgtggtcgtagtcatggaagaggatgattgaaaacaagatatggccaaagaaaagagaacaataagaacactggggcttagaaggtcagattacgtcttactcaatcagtcagaactctggcatcataggtgattttagtgaaaaacatatctatttgttggaaacaaatttttaactttaaatggttagcttataggcttaagatataagttcccagagatgaattggtgaatggcgtctgaacttgacctatttgcagcagcaagaatgtgcaagaatcttctccaggctttctcagagctggaggacccagcatttgtgttaatgtgactgggttaaaatgaaagcctttgttgtctctgaaaagaaattgaggaagtactgttaaaagatgatgagatcagccgggcacagtggctcatgcctgtaatcccagcactttgggaggctgaggtgggcggatcatttaaggtcaggggttcaaaaccagcctggccaacatggtgaaaccccagctggatgtggtggcatgcacctgtaatcccagctactctggaggttgaggcaggagaatcacttgaacccgggaggcagaggttgcagtgagacaaaatgtaatgtaaggtaaaagtgagacaaaaatgtctattgtgacctgaacatattggcctataatgatggtaaagctgtgtcactctgagaaagttacttaaactctctgagaagctttagagcttctcatttataatatagtaatgctaattcctacctgcttcacagggtttttgtaagggttaaatgtatatcaacataaagtttctagcacacagcaggtaattgcaccactgcactccagcctgggcgagagagcgagatgaaagaaaaaagaaaagaaggaaggaagggaggaagggagaaagggagatgagatccatggaggaaggaaaggagactttattttcagaggagatacaatctgtagatccgggagtgcagcttcagtacaagccccacagaaggggcaaggagctggggtcagccatccatacataattgagttaggttgggaaaaatctatgaatatttataagaggaatcaggcaccatgcacagtgggtaaacatgtatgtagcatgcatttcatgttcactttggggtgaggttttagtattaaaatgaggtggaatttggctctttacatctaaaggtgaactacaggacacaaagttcatgcacagtctttataagttggttgaaactggctcaaggtctgcagccatttatcagtaaaaaatgttcataagacaggtcctctgtccaatcagagctgtggtgggactgcaaggcaggggcttgggatagagagtggaggtcagtggattcaataggttggcatcaggcagtctatctcggtcaactgggaaattttccagctgtagttgtttcagtaatgctttttgggagctggtttctgcttaattacaggggaaaaagcttatggcagttaataacacagaaatacttaactaagccccaatcctgctggccatgagattctgtttttggtgtgtctcattttagccacagggagtccattttatctgtctgttggggcatattttaacagtacaaaagacaaactgagcaaaacaccagcacaaaaagactgtaaactaaggggaaattacatggaaaacgagaaaaatattgaagtagcaatgtattcttatagttactcaggaaactgctgttcactttgacacacacatgcatctcttccctccttaaactgcctatatgtgattcgatagtacagtagggaaattatatttaacagtaatttattgtatatttttaaatatctagaagagaaaaattgtaatgttcccaacacaaagaaaagatgaatgttggaggtgatggatatctcaattaccctgacttgatcattacacattgtatacatgtatcaaattatcacgtgtaccccaaaagtatgtacaactatgatatatcaattttaaaaatttaaacagggtcaaaaatgtctattctgacctgagcatattggcctataatgatggtaaagctgtgtgactctgagcaagttacttaaactctctgagaagctttagagcttctcatttataatatagtaatgctaattcctacctacttcacagggtttttgtaagggttaaatgtatatcaacataaagtttctagcacacagcaggtaattgatagatgttaatatccttatcattagaggggataggtcaacttagtgttggaacttaaacttgcactcatctaaaagcagcaaacatttcccccagcttgttgtttaagtagtcgctaatgtgtagaatttaacccagccccatcagcagctgctaaaatagcagcctgggtttcagtttacttgactgcatacaactgggctaaggttatgttggagaaatggtcagtaactagtaagtctaacgtataactggtcctggggaaatgccatatttttaatcttgaaaagtcgactcattcattgttatataagataatcctacttcctttttttgtttgttttttttttttttttttgagactgagtttcgctcttgttgcccaggctggagtgcagtggtgcgatctcagctcactgcaacctccacctcccaggttcaagcaattcttctgcctcagcctcccaagtagctgagattacaggtgcccgccaccacgcccaggttattttttgtatttttagtagagacggggtttcaccatgttggccaagctggtcttgaactcctgacctcaggtgatctacccacctcggcctcccaacgtgctgggattacaggcgtgagccaccgcgcccggccaagataatcctacttttctaggaataaagtgatcccactcctaagggtgatgtgactccagtttaactcattcatcttcatccctatatttccccatggaccttgattatggtgtagcttcacttggaaacgctcaagaaggaatgaaagataccatatgggaggcattgataatgagagctgtttattgccattcacctgcaaacactgtctgtgccgcctgttcatgcatatcagacacacaaacattcttcatttacttaaggtacatggagaaatgatgacatgctcacattttgggagaaattccccttctacttggatgggtttccttctttgttcaacagggccagaattttatctaaagggagtacaaaggccatgatgccttttccaggtaaaattctatatatcttgtccccttgtcctttatcacttttatggttaaatgaataagtaaatacataaaatgtgttttcagtataaataaatcatacagaaaataccaaataaatcacttgctgcaattaaatgtttggagatcattggctctaaggtgacacactattcttcacagtaatttagcaatgagcctactgtgacctctccatcaaaatggaatcaagtcacaatattgccttatctttctatggcttctcggtgacaacaatttgggtgactgcacagattttagtgtcagtaggtagagctgtcgctctgaggcaacaggattgaaccctagtccacttgggtgagattaggggtaagaagtagcagcaaactttgtcatgttaacccacctaaaaaatattcagcccttcatacccattggctggaaatctccagctccttaatctcagttcttcatattccaagaacctaagactgcctctctggtagagcaatcttggtagtgttcaaggcatcaacaaaatagcaggctctaaactgattctgtgatgtttttgcaaatggcaagatgccctttattagatagtctccataggggttctggatctttaattacttgatcatatttacggctctgtctttataataatactggccttcaccttttcaaggcccagtatcctggcaaaaacatcaatttggacatattatggaataggtggagatgagaatgccatatctgagtgtggtgcaattatttcagaattgttgtaaatatgctggaacattttgtgagaagaggtaaatgacagtacagaactggttgagacaagaaaattggaaaatgattggagcaaaaaatgaaaaggagctagaaaggaataaggcaggaagcaaggaataaaaacaacttgggtctgcttatccattagctgatgtgggggaaaaaacaacgtgggtcaggataacagtctcctttctccccccaaaaaaatattttaacaggggccagaatgacactgcttagtccataggtggcctaatagtggactcatttgatctaggcacataatgatatttttatcttagtatataatgagtggtaattaagctgtcactggcactgggaaaagatcaaaatgtgagtgtgcagttttcttcattcctcaccccataatggcagatgttaggagatattttgctgcacctctctatcctttgactcatcatcttactcactattcctgccttcttactggtggtatcttggcctttaaatgaagctgtttcctttggaccctagtgatccttagagttcagaggaaagaggctatgtaatatagtcagcaatatcatcacattcatcttattctcaactaatttttaaaagtacttacctaaagtatcaaagagctacagagcacattttaaggtgagctgtcatcttatttcttcacaaagaatgttttgagttgatatgacgatgtatcataagtgacaacagaatgcatgatccacagaatatttatttaaaactgactataactcttctaggctccaaaggtctgatttctttcaaagtagctgatgacattaagcactcttacattcattatttctctcatctgagcccccaacagccctgttaagtagaaatgacagggatcttcatctttattttacagggccacgtactaaggtgataaagccattactaaggtgataaagtaatatattattacttcccttgtccttagttttctcatctgtaaatcaagatgataattattttcctctcacagtgtaatgattttcaagtggtaggatggatatgatagttttattaaactgtaaagccctctataatcctgttaccatattcacttataaattccttaactttagttagaagtagcattggaaaaaataaaaagtatgactttctaagatgtgcaaaaagctgttcatagataagacactattgtgttcttttgataagtttgagccaacagaagtacctcaaataaatgccagctctcaattacagatgttcatcaagttcagaacctactgcaacctcttctctcgttttcttattttttttttttttttttttttttttttgagacggagtcttactctgtcgcccaggctgaagtgcagtggggcaatctcagctcactgcaacctctgcctcccaggatcaagggattctcctggctcagcctcccgagtagctggaattacaggcgcccgccactatgcccagctaatttttgtatttttagttagagacggggttttgccatagtggccagactggtctcaaactcctgaccttaggtgatccacccgcctcggcctcccaaagtgctgggattacaagcgtaagccaccgcacctgaccattacttttcttttaaaggatgttttatatgtaaagagttcaacttgattgtatagagcagcatataatgagttgaaggttgccctaccagtcttggggcgagtcagtccaccttgatggccccaccaaagactgaaccctagctctcagcccagacatctcaaaagcctgtgattgaatagcaggaccatgagctttgtactaactcaatgttaggtttgaatcctgattcccctcctgctaggcaggtgggcctgaaagagttacttaacttttactgagtctcagtttccttatatattaaaggagatagtaataactatcttgtaagaccattgtttgaattaaagtaataaatatatttaaagtgcttagtagaggatcactcaataaacattaatctttccttcccatattgtggacatatagtgtaaccaggtgagcttgtggatggatccttgtagaatcccccagtccccaactctgggagaaagtttttctgagagcatatctttaaaatggggcaggttacctacatcctatctgaatactaatgctagcactattatagatatacatgtgcagcacagacatcatttttaacagatgtgtttagttaagtaacagatttagaaagtgcagactttaatctatgttttctcctgagatttcatcaccatctgatttctttttttcttgctaaaaagtataattgtagcttgatttcccccaccccccagttatttccccaagaaataggggcctttttaaaaatttgaataagaagctggataagcatttgaaagacatgaggacagtggatacctgaagaggtaagaagttgaggactttaaagtaaaagccttaatgactaatatattttttcagaaggtcctgcttccaccatttctgcaaggaacagatgactctaaagatatcatatcaaggtctgctttctgcttgttgcataactggatggagtaataaccaagattgaaactgtcattggttaaaggagactaaatggagcaggtcatggaaattgaggtgtttctttctttccccaaggaggggctggagagaaaaagtagcagagacttttgtcatcagctttcaggggcagaaaacattggttcctctctcctctgacctgcctctccacctaaaaacctgaatggattctggattccacttcaggctgttttgagttttgatagaataagtttgttaagatgttggggaaaagcaaaatatggtcttccaggatagccctggtggggagaggtagaaaatggtgggataaaaagtaggattatactagggccatgtgaaaccatccacactgtagtggaggagcttgactgcatggcagaaggcaaggtttttcaatttatcctaaaccatatcccacaatgttccacggctctgtctccattcagcaaatatttgcagacactatataggctgtaggaactttatcattcccattgcttttggcaccacaaaatgtcttagagatcaacagaaaagatgaaggaaggacctgattgccccattcaggtagttctccccattcttgtagttctgcttagttgctttgagcactggtttctgtgtccccctccttgaattaccacaggatcctggggattccacttcacaatttaagagtatcctatcaggaattctttaaatggtactctgagtggtgaagagggagaagaagataagtactaccacttttgtggacccactatgagccaggtactgtacttctttacacatacacacacacacacacacagagtgagagttaaattttatttgtatgtaaaaattgtataaccatgtaagcctatgaggtaactattatttttattagacagataaggaaactggagcttggagagtttcagtgatttatccagcatcacatagctactaagtggaagacagagaccagaaagcagcctagtgatttcattcaatactgattaatttccctttctccccaccctcacctctacccagctccaaaagaagataacactacttaaatattagctattattatcattttcactattattattatattatataccgtatgcctttggaaccaaaataggtgtagagagaaagaaactaaactactaagccctgtactagacactgagagaatgtttagcagtaacaggtagctacttttagacaatatccctaaggttgatttaagactttttattccacagcccagattatacagctgaaatcagggatttcaaactaacctctaatgttagccaccaccaccaccttcatgctggagccattccctaggccaaaactacctcagtactgtcagtacccaaattcaagacctgaagatcgcgaccagtcatgagatactgggtggctaaggcaaagtacatttgttgtcttagaaacccagagcagccatatgccactaaataaatttatgaaatcaactttataagacatattgattataaatatactaaaacaaccaatttgataaaggtatagagtatgcaaattttgataaaggtatagagtatgcagatgtgtgggacgatagaatgttatataacaaaactggagctgcattgctaggctaaaaacaggttcttttattctctttgcctttattttttaacatatgcaacaatttaatctttgatgattaaaaaggttgcagagaattaaaatatattgctataagctattataaatatcagtctactgtatagtaggttcttattttcataaataaaaaactgaagctgagaaactaccacaagaccaaaagcttattttaatttttataagcaaaggtcaattctttgaacaaagtctaccccattgggctatgactgatagttaataagtaatcttatgaatttttctttatacataaagaacaaacatgggaaaatctgggctataatccttgacaagatatttcttacactgcttcttgcctaaagggttaaaaagtactagtatggttgcacatcatgcaatactgactttgcaaaaagggtttgtataactgtatatagattctccaagttggaaaactgaaaaatctaatttcaaaaatataagtaggcactgaacatatatatcaatatgccaatgacaaaaagaaacatacatatctatttactttctatttccagacacagcaaagataaactaattttgtaatgctttctacccactgtaggtattgttcacagattaaataaaacttttccaggaaaatatgccatatacataaagccaatcagatatacttcccagatatttaggaaaatccaatatagagaacagaatgaagaatgggtgaattcacaaagtaataagatataataaatcatctaaaatgagtaagaactagaattcaagtacaagattcaaatgaggttaagtgatagccagaaaaggtcatacaaagtaacatccaaatatcacctcagaagcttaacatacaaacaaatttcaagtcaggacagatacacacactaaatgaagaggggtttatgaacggggactaattttataagtggtacaagagtgaatattttgcttccctacacaatttctcctgcaacctcatagcagcagggatttggataacaaattcatagccaatgagaaacccctgtgtgtgtatttatattacctgtgtatataacaacaggggatataagtcttggtttgactatcttagggtggtacatacagtgtatcttgatcaggaccacatttataaatgatttttttatagtataatactgtaccaaggttgtcagggaggtccttttcatatacaatctctccaagtactgcagtccctcatctttcagtaactccagtggaaaatggtgcagattcctataatttaagaacaaattcttgtgcttttccagccttgccacagagttcgtcttacaaagttcggataccgtgactgaatatatcccatcagacacattgcagcagtacatctttacaaaattggtcggtttctcagcgctggcagagccagtgctccggagctcaagtggcactggaaggactctttgcctttatttctctgtagtttcttttcatagtgttggcatttgattttccttttaattttcaggttatatttgcacttaattggcactgtagcaggttcattgcatgttgtgtgccttctgcataccttgattgtaatcgaacctgggctagaagggaaattgaagagtacagcaggcaataaaatccagacaagtagagtgtcattttatccagctttcaaactctgtaccgagtcctggagatatgtggcagagccttctgaaaggaaacacaggtgttttgtttttgtttttgttttgatgggaaagaggtggtgccaaggtgctaagggcatgaaccctcatcttcctaggccagtttgcatgtatcttaattgctttggagacactatcatgattttggctgagaaaaaaaaaaaactatagatcagttctttaagattttcaaaaacctacagcattcctccagtgccctaagcctcttgttcctgacaaatctctctgtgctttataaaaacatgcccaacatgacttgagtccatacaaagaccatgctccttgttgctatgggcccatattaaaggctgtactttgtgtcagactgtacgaatgtgttctgtttttctttttctcacgcacatggctgggtagcctgagcgggacccagttttattagctttgctgtgttttcttttatgtcttttttaaagctcattgaattggtttaagatttgtacaagtgattttcttactgtcacatagagttaaaattatctagtccagcttctccatccaatgtttaaacctgttctttaatgttgctgaagttttgcccagccactgctttagtacttctattgatggggagctcactgttttccctatgctcttcttatagcacccgtttcatctttggacaaatctatcagtctacatgttgagctacagtcttcctccctcacgttactttccattgtggtctaactaaacacatttcatttcactcttttgtgatagctctttaaggatctgaagacagaaagcacatttcttaaattttctcaaaacatcagtttcggggaggctggccaagatggccaactagaagcagctaatgcgtgctgctttcatggagagaagtggcaagtagatacagcacctttaactgaaacatccaggtacatgcattgggatttatcagggaaacaatccaacccacagagaatggagaaaatcaaggcaggatgaccatccagccaggagtgacatggagccaggggaacctccctcacccagggaagtggtgaatgagtgagcaacactgaagacacatgctttttttcatggatctttgcaacccttgggtcaggagatcccttagtgaacccactccaccagggcctgcagtctgacacacaaagctatgtggagtcttggcagagcagctggtaaggcacacgtggagccctgggagctttagatatccgggcttcccagcaaaagaggctgcaactccagcaaacctggaggttagaccccccctcccatacatacctctagaaaaggggctgaatccaggaggctgagcagtgatggtctgcagaccctacttccatggaaccttgcaggataagacccactggcttggaactttaaccagccaccaatagcagtgttacacctccctaagacggagctcccagagggagggcaagctaccatctttgctgttattgccttcagtgcagccaccctttggtaaaccagtcagactgctttttttacatgggtccctcaccctacttctcctcactgggtgggacctcctgactggggtcaccagccacacttgccggggttttccagctgtcagtggttctgagcctccctgggatggagctcccaggggagggatgggtagccatctttgctgttccagttgactgactagagcagtcaactgccacagtacagcagctctacaaagaatcagccagactgccttttcacatgggtgctggatcccgtttctcttcactgggcagaatctcccaaccgaagcctacaaccatccttactggtgtgttcaggccagcaacaagtccatacctacctgggatggagctcccagagagagggacaggccgccatctttgctgtttcacagccttcactgtcgataccttaggtgctggaaaatctgaagtgattagggactggagcagacccccagcatactgcatctcagccctattgaaaagtggccagactgttatatgggtcctcaatcctatatttcctcactgggtgagtcctcccaacctgggcctccagccaccctctgctgggcctatcaagccagtagcagctctgcagctccctgggacagagctcccagtgggaggggcaggttgccctctttgctgtcttgcagccctcactctcgctgtctccaggctttggagagtccatgaggactaaagactggtctggacccctagcacagagaacccacctcatggaaaagtctgttctccatgcagttcgcagtcctcacttctcactagtcagggccactcgacctaggactgcagcacaaccaccctgcccctgcctgaccacttcaatcagaggcagccaagcagtgaaaggaagacccacacacagagatgagaaagaaccaatgtaagaactctggcaactcaaatggctagagtgtcttatgtcctccaaatgatcacactagttctccaacaagggttcttaaccagactgaattggctgaaataacaaatagaatgcagaatatgggtaggaaagatcattcagatttaggagaatgccaaagcccaattcaaggaaactaagaatcacaataaaatgatacaggagctgacagatgaaatagccagtataaaaaaggaaactaacagatctgatagagctgaaaaacacaagacaagaatttcacaatgcagtcacaactattaacagctgaatagaccaagctgaggaaagaatctcagaacttgaagactggctctctgaaataagacaaaaataaagaaaaaagaataaaaaggaacaaacaaaacctctgagtaatatggggttatgtaaagagggcaaagctacaaatcattggcatttctgaaaggaagggagagaaagcaaacaacttggaaaatatatttcaagatatcatacgtgaaaacttctccaaccttactagagatgccaacagtcaaatttgggaactacagacaatccctgcaagattcaacacaagatgatcatcccaagaaacatactcatcagacttcccaaggtcaaaatgaaagaaagaatgttaaaggtagctagagataaagggcaggtcacctacaaagggggcttcatcaggctaatagcagaaaccctacaagccagaagagattaggggcctatattcaacatttttttttttttttttggagacagagtctcactctgtcacccaggctggagtgcagtagtgcgatctcggctcactgcaacctctgtctcccaggttcaaacaattctactgactcagcctcctgagtagctgggactacaggtatgtgccaccacacctggttacttttttttttttttttttttgtattttcagtagagatgcggttttaccatgttgcccaggttggtctcaaactcttgaactcaggcaatctgcctgcctcagcctcccaaagtgctaggattacaggcatgagccaccacacccagtctcaacattcttaaagaaaaaaatcttcaaccgagaatttcatactcagccaaattaagcttcctcagcaaaggagaaataaggtccttttcagataagcaaatgcagaggaagtttattacaaccataactgccttacaagagatcttgaaaggagcactaaatatggaaaggaaaggctgctaccagccaatacgtaaacaaacttaagtacactgtccaatgacactataaagcaaccacacaaacaggtaggcataataaccagctaacaacataatgacaggatcaaatccgcacatatgaatactaatcttgaatgtaaatgggataaatgcctcatttaaaaagcacagagtggtaagctggataaaaagcaagacccaatgataagccatcttcaagaaacccaacttacatacagtgacacctacagtctcaaaacaaagggatgaaggaaaatctaccaagcaaatggaaatcagaaaaatgcaggggttgcagtcctaatttcagacaaaacagactttaaaccaacacagacttttaaaaagactaaaaagggcattacataatggtacaaagtttaattgaacgagaagtcctaactagtataaatatatatgcacctatcacaggagcacccagattcataaagcaagttcttagagacctacaaagagacctagattcccacacaataatagtgggagactttagcactccactgacagtattagacagatcatcaaggcaaaaagttaacaaagatatttaggacgtgaactcaacattggaccaaatggacctgatagacctctacagaatgctccaccccaaaacaacagaatatacattcttctcactgccacatggcgcatactctataatcaaccacacaatcagacataaaacaatcctcaacaaaggcaaaagaaccaaaatcatatcaaacacactctcaaaccacagcacaacaaagatagcaatcaggactaaaaaaaaactcacagaaaacagtgcaatagcatggaaattcaacaacctgctcctgaatggcttttgggtgaatgatgaaattgaggcagaatgaacaggctctgaaattgaggcaataataaaaaccctaccaaccaaaaaaagtccaggaccagatggcttcatagccgaattctaccagaggtacaaggaggagctggtaccattccttctgaaactattccaatcaacagaaaaagagggaatcctccctaactcattttatgaggccagcatcatcctgataccaaagcctggcagagacacaacaaaaaaagagtattttagaccaatatccctgatgaacattgattcaaaaatcctcaataaaatactggcaaaccgaatccagcagcacatcaaaaagcttatccaccatgatcaagtggacttcatccctgggatgcaaagctggttcaacatatccaaatcaataaacgtaatccagcatataaacagaaccaaagacaaaaacaacatgattatctcaatagatgcagaaaaggcctttgacaaaattcaacagcctttcatgctaaaaactctcaataaattaggtattgatgggacatatctcaaaataataagagctatctatgacaaacccacagccaatatcatactgaatgggcaaaaacgggaagcattccctttgaaaacgggcacaagacagggatgccctctctcaccactcctattcaacatagtgttagaaattctggccagggcaatcaggcaggagaaggaaataaagggtattcaattaggaaaagaggaagtcaaattgtccctgtttgcagatgacatgattgtatatctacaaaaccccattgtctcagcccaaaatctccttaagctgaaagcaacttcagtaaagtctcaggatacaaaatcaatgtgcaaaaattataagcattcttatacaccaaaaacagacaaacagagagccaaatcatgagtgaactcccattcacaattggcttcaaagagaacaaaatacctaggaattcaacttacaagggatgtgaaggacctctttaaggagaactacaaaccactgctcaacaaaataaaagaagacacaaacaaatggaaaaacattccatgctcatggataggaagaatcaatattgtgaaaatggccatactgcccaaggtaatttatagattcaatgccatcaccatcaagctaccaatgactttcttcacagaattggaaacaactactttaaagttcatatggagccaaaaaagggcccgcagtgccaagacaatcctaagccaaaagaacaaagctggaggcatcacactacctgacttcaaactatactacaaggctatagtaaccaaaacagcatggtactggtaccaaaacagagatatagaccaatggaacagaacagaggcctcagaaataataccacacatctacaaccatctgatctttgacaaacctgagaaaaacaagcaatggggaaaggattccctatttaataaatggtgctggaataactggctagccatatgtagaaagctgaaactggatcccttccttacaacttacacaaaaattaattcaagatggattaaagacttaaatattagacctaaaaccataaaaaccctagaagaaaacctaggcaataccattcaggacataggcatgggcaaggactttatgtctaaaacaccaaaagcaatggcaacaaaagccaaaattgatagatggtatctaattaaactaaagagcttctgcacagcaaaagaaactaccatcagaatgaacaggcaacctacagaatgggagaaaatttttgcaacctactcatctgacaaagggctaatatccagaatctacaaagaactgaaacaaatttacaagaaaaaaaaacaaacaaccccatcaaaaagtgggtgaaggatatgaacagacacttctccaaagaagacatttatgcagccaacagacacatgaaaaaatgctcatcatcactggccagcagagaaatgcaaatcaaaaccacaatgagataccatctcacaccagttagaatggcaatcattaaaaagtcaggaaacaacaggtgctggagaggatgtggagaaataggaatgcttttacaccgttggtgggactgtaaactagttcaaccattgtggaagacagtgtggcgattcctcagggatctagaactagaaataccatttgacccagcgatcccataactgggtatatacccacaggattataaatcatgctgctataaagacacacgcacacatatgtttattgtggcactattcacaatagcaaagacttggaaccaacccaaatgtccatcaatgatagattggattaagataatgtggcacatatacaccatggaatactatgcagccataaaaaaggatgagttcatgtcctttgtagggacatggatgtagctggaaaccattctgagcaaactatcacaaggacaaaaaaccaaacaccgcatgttctcactcataggtgggaattgaacaatgagaacacttgaacacaggaaggggaacatcacacaccagggcctgttgtggggtggggggagggggcagggatagcattaggagatatacctaatgtaaatggcgaggagttaatgggtgcagtacaccaataatgcatgtatacatatgtaacaaacctgcacgttgtgcacatgtaccctagaacttaaagtataataaaaaagaaagaaagaaagaaagaaattgaggcagaatttaagaatttccttgaaactgataagaacaaagatacaacatactagagtctctgggacgcggtgttaaaagagaaatttacagtgccaaatgcccacatcagaaagctagaaatatctcaaattagacaccacaactaaaagaactatagaagcaagagcaaaccaaccccaaagctagcagaagacaagaaataaccaaaatcagagctgaactgaaggaggtcaagacacgaaaaaccattcaaaagagaaatgtaaataggagttggttttttgaaaaaaaatattaagatagataagccactagccagactaataaataataaaggagagaagatacaaataaatacaatgagaaatgacaaagaggatgttaccactgacaccacagaaatacaaacaaccaccagagactactacaaacacctctatggacacaaactggaaaacctagaagagatggataaattcctggacacatacattctcccaagactgaaccagggaggaatttattttctgaacaaggaattagtaacaagctccaaaattgaatcagtaataaatagtctaccaactgaaaaattgcccaggaccaggtcgattcacagccaagttcttcaagatgtacaaagaagagctggtaacattcctaccaaaactattccaaaaaattgagggggagagacacctctctaactcattctatgaggccagcatcatcctgattcaaaagcctggcagagacacaacaaaaaataaaactttgggccaggcattgggggtcatgcctgtaatcccagcactttgggaggccgaggcgggcggatcacttgaggtcaggagctcacgaccagcctgaccaacatagtgaaacccatctctactaaaaatacaaaaaaaatcagctgggcgtggtaatgcctgcctgtagtcccagctacttgggaggctgaggcaagagaatcacttgaaccagggaggcggaggttgcagtgagccaagattttgccgttgcactccagcctgggcaacagagtgagactccatcttaaataaataaataaataaataaataaataaataaataaataaatcttagggccaataaccttgatgaacattgatgcatcaatcatcaacacaatacttgcaaactgaatccaggagcaatcaaaaagctaatacaccatgatcaactagacttttccctgggatgcaaggtaggttcaacatatgcaaatcaataaatgtgattcatcacataaacacaactaaagacaaaaaccccatgattatctcaatagatgcagaaaaggctttgttaaaattcagcatctcttcatgttaaaaattctcaataaactaggtattgaaggaacatacttcaaaataataagagccatctattacaaacccacagccaacatcatactgaatgggcaaaagctggaagcatttccattgaaaactggcacaagacaaggatgtcctccctcaccgttcctattcaacatattagaagttctggccagagtaatcagacaagagaaagaaataaagggcatccaaataggaagagaggaagtcaaactatccctatttgcaagtgacgtgattctgtgtctagaaaatctcatagtctcagcccaaaaattccttcagccaataaacaacttcagcaaagtctcaggatacaaaatcaatgtacaaaaatcactagcattcctatatgctaacaacatccaagctgagagccaaatcaggaacacaaacccattcataattgccacaaaaagaataaaatacctaagaatacagctaacaagggaggtcaacgatctctacactcagaattacaaaacactgctcaaagaaatcagagatgacacacacaaatggaaaaatagtccatgctcatggataggaagaatcaatatcattaaaatggccatattgcccaaagcaatttatagattcaatgatattcctatcaaattaccaaggacattcttaatagaactagaaaaaactattttaaaattcatatggaaccaaaaaaagagcccaagtagcccaggcaatcctaagcaaaaggagcaaagctggaggcaccaaggttacccaacttcaaactgtactacagggatatagtaaccaaaacaggatagtactggtacaaaaacagacacatataccaatgggacagaaaagggagtccagaagtaaggcctctcacctatagccatctaatcttcaacacagtggacaaaaacaagcaatgggtaaaggactccctattcaataaatgttgctgggataactgtctagatataggcagaagattgaaactgaacaccttctttacaccatatacaaaaatcaactgaagatgaattaaagacttaaatgtaaaacccaaaactataaaatccctggaagacaacctaggcagtgccattttggacataggaataggcaaagatttcatgacaaagatgccaaaagcaaccataacaaaagcaaaatttgacaaatgggacctagttaaactaaagagcttctgtacagcgaaagaaactatcaacagagtgaacagacaagctacagaatgggagaaaatttttacaaactatgcattcgacaaaggtctaatatccagcatctttaaggaacttcaacacatttacaagaaaaaacaaacaaccccattaaaaagtgggcaaaggacatgaacagacacttttcaaaagaagacaatcatatgaaaaaaatctcagcgtcactgatcattagagaaatgcaaattaagaccacaatgagatgacatttcatgccagtcagaatggctattattaagaagtcaaaaaataacagatgttggcgaagttgtagagaaaaataaatgcttatacactgttggtgggagggtaaattaatttgaccaatgtgaaaagtaggtggcaattcctcaaagagctaaaaacagacctaccattcaagtcaataatcccattactgggtatatatgcaaaggaatataaatcattctgttataaagacacatgcatacatatgttcattgcagcactattcacaatagcaaagacatgggatcagcctaaatgctcatcagtagcagataggataaagaaaatgtggtacatatacaccatggaataccataaaaaaagaacgaggtcatgtccttcgcagggacatggacagagctggaggccattattcttagcaatctagtgcaggaacagaataccaaataccacttgttctcacatagaagtgggagctaaatgatgcaaatacatggatgcaaataggggaacaacagacactggggcttacttgagggtggagggagggaggagggagaggatcagaaaaagtaacgattaagtactaatctttgtccctgggtgacaaaataaactgtacaacaaacccccatgttatgacctatataacaaatttacatatgtatccctgaacctaaaataaaagtttttttttaaatcagttttgagtcctcttgttctagactttttatctaaatgagttccaatttgtctatatcacttatcaaagtttattagaacatatattcattctgttcctgccatcttaatgacatcatgtttcccctgcttaatccttctttgtgtctctgtagattattaattttttatgttagatcattttaaaagatgattttaattaaaataatacctacaaccccttcttcccacccactctcctcttccccaagagacagacattctaatttggcatgacattatctggcctaacagtgtctggcatatgaagtgcctaaaaggtcatcttccattgttttagccttctggagtagttgaattaagttcaaactcagaatgtttttcaaatgttaagtctctctggggatgtttttcataacatcttcgaactggctaacacgactaaatgaaacatgctgcactggattaaaaggttatttccctagtgtgtcaagctaacagagaacatgaaacttcccatcaggcactgggcatctctggttgtcagtctagcaacattgtctccattaagttcctaacccccaccgctcagagaacactttagtcaagaaactacccttcacactgaatcttgagtggcagaaaggcaaagaaaagaagatgtaggaagagtcagaaacaagcaaaagaaataagggactctgtgagctaataacctgagtctaggtaatcaagaccaaagaccgatggaaacccattatttgaaattaaggaagaaacctcatacaggatcagagccaagcaaaaaatggacaatggtctaaaatgggcaaagagtaattctggtaagttagaatattgaaggacaggacaagagtctctattccatggagataagatacccgcaatttaccacattagaatggttacctaagaaagactgtggaaataaatcagaataactgaataatggcaaaagggaagcctttcttggatcactgatgaattgaagaatatgatgacatcaacctctgcacctgagaccaataaaataaataaaaccctaggccatcccatgcaaatagacaagttagttaggaaacaagaataacagtgctgtctagtagaactttctgtgataatgaaaatgttcggtatctgctctgtccaatattgtaaccactagccacaggtgattactgagcacttgaaatttttctagtattactgaagaactgaagttttaattaatttacatttaaatttaagtagctgcatatgactagaggctattatattggaggggacagattggatgttgcaagtgagcccaaatcctggcacagaaaaggtaagtgtacactgtagttgcaggaaacagcgttcatccttgccctctccaggacctgtttcgcccatcagtaggtgaacttgcagaaggctagcccctagaagttctcccctactgtggatttggctgctagatttgggaggagtcctgcagagctgactattgttcaagaaatgtgggcttcggaattgcatgtgcaatgggtgtttcctatgcagactttaatgagcacagcacccccagaatgccacgtgtatggctttgggcatcagccaggattggcttgagttgggtgctacctagtgaactatttcaaactatggtgctctgaggacttctttgctgccttgggtatgggtaacagtaatgagttgtgaggggtcagaatagagagttaatagtataaatgattgctaggctattacagaattctaactagaatggcaacatacttattcttaggcccaacccctcttcttttctgatattccactcttcttagccctgtatcctttcccttgctcctggatagcccattccttgtctcatgtggcaaataaaaggaatatgagaaaatgcttctaatgggggtggggggacatggccttattaacacgtgtgtttgggttcctgggtgcttttgtggaattattgaaattttcctttcctctgttgaataaaaattaaacagcagttgtaaaagtattgtacagatggtcaaagtcatcttaaagtactttccccatatataagtagccaataactatcatgtacccacaaaaattaaaaatttaggccaggtgcggtggctcacgcctgtaatcccagcactacgggaggccgaggcgggcggatcacgagatcaggagttggagaccagcctgaccaacatggtgaaaccccgtctctacaaaaatacaaaaattagtcgggtatggtggatcacgagatcaggagttggagaccagcctgaccaacatggtgaaaccccgtctctacaaaaatacaaaaattagtcgggtatggtggcacgtgcctgtaatcccagctactcaggaggctgaggcaggagaatcactggaacccaggaggcagaggttgcagtgagcgtgactgcactccagcctggatgacagagtgagactccatctcaaaaaaaaaatttttaatttaaaatttaccccagtggagttcacttactgatggaggatgcctgagtcctttgacctttggcagtgacaggtcttctggctgtgaaaaggtctaagcatttatcagcctatcagtttgagcatgactgctgggctccactacaagcatatctgcaaaaggagtgtgatgagggtgggatctgaaacagtagttttaccacttggcatggattgcctagcagttgtgtacttagtgaaagcaagtccagagttaagtgggaagtgcacttatcttcatggagtgatcagagatggatttatttatttatttatttttcctgtagggcccaagcctgtgaaccaaagggattttttttttcttggtgaaagaaattcacgttgaaccaatatctagaagacctatctggggatcaacaaggctaggagaatattttgaaagtaaaatcaaaatacagaaataaatatttgagccaatctaagacttgtcccactgagagatacctgctttgccaagtacatgcctacctctctaagattgtaagtgctttgaggctacagcttgtgtttctcacttctgttttcctcatggcatagtctaacatataaaacaggtatttaataaatgtgaaaaaacttaacatacatccacacccatgtgacagtcccagccttccagcaagctgtttgtattttgtttccacatagccaagagaggtaaggaagtggagtgctcaagtaagccccagattcacagaccttcttcagtgttgaactatgctgttcttcactgcttagaatatagaaagggtatcactgtttcaagtacacatgttaggatggcctgggaactaccctgatattaagaaggaaggccagagattttatggatggtaaaactgaggctcccagttacctgtaacagctacctcagtatctcatgggaaaactacagtgggaccaagattgtttcctgggccaggacagtagtatcactttttttaatgggatgttttgtatttgagtatgcattgtcttcaatttacttggaaccatttatgcattattcttgtgtacttacctaaaaatatctgatctgtagggaaatgaatagatagttctataattcttaggggttctgaaatatagtaattaatttgatgtttatctctttatggtcttgttttctgctttggaagttagaatgaagtcagaaatgagtaaaagaaaactatgatcacttggaattttatatatgtatatatatgaagaaaaagaaggctgggtgcggtgactcacgcctgtaatcctagcactttgggaggccgaggtgggtggatcacaaggtcaggagttcaagaccagcctggccaagatggtgaaactccatctctactaaaaatacaaaaattagccaggcgtggtgtcaggcgcctgtaatctcagttactcaggaggctgaggcaggagaatcacttgaacccaggtggcagaggttgcagtgagccgagatcgcaccactacactccagcctgggtgatagagtgagactccgtctcacaaaaaaaaaaaataaaaaaataaaaataaaaaaagagaaagaaaagaaaaagaaagaaagttgggccaggcacagtggctcacgcctgtaatcccagcactttgggaagctgaggtgggcagatcatctgaggtcagaagttcaagaccagcctggccaacatggtgaaaccccatctctactaaaaatacaaaaatgagccgggtgtggtggtgcatgcctgtagtcccagctactcgggaggctgaggcaggagaatcacctgaaccctggaggccgaggttgcagtgagctgagatcacaccactgcactccagcctgggcgacagagcgagactccatctcaaaaaataaaaaataaagaaacttttgtacttgtcatggtatccctagtccctctattctccccccaaaatttcaaatggtatcttaactggtcattattaaatagctgaatttattttagcacttccaaagaattcccagcttttttcatcttccaacttccagtcctttatattgcatcctgcttccatgatggaagaagaaagtcaccataatttttttgagtgtacatgaatgtcctgtgtgtgtgtgtgtgtgtgtgtgcgtgtgtgtgtgtaaggaggaaatgtgttgcttgggtgggtatgccttggggtgacaatacagagctctagaaccagaggctggaagagcagtgcctacttctcagatggattttggctttatctctacttttcacttctcctcttgggataagtaagaacagctttcttatttctgacagcatttcctccaataaagacaaacaaaaagttagtagccctctgattagtggttatttttattgataacttacattccacttggtaagtaacttggtgctatggggatatttctggactagaaggcaacatacatcccacatccaagaatgtgtatgtgttaccaaatcactatgtaacactggcaagtagtttcccctttctgggacttggttaccccacttgtaaaatggggagtttgggatgagactatcttccaagatccttccagccctgtggtttagtgattacatttctgaaaagaatgtaataacattttttaaaatgcagttaacaggataaattagtaataagaaaatagattagaaaccatatggagaaagtcaaaagataatttagcctaaagttattgcgctcaagcattaaatgtaactcagtgctgcctggcaacaaaagcactctttgattaggatatagtccttatataaatgcattctcagaaagggccaggctatagtggtgtggttcttcagaggactcgccatcttccacacacaaatgggtcttccaggttgatctctctgttcctaatataccattatactgcccatttggatctagagtcaaggagaaagtgactgtctttagaaagaaataccccacctgagaaacagtgattatactcttctgtcactctttcctcagatttgagaaagaaagcaggcagaagtcctgaaaataaaattctttcacaaaggcaaagggactcagatgtgtcagtgaagttgagctacctatagttataaggtttaaaagttaagactagtgaggaggctggctattcttgacttgaacctaatagtgcctctgcttgttctttctacccctaattccagtcttaatgaatattgtttcctggcatttgtatagtgctttaatatatacagtgcatttgtacatgctttctcattgattcatcgtcttatgcacctactcttcttgaaaatttctttagagtgatgtcacaaaaaatggtacagataaaaccggtacagagagaaagaaaagggaagggagacccaaatgttgaggcactgagctaggacacaaatgcagccactatcacttctgcctaggaacatgatggcaaagagggtccctcttagattggtggctgccaaaaatgaaggcaggtgatacatacggagccctgtcgccgccagcagcaccctacttgctacccctgacaggattggggtatgtgtgtataaaaatcagaggcatacaggaaaggacatgagatggaagggattaaagagttccctcaggctcatctcagtatcacacaaaacttaaatcagaatttattcttgcatgtcaattttttgtagtacatgtaattagtttcaatttttaaagacgaaaaaataggctgggcatagtggctcatgcctgtaatcctagcactttgggaggccgagacagccggatcacctgaggtcacaagttccagaccagactggccaacatggcgaaaccccgcctctactaaaaatacaaaaattagcttaggaggataaggcaggagaaccgcttgtacctgggaggcagaggttgcagtgaagcaagatcgcgctgttgcactccagccttggggatagagcgagactctggaaaggaaggaaggaaggagggaaggaagggaaggaagggaaggaagggaggagggagggagggaaggaaagaagagggagggagggaaggaaagaagaggaagggaaggaaggaaggaagaaaagagggagggagggaaggaaggaaggaaaggaaggaaggaaggaagaaaagagggagggagggagggaaggaaggaaggaaaggaaggaaggaaggaaggaaggaaggaaggaagggcgtgatggtagcctgtaatcacagctactcgagaggctgagtggcaggcggaggttgcagtgagccgagatcatgccactgcactccagcctgggtgacaaagccagactctgtttcaaaaaaaaaaaaagagagagagacagagagaagaaagaagcaagaaagaaagagacaaaaattaaatgaattctagattgttaggaactaaaagaacccttagatataatctagtttttctcccttattgtatagctagtaaaactaagtaccagagaagggagggagcttgtctgaggacacctagctaatgatcgtactctgtccattatacagtatcccctcttctatatgagttttttgtgcatatcttttgaattttggaattttttttttgagacagagtctcactttgtcctccaggcttaagtgcagtggcacgatcttggctcactgtggcttcaacctcccgggttcaagcaatcctcctgcctcagcccaccaagtggctgggactacaggcacgtgccaccatgcccggctaatgtttttgtattttttgtagagacggggtttccccatgttgcccaggctggtctcaaacttctgagctcaagcaattcgcccacctcagcctcccaaagtgctaggattacaggtgtgaaccaccacgcccagccagaattttggaatctttatcatgagagaggaaatatttaatagagtcataccatacttttgagatatatagaattctttacagtgtagctgtagtaatctcttcttgatgtctttctcacccttaatattgttaaaacttgtatcgttgctcatttaagcatgtttcctgtacttaacatcatcatacctccgtatttctagcttagggtcttaaaatcctgatagatatctgaaaatagaattagccaagcagagttatggattagaatgtgctccctgtactgttgctgattctgccatccattattctgactaaagctagactgggaagaatcagactagacagagctagctgggctagcttggaaaactgtctgtgggcctatttgctatagcagtaccatctccttgcttcattacagtccctaacccaacctgaagattccccatctgtaacagcttgcttgtcagttgctttctttccagtgtgacagctaaggtcctggtcagcttcattagacatgttgtacctgataatgggtcttcatactggccttgctttattcccaagaagatcctggcaccgatatttctgagactaccctggtctggaatccaaccacccatgattcttctttcacagtcatctattaactctttgatctgtcttttctctctatattctgactactgctcccttacctgtcacatctaaatcatctttcaggtctatacagcacacctatgtagttctacttacatctaacatctcctttccattcctatttcctcctcctgaattctaatctttttgacatctcacacctgaacattttttcctatcttccccccctctgtctctcccactttcactggtcctaatattcttcactactcaaaacccttcagcatcttcctgaattacaatttagttggcctccacagtatatttcagtttatctttccactatattttcttgtttgtacctatttcagccaaacattattccctaaattctctcccatcttttcctaccattcaacatcattgtttaaccagtttttataaagtacataccatgttataagcactatgtgagctaggccctgtggagttgggggtgttggtgcttagtcttttgggggtatcagatataaagtagtaaagcttgtataagatgataaacacagaggagataaaaattctttgagaatacagagaatgacagagactaattttgtttggagtggggaatcaaggaatgtgtcaaggaaaaactgagaagggaagagtacagagaggtgaaagggaggttgggaaaggggaagggaaggaatgggaaaaggggacagagattccaaacagagagaatatcaagtgcaagacacagggaagcaaaaacaaatggtttaatattaagggagtggagagggttagaatatttaggaacatagggggaagtgaacagaatgaaaagaggatacaactggagaaggtgaggattgattgaggagagtgttttgcaaagcaaaacaaagttttaaggtaccttgtcaacttgctatgattctatagcagttgtttagaagatagactggagtgggagggagacttgtagcatttcatgaaggtccttctgcctggaatacttttctctccgctgaacttccccatcctcacctccagaaaggtcatccttcaaggttcaccttaatgttgctgcttttagtgaagccttcccaaatctcccgcctctctagaattctagaattggagtaatttccctccatttgggattcccatagcaactttctgcccctctttcagtgtattatacttacaatttgtttgtagcttgctttccccctctagactctgagcatcttgagaacagagatctagcctcatttatctgtcttttctatgctgtacttgatagaatactgtgatcacaggtagtactaataattttgatgaattgatttaaactggtatcccagagattggcactactcaaactccaaaggctatattgccccagacccatagacaaaaacaggacttactttcttgccttgatttttttcaccagttgggaaaagccaaggacatcctcaacacaaatgttggtgtgggtcacctagactctgagaccttagacttcaaggccgctggggaagaggatagcagcctacaggatctatgagcctttctcaagcccagctgaggggaagggcagataggagggattgcttttccagtctaatggagcatttccttgcttcaaaataccatctccatgctaatgttattttaatgccattacactgtgtaatttactgtgatcagcaaagcaatttgttgtacattcttccaaaagtgttaatcaattttagctcaaaatagattttaaaaccccacctaatttactgtcctaaaatgctgatcagtgggggaaagctaaagcaagcccagagttgtttgtattgtaactgtaagaaattataattcctccccaaaattatttttataagcagccaaggtataagtaaataggtatgtagaaaaatatatacctttagttgtcctgtttatagctgagatttgaaaaatcataggaaaggactaaaggattgtctgctcaaggtctagcctactaattctggagaacaaaggcccaaattattgataatcactaagttaatatctgtgatactcagttttcccttttcaaaaaaagttatagactctaatagaaccaaacttatgaggtaattaattatacatccaacctcccatgtccccactctacctcttctttatcttttgccaaagtgtatctcctctctgttctcaaccttataagattccctttacttcagagtcataaatcttgggtgcttggccagatttttccattagaggcaatttatgttcttagggaaataacatcccagagtaaagttacagcagcactaatatgtcccctgacatagtgttcttgtcctgcctgaaaagactggataattggctagacacagttgctcatgcctgtaatccagcacttcaggaggctgaggcagttggatcgcttgagatcaggagttcaagatcagcctggccaacatggcgaaatcccatctctactaaaaatacaaaaattagctgggcatggtggtgcgtgcctgttaattccagttacttgggaggctgagacacgagaatcgcttgaactctggaagggccactgccctccacctgggtgatggaatgagactctgtctcaaaaaaaaaaaaaaaagtttggataattgttgatacttaaatgtattgttcctatatatatttcatggtacattaatttttactgataacagatgcttatctgtggcagctgttctgtattttcctacctgaaagggtatagaagtatagatcagtaacatgtggaaacttgtatttgtctagccctgttttagtcaggggttggagttggtaagaatcatggagatggcattttgtgttttaagaaaaaacacctagtctcttggtcaggaaacttggggggtttttttcatagatctctcattgtgttgttttacaaccttggctgtcatagtctctctttccataccttggacttcctggtgataaaaatggacttgcttgtagttaactatagacataagggataagaagacattaaattattgaaatctaaaagtaatttgccccttatcaagttcctgccaagatggacttagtggaggggcaaaagaggggtaaatgatacctgaagttctactgaactccaaaacaaaaatgcacagagtaatccatgatggcaatatgattccatctgatttatagggtcgtctttgaagcagaggcagctatccaatctgttcattcagttctactacaaatgagccctccttgacaaagggtggggacttggacattgctatccactcctctccatcttttaaaactctccagcccttttctgtgtaaatacaagtaagcatatattttctcttttccctggcacccatggtttattgcctatgcatcaaatcagatctcatataaaatgagaagaaaatgtggcaattctaatatataagtgttaggggaaacccagagtcatctaacatttttaaaactgagagactgcctaatacagtctttgtattttatagataagggaataggcccagatgggtaaaatattttatagattgaatcacgtggaactgttactgcttcctgtttctcaatgctgaacctactttttagagtatattgcatgcattaggataaatgactatacaattgagattcttataatagctgcttgactatcaataccatatgctttttaataaagggatagatactcagttggggagaaggtctagggacagggggagggctagatgttgtagtggcatgtggcagatacccccatctcatctcctatcattttgcacataaataccactcaggtaggtgggcaggagatgaagggctacagatagatatatgtcctatgacctaaaaatatcagatgatgctggggccttttcagaaaatctaatcttctttgtagtcacattttttaaaaatttgctgtgagtttggaggaatacttgtcaaagtccaagttaaagtcctggaagtcgagaaaccaaggaattctctaccttcttcatccttagcagtcaaattttaaggcacagaaagagaaaatctgaatatgatgtatatgtgtgtatgtatatgaattgccttgtttttgaagagcatctgatcatttgaaatagaaatgaggcaaacaaaaataaagttaattgccacacacaaacacacatacaaacacaccttatctcaggttagtcttgtctttgctttgtgtccttcttaatcaggcaaccatgattaggttaaatgcattactatttggaggaagggatacgtttgtctgcttccttggatttcagttttgaataatattgtggcacagaggtgatagaaggatctaggatgtatgaatgagtgtgagtttccaaactgactttatgtggtaggtataaattgtgaaacaaaaacaatagcagtgatgaagtcaatctggaaacaggtaaatcccagtgagccttttaagacccctctagctgaaataacctataaaacacaaaataaaacaaatttaatgactgatattatatatttgaaatgtgcaggttggacagcatttggacttggaatgaaacaataagaggttatattcatggataaccaacaagataaggctattgttgcctcagccaacggagaaaacactctgattaatggggtcaaagaaaatggtaagggaatttaattatagtatattaatatctctcctggtagtcctctgttattactatggattttcagtacccacaaagttgggacaggttgagtccaggatgcctctgaaatgaatgttaattgtaaactttattccaccaaatatctaacttggctataagagtctctaagaggcattgaatctgaccactttgccctcccaaatcatatctgccagatgaagatcctcaaaattcctagtgaattagaaatatgctgtgatgtgaggcttagaacttctagagtggccgggcgcagtggctcatgcctgtaatcccagtactttgggaggccgaggtgggcagatcatttgaggtcaggagttcgagaccagactggccaacatggtgaaaccccatctctgccaaaaatataaaaaattagccgggtgtggtggcaggtgcctgtaatcccagctactcgggaggctgaggcatgagaatcacttgaacccaggagatggagattgcagggagccgagatcacgccactgcatttcagcctgggcaatagagcaagactcaaaaacaagaaagaaagagagagagggagagagggagagagagggaggagagagaagagagagagagagagagaggagagagagaagagagagagagagagagagagaaaagaaaagaaaaggaacttgtagagtcactaggagcttccagaacatggatctggaggacaggcctgagcctcgtagctcaaaagtattaatgttccatctgagcattttccccttgaaagccttgactttccaattgatcaagcagtccaattcttttctcatttctgaggagagctttgcctttttctgaggaagaaactcggcctaaataattattatttttcatttgcatgaatgttcaatataaaatcagcgttgttctttaacgttgtagtttttatttgtaaagatagagatgtgaaggcttagcttatataataagatcaagtaccagaaactgatcaagggaaagagagttaatgagtctggtctaagactcttaattttattcctgtcatttctttcccttttttctagactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgaggtaatactgcaccagtatggctgagatgatgcacccttagctctcctactacctactaagcccgcagtccctcattttttccctcttgaaagcaaaaatttgcatgaaagaaactgtcccattcccttctttttcaaagtaaaaagaaaattttaaagtgcatgaaaatccctatacctttaagccacccaaaagattgggcaattttgttgtggcttggctagggataagctctaacaaagctatttcttcttctgctattcatcactagttactacatattaagaaaatagaattaaaatatgctcttgaatgatttttggaagtgaaaggctttgcagtaagacagattttgaaaaatagaatttaaaagtcatgtagacaaaaagccaagatcatttaaacaaaagagcattagctggaaaacaaaatctgaacatgtggcaaataggagggctttctagtgccccatgctatttgtatctttttctacatcatacggcatctagtatgatgttaacaaatttagcttgtatgatccctttgtgggacatacactaaaactaactcagatggcataaattgtttgatttttctgcagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaaccatttctaattaaatctatgtcccaaataaaacgttctttatcatctagagcagtgtttctcaaactatctgtggtgagggaccaatagtttttgcaatccatcacagaccaatactattataaaacacaacaaaaatgaatttctaagaaagttaaatggaaaaaagatatgcaaaataaaagcccaaatgtattagatttaacatgtaaaattacatttcgagataaacataacataaggggaaagaaacgaattgcaaaaagttggtaccctgtttgagacaagtccactcatcaatgtcaaattgccatagaaggttctaatcatactttgaataatactttgactagaccagcagcattgccatcatctgggaacttgttaggaatgcgaaattccaagccctacaccaattctgctgaatgagaatctgaattttaacaagatccctaggtgttttgtgtgcatgttaaagtttgagaagcactgggctagagttttgtgtaggggattcttttgcccctcaaattgaggaatcatcttctagtgtgtccagtcttcaaagaccttaaaacaaattgtgtctttgttttgtgatccagatggaatctgcagagatgcagtcctctcaaagtgttaaagctgtttattgaaagtaataaatgctgatttgcctgg

SEQ ID NO: 4745 - DNA, 192636 bp, human
ggggggacgaggcaggggaagaacctgggaaggaaaaccagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggtgagtaggagcgctgccatacagcttcctggccttctcgccggctccccggctggctcggggtggcggccgcagggggtggaatgaactggggtaagtcgagctagacgagaaggaagggaaaacggaacggaggacgtctgtatgcgaatgtgtgtgtctgtgtatgagggagcgaggccgctagggcgagagatcccggctcgccctgacaggcactgcaatctaggaaaggcctctgtgcttgcgccgtaggaagggggttgcggggggaggggaagcgagcggaccggagccgccgcgcttacacgcacgcagctcggcagagtgccgcctcctttcggactggtgcagggtagagcctggccagggaatggggcatgggcatggcacgcttcggcgagagcgggaaaacccacgcggcggccgaggccgggcgctcggaccaaagccgcaaaggtgcgaagccgggcggccgtggcgaccacagagcgcccccaggacacgcgccactcggccgaggctgcggacaggtttaagttggaggccagaccgagcctcgcccagctcatctcctttgcggaaattggcttgtggccccttcgcgctctcggtggcggtcgaattgacgcttttctgtgtggcttctggcgcttctctctgccgcgccccgcagcacacgtcggctcgcgtcttgtacaccctgtagggcgggaaggccgtgagccggcgcggggagcggagtcccgctccgggaaagtgtggaaaccgcgctgctgagttggcgccgttccgctgaggaattcagcgatttcagcatgactgcttctgtctgtctgattcgtgagggaccgaatcacccgcgcaaggttttctgtctttttcgaagttaaaaaaaaattggcatccccatttcgacaacagcactcttgatttttatcaagcttctggttgcattttggaataagtgggtctcatattttgcttctggatcttggctcccagcatattgttgaatgctgtgcacagcactacatttagatatgtggcctttttctaatgttgcattttctagactgttatctgaaaagacatgatttgtgttgtagggctggcagggctgtttttaaaaatgtctaaagcactttaatcccgggatttgaatatatccttggttgtttttggtggaggagttcctggaatattttgcttggtgagaaaaggtgctgtaatggtcttctctgaactccttacgaccatttgtgttttggaggggtgaatctcccttacatcttttacacatgaggtaacatatgaccaaacgttttatttacagcagtgacgttcttatggctgaggagaatttacacttattgaaaaaatatttttagaagggaacaaaaaagtcctaagtaactgtcattttacatattaactgggaaaccggctaatcaaataaaactggctgagtgtctgaaactctatcccagtgaaatatgtggctgtgaatataattaaccatctgtctagtgagcaatttaaatttgggctggtacatttttattacagtgtctaatttctggaagacatacattttacccagcagtaacaacaaaaacgtatttgcttactaggtcaaaaatttactgtgtggtggtggtatttccctttcttcctccatgtctttcatagtccccacactgcgtaacctgggaggtcaaaaatgagcttcttgtttttgcaaatagcgtatttacaatagaggaactgaaactagccctggtggctagtgattagacatttttgtctcttagaaatactttccaatatttcacctccccgaaaatctagatagattgcatgcatgctagttaaaaaaatataattttttggtgcacatggggtagggtgattgaacaaaatttgtaagacttgaaatttctctatttactttctcttattctgatgaattctctacctggctgtcccaactggcccccccagacataaactcatacaaaaacacatgcttttttccttttagacagtttttaaggttaacagcattcagatctgtgattttaacaatatactgataaactgcttttttttgtaaatcgtaagtgtaaaataccatgacataaaaatacattgtacatatatttaaagttttccctatggtgtgattttagccagaaatttattactaggaaaaaagagggatagagtttgagtagagatgaaatggctccgggaagattagatttgagagaccttcaccaaatagctattgttaacataacataatttaaatgaaccacggattgattgtgcagtaagctagagaaagtcatttaaaggaaaatatttttaaagcaaatatttgcctaaataacagctctgataaattggtaacaattatgtaagtacatggcagaatttgacatatgtcaagtctgttaaataaatcaacctgttcagtgaataaatctttgatgcatcagtgctttttcacacacacacacacacacacacacacacacacccataacaccctgttgccaaagtcaaacaactgcagtactgccactttctgttttacttcaagtctgtcccttttccctctttttcttttttccacaatcttctggttacctgtaagctacctggtgagcagagagaactaaaggtgaggtggtgttgcctgtgtttaggaggtgggagaagatgagaaaagtgctaagtgttggagcacacaaagatgggttcatggatcctggacacggtcactatggaggtcctcgtctcacggaccaccatagtgtatttgcataggagaaggactggcctatccagagaagcattggttgcagtttctctgttcctaaatccagttctagtaaataatattttttcttctgtatatcccttagtaaggggagaaaaatagattctaaatggcattcgactgttacattatctttaatcttttatctgatggcacatatataagtgttcccggtaggagtaagcaaaaggagaaaagggccaaagtggatgaaagggaaggggaatgattgactaaggagtaggtcatttggcttccttgtttttcccatcttaagagatttttggtttggacattattcattttttttttcttttacttcctctgaaaagttggccaccagctccctaatggacagtttctccaccagagcaccttttcaaacccaaggtcatagggtcagacacaaagcacttgttacgttctctatggcacttctccagggctgcttgaaaacaaaacaaagaatatatacacctactacgtacccataagaattagaaaaacaaaaacaaaaacaaagagcaccagacaagtttgcatcacttggagctacctttaagttcacaccttttctcttgcccagaaaatttctttttaggcagaggtgaacattcgtgtcttctcaaacaacaagtggctctgtttgtaagtacatcacaaccttggggaaatctggtctggggtgtcgtcagttgggaaagtggagggttggggaaagctgccttttagtgatgatagagtcttttatggaccagctacaggtaggcgtgaggaccttcattgtctctgttcccttcagtccctcattgcccacagtgattcacaggcctctgctagggaacgtgctcattttggtctttttctgcaggtaagcactatgatctgatttctttccctaccatcttctctggtggaaaagaagctgaagtcttcatgaccaactattaatactatgtacacaattattacttttccaaagagcacttcaatatgtcatcttatttatccccagtgtgataattttgatgtaaacaattatctactgttttctctagcaccctcaagccccattaaaaaaattttcagcttctcaccctcagtagcccattttaagtgttataccactagcttaaacaagaagttcctcctgatgtttactctgaaggggtttagaggtttgagaccaagattaattataccttgggcctgagtgctaaagtagtgccaagtcatcctctgtcaagaacaggtgtaaagacttaaacgttagacctaaaaccataaaaaccctagaagaaaacctaggcattaccattcaggacataggcatgggcaaggacttcatgtctaaaacaccaaaagcaatggcaacaaaaaacaaaattgacaaatgggatctaattcaactaaagagcttctgcacagccaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccagaagacacatgaaaaactgctcatcatcactggccatcagagaaatgcaaatgaaaaccacaatgagataccatgtcacaccagttagaatggcaatcattaaaaagtcaggaaacaacaggtgctggagaggatgtggagaaataggaacacttttacactgttgctgggactgtaaactagttcaacccttgtggaagtcagtgtggcgattcctcagggatctagaactagaaataccatttgacccagccatcccattactgggtatatacccaaaagactataaatcatgctgctataaagacacatgcacacatatgtttattgcagcactattcacaatagcaaagacttggaaccaacccaaacgtccaacaatgatagactggattaagaaaatgtggcacatatacaccatggaatactatgcagctataaaaaatgatgagttcatgtcctttgtagggacatggatgaaattggaaatcatcattctcagtaaactatcacaaggacaaaaaaccaaacaccgcgtgttctcactcataggtgggaattgaacaatgagaacacatggacacaggaaggggaacatcacactctggggactgttgtggggttgggggagcgaggaaggatagcattaggagatatacctaatgctaaatgatgagttaatgggtgcagcacaccagcatggcacatgtatacgtatgtaacaaacctgcacattgtgcacatgtaccctaaaactgaaagtataataataataaaaaaaaagaacaggtgtagcaattcattttatttaggggaagttaaaacatttcctctatggaggactataagtagagtgaccatatgttgtggtttatgcctgttgctccagcatacttattttaccctcaaaaatgtcccagtttggaaaagaattttgtgatcaccttagtataagccacctttgaaagaaaccatgattctcaatttggggaggtgattatatttgcaaaacttgagggtataatgagctttggagacattatagtcccctaacccagctcaacctatctttttcctagttaagagatctttctggagaagaacccctgaaatgattcagggtttcggctcaacagaattggattattggctccaaaggcatctctcctaaatgcctgtttgtatttgcacatacacatgcacataaagaggtgatgtctgcatgctggaaaatggctgctctaactttcatgaaagactggtaagaattaataagtttaaagtttatcaggagaaacttaggtttagaagcaacatcctgaccatggtatttgtgagatacaagggcatagcaccaagagaagtgttaattcttttcagaataggtttgagaagtgcacaggcaactttctatttcaaatagtttgtatgtggtcattactcttatgtatatagtttttcaatttgccttttccataatggacacgatgatcttttcaactacctctcattcctcccagtatccatgattggctttcatcgatctagggcaggagttaaaagaaactatggcccacaggccaaatctggcctgccatggaaaaagaaataatgcagacaagaaaaaaaatggagccatttagagttgcttctgcaaacattttcaggcttcctcttcttaattgagcttcatttagttcaatgttaggatgagtccacatttcatgattatatttcagctcatatctagtgtttggagattgtccagagcctggtagagtggcagggggtgacccgaaaagtgaaatccacaaatggatttttttgtttgagtcaaaatgtcaatagctattttttctttcctgcctaggtgagtaatccaaattttgttgtgccactaaattctttatgccttcctccccaatatttgtcatgttattccagacatgcatatgatttattaacccagagactagatctcagcaaattgcttgaataggaacatgctttgtctttagttactaaataactggaacacatcctgaagatgtgctgttttactaagtagggaagtagaaaaagtgggtcatcaccatctagccaatagtccctaaccttggcatgaacccctgtgaaaattcagtgaatgccaaggatactctcttcagaaaagtgcatatttacacatgtaacacttgcatacattttcaggaagtccagccatatattgtgagtttaaacctccgtgctggcctttccctagctgttacagaattcttgttgtatggctgtcatggtcatggtagcttgaaatggaagccattaaatgtctctctcaaaaaacatgttattagtatatttatgggccacatccctcagctaccgtacaagcatttttctgattagccttcacagacatttttttattatgaagaagagccacttagcactcacttttacattaccattctcaccaaaaacgtcaagactagtttccccaaattattgacttgtcaactctctgattcttcaaaatgcctgttcagctttcacacaccccacacacaagttcatcattaatatataaaatatattccataaaagctcactcacatttcatctgcctctacctctctctgtttcatctgtttctctcactctatatatttctcttagccaaggttctgacaaatgtggggaactctttctagcaccaatcattaggtatggtgatggagtcagagagggagatggtgtctagacaccttcatggggaccttgagacacatgagctttttggagtattagacatcttggagagagttaatgtatttcatcctggatatctaacatcatatattaaaggcaaagttccttaagctctgcaaacacaaatatatgccacatctgcgccttgcagttgggatggtagtaataggtggtatattagtctgttctcatactgctataaagaaataactgaaactaggtaatttacaaagaaaagaggtttaattggctcatggtcccacaggctgtacaagaagcatggctgggtaggcttcaggaaactttcaattatggcagaagtggaagcaggcatgtcttacatggccagagcaggaggaagagaccaaaggaggtggtgctacacacttttaaacaaccagagctcatgagaactcactcactatcatgagaacagcaagggggaaatctgccccccatgacccaactacctcccaccaggcctgtcctccaacattggggattacaattcaacatgggatttgggcagggacacaaatccaaaccatatcaagtggtattcagattcatgaataaatgtttattgcttgttgtcttggtagtttagaatactgtagagcatgtgggttaatagaaccctaagactggaggggtccattaatgataattactgattcaattcagcaaacacttattgaacatctactctgtgctaagccctgagatattggggacagataaaagaataaaatgaatttttctgtctcatagggaattagctttgctcctggctgggtctttttaccatctgcatgaatttacccccctattttcctaattcaatgcattcttctattgtttctatgttctaccccttggtaaatgtcttagtctgtttcctgttgcttttaatggaatgcctgaaactgagtaatttataaagaaaaggaatttatttcttaaagttatggaggctgaaaagttcaaggtagaggggctgcatctggtgagggccttcttgctggtgaattctctgtagggtcctgaagcagtaccatggcatcacatggcaagggggctgaatgtgctagctcaggtctctctcttcctcttcttataaagctaccagtcccactcccgtgataacccatttatccattaacctattaatccattaatccatgaatggatcaatccattcaccttttaaaggctccacctctcaatactgccacatcagggattaaatttcaaaatgagttttggaggagacaaatcaaacctcagggagtttcttggcaaataggtatctctagctgggttgagacaagatttccagcccctatggcaaaaatgcttcttttcttatccttgcattagtttagcaggccccatttaatagggaataatgtgattgtttccctgtgattctgaggcaacatttctatcactgctatcattggtgatgtggaattgcaaatatcattagccgtgatgtattgactactgccttaaaattatagtatggagttgttgattctgactaatgaattgaatgtactctgcaaaaagccagctgtccatctttgagtgagttgatttttaacccctatttggtagctttagcagttttctactatggttgctgtaacaaatttccaaaatcttagtggtttaaaacaacaaatttatatttctacagttttgaaggtcagagattgtctgaactaggcactgactaggctataatcaaggtgtaggcagggctatatttatttctggggtctctgggtggagactccattttcttgcttttctggcttctaggggctgctggaattttttagctcatggtccccttccatattcaagccagagatgggagattgtttcctcacactgcatcacttaaatcttgcttccatcattacatttccttttctgactctcactcttctacctccctcttctgtttataatgacccctctacttatatttggtctatctggatggataatctgggataatatttccatcccaagatttgttgattttcaaccataattctatctgcaattttaattcctcttgtgccatgtaacctaacatattcacaggttctaggagtaggatgtgaacatctttgaaggcctttattctgcctaccacagtgacttgacttttttgttgttactttttattttggaataattatagaatcactggaagttgcaaggacagagaggccctgtgtatccttctcccaatgccccaatggttacattttgcataatagttctgtgtagttctgtatcactttatcacatgtgtatatttgtgttttttatttatttttagttttgtagaaacatggttttactgtgttgcccaggctgatcttgaactcctggactcaagaaatcctcctgccttggcctcccaaattgcttggattacaggtgtaagccagcgtgcccagccagcacacatgtatatttgtgtatccaccatcacaatcaagataaaatattatttcatcaccgctagagatctcttttgtgctacacctttatagtctttgtaattcacccccactcctttgccatatcaaacttgcaatcaccaatatattttccatatctaaagttttatcatttcaagatttttatataaatggaatcattgagtatgtgacttttgggggttggcttttttcactcagcgtaatgccctgagatctattccagttgttttgggcattaacaattcatttctttttactgttgaacagtattacatggtattagtgtatcacaatttatttaatcattcacctgtagggagaaattttggttgtctggagtttttggttattacaaataaaactgctatgaacattagcatacaggtgctttttgtttggttggttggttttgtttgtttgtttgtttgagtggggcggagactttctctgttgcccaggctggagtgcagtggcacaatctcggcccactgcaatctccacctcccaggttcaagtagttctcctacctcagcctcccgagtagctgggactacaggcgcatgccaccatgcctggtcaatttttctaatttttgtatttttagtagggataggtttcaccatgttggccaggctggtcttaaactcctgacctcaagtgatccacctgccttagcctctgattacagagttggaattacagtgctgggattacaggcatgagccactgcacctggcctagcatttttgtgtgaacataagttttcatttctctgggaaaagctcccaggagtgcaattgctgcattgtatggtaaatgtatgttttagttttttaaactaaaaactgattttgcagttttttcagaaactgaaaatctattttccaaagtgtctgtaagtacataacttattatagtctactagtatcaacattttacctgtttgagtaaattatagaaaccttacccctctttaagttcctttaaccttccccacttataattgccttactttctctacatatatctagaactacattagacaatgctacaatttttgcttcaaccctcaaacataattgagaaacccaatgggagaagcaaagtcaattatatttacccttttactctttctgttgttgtttctttctgaggtttctagatttcttcttttacattttttttctgttagagatcttcctttacttattcttttaatgcaggtttgctagcaacaaattatcttagttttccttcttctgagaatttattgatttcccattcattcctgaaggatattttcacctgatgtagaaatcctggttgacaggttgttgttgtttcctgaaagcatttgaaaaatgtgccatttctttctggtcttcatgggttctgatgagaaatctgctttcatttgaattgttttacacttgtagttagggtgtcatttctctcttgctgcttttaaggtttttttttttttctttagtctttagaagtttgactatgatgtgccttggcaaaatttctttgggttcatctggtttggtatatgctaagcttcttatgtctgaaggtttatgtcttttgccaagttttggaagttttcaagtattattccttcaaataatgtttctgtcctgccttctattcttcatggtttcttctgatgagagaaaacttagatcttgtttttgtagttctacaggtccccgaggcctgttcatttttctcgtctattttttctctgttgttcagactagatagtttctatcattatattttcaagttaagtgattcttttctccatcttcttcattctgttgtagagaccatacattgagtttttatgttttgattattatatttatgagactttctatttttcgtttgttacaagagtgtttctaattacttattgaaacatttttgtgatggctggtttaaaatctttgtcagataattctaatatctctttcatcctggttttgccacctatcaattgccttttttcattcagtttgagatctttctggtcattggtatgataagtgatttttatagaaatatatacgttttgtggtatgtcatgagactttggatcttatttaaactttctgttttatctggctttctctggcactgctctagctccaggacctccaattcctggggaagggagttgctgtcttgttactgccagatggtagtagaagtctgcttgcttgttgacagttggagggcaggacttctcattattgcttgttaggggttggaattcagccacatttcaagtgcttggtagccatgtatggttagtggctaccatattggataacatatatgtagagcatttctgtcactgctctaggaagactgaggttgggggagggagcagtaaaagagcttggcactacaggaattggggtttgggaaaactggcacagatggaataagacaaggatctagttattgtatctgaggtccatggctagggtttggttccaaaacctgaggtgctgtgagttctatctagagaaatatgggcacagagaactcatctggttaatatggatccagtagggcagagttagtatccatagtattaactaagttttgtcctctcagccattgtaaaagacatggtgtggcatgctgcagatcctagtaccactctatttgagtagagggaaagtcttccctattagatggcagttagtttgcttatttgtagcaacatacttgacctccatgactgaggtaaccattgattgaggaaacgttaacagaaaagagtgagttgtgaaaagggtattcatttagtttataggatctagggtttctttggcatcttggtggccttaatgttctaatccttgagacttccagcatgcttagccaggtggggagcatttatgtaagaactctgtccttcactgagctctgtgttgacttgttggcactttttgtccaagtcccaaagagttagtggaccctgttacacagcttctttgtacactgaaataactgttgccttctcaagtctctctttgcttagattagtgggggtgtacttaatgtagattcagtgttttcaatctccccttggggcagttcgttatattttcccttactggctctatgtgtgtatacatcctaatgtgcttgtatttatggactgcctgtgtactgtatctcttggcaagggaaaaggaatacctagtgtctattgaatatgtattgtttgtatagtatacaggtcacatgaccttttcccttagcaagacctgtatgtgcaaagctgtggctttgacatgttaagatatttcataacacagtcaaatccacttggctgaataggtgaaagaaaagggaattgagccagggctatagtgggatttttcacatctatgtcgtttgacttaaaatgaaacaaaaatacacactcatttgagaaagaagcagtttcagagttaggctgtaaagagaaaataaacatgctttataacccaaagccaaggtgttggttttaaaaccctagactatggctcacccagatccttccagtatgtgtatatgtggggaggaggtgagtgttgctggtctgctactcagagatatggagatggtatcatgggagcaaaatcccaatttgtcactttgtcttttaagaaggctccaaatatgccacttacttttttttctttgagaaggagtcttgctctgtgtagtggcatgatctcagctcactgcaacctccacttcccgggttcaagtgattctcctgcctcagcctcctgagtagctgggattacaggcacccgccacaacccctggctaatttttgtatttttagtagagacagggtttcaccatgttgtcaaggctggtctcaaactcctgacttcaggtgatcttcccgccttggcctcccaaagtgctgggattacaggtgtgagccaccacatccggctgccacttacttttgaagacagtggtcactagttgtgctgaggggccaaagggtcaggatactcttatacaaatctaagaagagaacctggaatcaccttttcttgccattgatcttaccattttcctataagccacagtattagtttgttttcacgctgctgataaagacatacctgggaagaaaaagaggtttaattagacttacaattccacatggctggggaggcctcagaatcatggtgggaggtgaaaggcactacttacatggttgcagcaagggagaatgagggagatgcaaaagcagaaacccttgataaaaccgtcagatcttgcaagacttattcactaccaccacaacagtatgggggaaactgcccccgtgattcaaattatctctgacaaggtccctcccacagcatgagggaatgatgggaatactattcaagatgagatttgggtgggcacacagagccaaaccataacattccatccctggcccctccaaatcttatgtactcacatttcaaaaccaaacacgccttcccaacagtctcccaaagtcttaactcatttcagtattaacccaaaagtgcacagtccaaagcctcatctaagacaaggcaagtcccttccatctatgagcctgtaaagtcaaaagcaagctagttacttcccagatacaatgggggtacaggtattgggtaaatacatctgtccaaatgggagaaattggccaaaacaaaggggttacagggcccatgcaagtccaaaatccagcatggcagtcaaattctaaagctgcaaaatgatctcctttgactccatatctcatgtccaggtcacgctgatgcaagaggtaggttcccatagtcttgggcagctccacctctgtggctttgcagggtatggcacccctgctggctgctttcacaggctggcactgagtgtggattttcctggcacatggtgcaagctttcagtggatctaccattctgggtctggaggatggtgggcctcttctcacagctccactaggcagtgccccagtagggactctgtgtgggggctctaaccccacatttttcttctgcactgccctagcagaggttctccgtgagggctccacccctgcagcaaacttttgcctgggcatccagcatttccatgcatcttctgaaatctaggtggaggttcccaaacctcaattcttgacacctgtgcacccacaggctcaacaccacgtggaagctgccaaggtttggggcttgtaccctctgaaaccatgggccgagctgtacgttggccccttttagcaacagctggagcagctgagacacaaggcaccaaattcctaggctgcacacagcatggagaccttgggcctatcccacaaaaccattttttcctcttaggctcctgtgtctatgatgggagaggctgccatgaagacctgtgatatgccctggagacattttccccattgtcttggggattaacatgtggctccttgttacttatgcaaatttctgcagccagcttgaatttctcttcaaaaagtgggtttttcttttttactgcatcatcaggctacaaattatctgaacgtttatgctctgtttcccttataaaagggaatgcttttaacagcacccaagtcaccttttgaatgccttgctgcttagaaatttattccaccagataccctaaatcattttgctcaagttcaaagttccacaaatctctagggcaggggcaaaatgccaccagtctctttgctaaaacataacaagggtcacctttgctccagttcctaacaagttcctcatctccatctgagaccacctcagcctggaccttattgttcatatcactgtcagcatttttgtcaaagccattcaacaagtctctaggaggttccaaactttcccacattttcctttttctgagccctccaaactgtgccaacctctgcctgatacccagttccaaagtcacttccacattttcaggtatcttttcagcaatgccccactctgctggtaccaatttactgtattggtccattttcatgctgctgataaagacatacccgagaatgggaagaaaaagaagtttaattggacttacagttccacatggctggggaggcctcagaatcatggcgggaggtgaaaggcacttcttaaatggtggtggcaagagaaaatgagggagatgcaaaagtggagacccctgataaaaccattggatctcatgaaacttattcactaccacaacaacggtatgggggaaactgcccccatgattcaaattatctcccactgagtccctcccacaacatgtgggaattatgggagtataattcaagatgagatttggtggggacacagagccaaaccatatcagccactgtggggtgggtggttgtgtgtgtgtgtgtgtgcacgtgcatgtgcacatttttctccctaattcagtaatgctttgttagctatacttacatggatttagcacctgaatgaacagaaaaacccatttgtttattgtcgaaatagtggggatgccatgacattgctgactgccatgatttgtgattcattaaggccaggatacttctagacaatcactgaaagttgaaaagcaggtaagtgaattaatctcttccctttgattttcacctttaatattataaccttagatatgacttcaatatcttccagcactgagtagaattggttaagggaaggccagagtggatgtagttaacaccaggaatggaattccttttgttttctgaaaattcagtttatagtttattagactgaagaatccacaggcctgcctcagacaaccaggccatatactagacaagagcactctcagattacactttgaaatgaaagcctattttggcataatatgcactgaaaggaaaagtgtgctcctaggtatgctctttactttgccttttggactgtcctcttgggtttcctcagcctttctctgatctgtatggctctaggccccactcccaataaccctctaggaggctctgttccatgtcatctacttatggcactgaaataccaggtgtcacatggtataaggtagtagtgaccacaaggggcccagaggaggatgtttgccgagggaagcagcctgtttccagatcctcaggtagagggtgtgctcaagcagctgagacagcctgaggtgggagaaggagcagtggatgataggtcagagctgccatttccattggttgttgagatggccagctgagggagacagttgtttgttcagtggtcctgaggaagtaaaatcatatactggtgttttttgattcaggcgacagattgatgttaagggaccataggcatttaggctgccaataataatacctgatcatcctatagctccttctaaaggactcaaaggactcctatattttatttcatttggcctcacaaacatcttcatggacttaggaaaggtaaatattgatagtcatgtaggacaagcttttctctctctctgggcctcagaattttcaaattgtgaaatggaggcttggtctagagatgatgatctctaaggtcgtttcccacagtaacagtttctatggtggcaacatcttccaggtggaggaattaagtctcagacactttaaagtgagttggacacaactacactctctatcaggtacagagtgatgattacaggcccaggccatgatcccttcccttagcttgccctattagtggtctctttgaacagtgaggtaaggggcgggggggggggtgctcttgcttctgaacacacaagggctttacttatctgtttcatttaacactctcccctcacctgaccaccttcccaaactacctcctgtcactcatcagcagggccttcaacttttcccttgatgttcctcgggattcatatcttgtttgactgtagctgttttcctggtgtattgtgtggctagatgcaaagtcattgctacccttagagagtaaagtctggaaccagcacttcagttacatcaggaaagagaggctgtgcctcctgggtgtggcagggggtcaaagtgagaagagacattcaaaaacatcatattataaggtgccctgaaaaagcaaggagggtctgtagattagggctggggaaaaaggactggacaaaggtatgatgggggaaatcagacagtgagttgatgaaagcaaatacattcaatgatcaattaatatgcagcaaagaggctaggatgcctgagatttctttggagttggaggataaacatggcatttatgactgtgacagggatttatcttgggagagggcagtaggggaaaaatgaaaagctttattttcagcaagttcagcttttgtagtaagatatttagcttaagaaatgcaagctaagtactgtgagggaataaattcagagaaccatattccccatatgattcctggaaaccagtaggaatttggctcaagaagggacggcagaaggtgatttgtggtgttataacagccgccttggaagccaagatggaaaatttgtccctgaaaggctaggcagttggaggagactcactggaaatttctgtccggagaaaataaatgaaccagagaagagcttaaaaacacatggtggagggtgaagtctgggacacccaggaacccatatcttgtaataggtccacttgttaaattcctggcttatggtctagaacaggattttgttcatttccttggaacaaaaaggtccccaggcacccagagcttctatcttatcccagtccacagcctcttacccgttctttcatttctcttttcttttcctttttttttttttaagagatggggtcttgctctgtcacccaagctggagtacaatggcacaaacacagtttactgcagccttgaattcctgggctcaagggatcctcctgcctcagcctcccaagtagctggcattacaggcgtgtgccaccatgcctggctaatttaaaaaaaaaattgtgtagagacagagtctcgtcatcttgcccaggctggtcttaaactcctaggctcaaacaatccttccacgtcagcctcccaaagtgctgggattacaggcatgagccaccctgcccagccttttttttcctatttctctcattttaagaataaattcatttatcatttatcaaaagaatccatgaaaatttcacaaatattgaaaaatagggaaaagaaatagttcaacgttttgtttttagaaattatttgtgtctttatttttgtttttgttttttgttttgttttgtttttgagacagatggagtctcgctctgttgcccaggctggagtgcagtggtgcagtctgggctcattgcagcctccaactcctgagttcaagcaattctcattcctcaacctcccaagtagctgggattacaggcacccgccatgatgcctggcaaatctttgtatttttagcagagacggggttctaccatgttggccaggctggtctcgaactcctgatctcaagtgatctgaccgctttggtctcccaaagtgctaagattacaggtgtgagccactgtgcccgacgtttgtctttattttgaataattataaaagtattgaaaagactaggaataatataagaaatacttggatctctacttggagaaataaaacattacagacaagttaaattatatcccctattttcagtcacattcctctccattcattttcagaagcaagcactaagataagcttggtatgtattcttccattttgttttatacttttgcatgaaagtatgtctctcctctcccctcttcccataaataatatatagagcttgtctgtgtgtttttaaaatttatgtaagtaataccttaatgtatgtgtcattctgcaacaagtttttttgttttgttttgttttgtttttacccaatatcttgttttggaatttattctattctcttttttacattccccttttctactcaaactgtaccctggagctgatgacatgtacattactttttcatatttttatgataaaaataatatgtaaccacattacaggaaagttggaaaatccaaccaattgatggctcttaggaccagagagctcagtgtcctactgtagacttgatttgcaaaggttctaggcagctgggctaacctagtggttctgcctgtaaaatactgaagagcaaaattggaagtctctagggacacttccttgcctgtctgttaccccattccatgaagtagtaaaacagaggcccagagaaggaaaatgacttaacaagggcacacattcattgaatattgtactcgagatttctggatccctgtcttgtacttgaaacgtttccaaggaaaaaaagagcggtggggagagagagagagggagagagggaaaggaaacctagaactgcaatttttcatcgtaaaaattatccattttaataaagcatgggaaatacagaagagtaagaaaaatgaagatatcaagaattgtccattttcctattttgaacttctgatcttttttcttgtacaacttttgtttctttgattgtaccctatcttgcttttttccacttaactttataatgtcataatgcacatctttttcaaaaagcagacttctacactgaaatcttgacagtaaatatttttaaggcacatatttgctatttagccatttaaaatggtataggcagggaattgtgtagagaggaaaacaatggcgtgggatattttccagcaagtttgttcctgtcctttggctagatctttttcttctaaaacaaaacaacaataacaataagatctaggtagacatttctaggattcctgctactaaagtattcattcagagaagtttcattactctctcaaatggcctagggtgtgaccaagggtcactctaatatactcccctccacttacaaggcaagggcaagtgttgcccttggggcccaaagggagccaattctggagctacctgggtcatggaagttgaccctgaggaaaagactgtggtagtttccccagtccatggagtgaggagtgaggtggggtgctcaatttttccagagcctgagcacaaagacagtgacagtcattaaaacttcttcagcacttactatgagaggcaagacatccattcccaacaaagccacaccacttcacacacacacacacacacacacacacacacacacacacacgattagaattgttgcctacagttttggttgcattgtttaattgtaatagtgcaaaagtgcatttaactatgaaggcttgctgggagaaaggaaagtgacggtttattattctagtcagttcaacatgtttgaaacagtgaagcaatgagagattaacctgctcgctcaaagtcacacagcaaaaaagtaacgatgctgagattaacaaataaaaaatgaaaacacccttattcttggtcttgggtcttgaaagctgggccttagcctgctgaagctcactgtacttctgctttaatcagtttaattcattgctagcttgcccttgccacctttgattctctttgcattggccaaataccaatttgcagtagttgttctgaagtgcttgccagtttcaatttttcaattccaggctctattctttctcacagggctagaaagccacaagtcacactagtggccagctgtatctatgacccaaacttgctcaggtctgtgtgtgtgtgtgtgtgtgtgtgtgtgtgtgtgtgtgtgtgtgtgtgtgtgtgtgtgtgtatgcctgagaatcagtgaggactccaggactgggaatgttcaaggttttgaattgaaataattgaacaaattcctctataaagaaaccttttcccctgccaaatgattttcttcttaatgatttctgcagttgattaacgtttagaaataggcagtgaagcctcagtgaacgtgtatttgctaggccatagggtgctcttgcttccaggttgtagaaaccaatgttgaaacaagtcccagctgtgtttacctccagattcaagtttcaatacaggggagctcctttccacatctattttccctccttcctgcaaaggcagctgagctaaagctgcccttaataaggagtggccttaggcactgcagtagcatttacccttcaaactgggcagacaacttctctgtggggagtctgagcctgccacacctatcacacaggctttgggaaatgtgaagtggcacttactgcaatctaacctccagagaacttgcctgcatgctggccagttgggctatgggaaaccttgccattttttgcctatccaaaggcccacacctaaacaggtctgaatgcaaatgcatgggtgaaaggggtaagcgaggggcactacagaaagctcacaactgtcctcagacccaggaggatggcaggccaagaagtccattattcatttgtttccagtgtctcaggtaagtgaagattgcagtcctcactggaaaagacaagaggggcaaggagatacatgagcccagaagagctacaatggacctcatttacagataagctagataggcacttcccagtctttttgtaccctccccaatccttctgttacctttttttgtaagacccaactttgaagagttgttttttctcctgaaaactgcacttattaaataatagcttttctgtgttcctatacatatgcatacataaaactgtaatatatatacatatatatgtatatatatacacacacataaacatacatgcatcagagctgatcagcacagagagccaatgttattctgcttggttgctataattccagggaaaggtaaaaacatttagctaactggggcagctgtatgaaaaaactctccattttctttaaagttctgaaatactgaaaatggtttgaggatcccatttattaccttttttttgttaagatgaccagggtcctcaggttggaaactactgatctagttaactcctcttccctatttttgagtcagaatgtaaggcaaattttggccaaatagaaagttagtctttgagctgggattaaaactcatcccactgggagccagtttgcatcccttcacttggtttcccctacgacatttctgagctataaatctgactcatccatgattaattttaaaaaatgtcctgaatgatacttttggcagtggtctttaatatatattaaaggcacatatggtggtttggaactgccttgagatttgagacaggacttcaatttctggtagaggtattaaaggagctctctccatttatttggagctgtaagtcatttgtagataaaatgtacttagggagtgcctactaagtgtgagatgctatcatagctgggagaagggaaggggtaggagtaacaatggaggagtgggttagtagaacagcccccatttcaggaaaactatattttattagggagatatatgtgcacaggactatttctatggcaaggcataaaacagcgcatgcctcagtagtaaattgcacatgtaacactttgtccagcagaattctctggaactgaaagatgtataatggaaccaagtaaaccagcaactgtaccatttctaactgtgaggagaaaacaagtggtgaaagttgtgcctcacaggtgctttgtgcaacaaattacaacaaaatttagaagcactaccatcctggctatttatatgtttatcattaaacctcacattgacatcttagctgcaattgttttctacctccaggaaacaacctaggagatcatctaaaccatctttatctgaaacattaattacttttgttagattatcttgcctagaaatatccatagacaggcagctacctctaaaggcaatccatgccagaaagcccattctttatattttcttttactatttttattgtggtaaaatacacataaaatttaccatcttaaccacttttaagtgtacagttgtgtggaattaaattcattcacactgttatgcaaccatcaccaccatccatctccagaattcttttcatcttgtgatactgaaactctgtacccattaaacaacagctccctattttcccttctccccagcccctggcagccagcattctattttctatccctatggatttgatgactctaaatacctcatgtaaatggaatcatacagtatttgtctttttgtaactggcttatgttcatcaccataatgttcttcagtttcatccatgttgtagcatgtgtcagaatttacttctttttaggctgaataatattctattgtgcatatataccacattttgtttatccattcatccatcaatggatacttgatttcctttcaccttttggctattgtgaatgacaatgggtgtacaaatatctcttcaagaccctgccttcaataattttgagtatatacccagaagtgggattgttgggtcatatggtgactatttttaatcttgtgaagaatttccacactgctttccattgtggttacaccattttaccttcccaccagtagtacacaagggtttccattttttcagatcctcaccaacatttgttgttttctgtttttcctttttctttttctttttctttttttttttttttttgagacggagtctcactctgttgccaggctggagtgcagtggcatgatcttggcccactgcaacctccacctcctgggttgaagcgattcccctgcctcagcctcccgagtagctgggactacaggcatgcaccaccacacccgtctaattttttgtattttagtagagacgggattttcaccatgttgtccaggctggtcttgatctcctgacctcgtgatccgcctgcctcaccctcccaaagtgctgggattacaggcgtgagccaccgcgcctggccctgttttttcaatagtagccatcctaatgggtgtaaggtgatatcttattgtggttttgatgtacatttccctaataactagagatgttgagtatctgctcttgtgcttatttgccattcatatatcttctttggagaaatgtctatttgactcctttgctcattttaaaacttagggtgttaggttttttgttattgagttataggagctctttatatattctagatattaatactttaccagatatatgatttgcaagtattttctttcattttctacattgcccttttacaatgttatttcacaataatgttgttcaatgcacagaagtcttagacttttatatactccaatttatctattttttctttggctgcctgtgctttgttctttccccccaagattactctggctattcagggtcttttgtggttccatgtgagttttaggattgtatttttctatttctgtgaaaaatgtcatcagaattttggtagggattgcattaaatctgtagatcactttgggtagtatggacattttaacaacattaattattctaatccatgaacatgggatatcttcctatttatttgtgttttcttccatttgtttcatcagtgtattatagttttccatgtacagatctttcacctccttggttaaatttattcttaacttattttattgtttttgatgctatcataaacagaattgttttcttaatttctttcttgggtagtccattattagtgtataggaatacaactggtttttgtatgttgattttgtgtcctgcagcttcactgaattcattgatcagttctaacagttttttttgggggacgatctttagggttttgtatatataagatcatgtcatcagcaaagagagacaatttaacttctttctttcctatttgatgccttttatttctttcttttgcctaatttttctggctagaacttccagtactatgttgaaaagaagtagtgagagtgggcgtccttgtcttgttcctgattgtcgaggaaagtatttcagcttttcattgatgagtatgatgttagctgtgggcttgtcatcattgggtttttgatagggattgcattacatttgtaaggtctctctggtggtatttacatcttaacattaagtcttccaatccatgaacgcaggatgtctttccatttattagtgtcttctttaatttctttcatcaacattttgtacttttctgtgtacaagtctttcttctccttgattaagtttattcctaagtattgtttgtgatggtactataaatggaattgatttcttcatttccttttctgattgtttcttgttagtttatagaaatgcaactaatttttgatgctgattttgtatcctgcaactttgctgaatttgttattagttataacagtcttttgtggaatcattaggatttttcctatttttaaaaaatagaacagtttattttagaacagttttacatttacagaattattttaatgataataaagaaaattcccacataccccacaccatcttctcctattattaacatattccaagagtgtggtacgtttgtcacaattaatgaactgatattgatatattataattaactaaagtctatactttatatttcttcagttttcttctaatgtcctttttctgttctgaaatcccatccaggataccatatgacatttagctatcacgtctccttaggctcctcttgactgtgacagtttctcaggctttccttgtttttgatgaccttgatagctttgaggattcatggtgaggtattctgtagaatgtcccttaattgggattcacctgatgtttttctcatgattagactggggtaatgtgttttgaagaagaccacaggaataaagtgcccttatcattacattgtattaaggatacatgctatcaacacgactttaacactgttgatgttgactgtaattatctggctaaggtagtgtttatcaggattctccagggtaaagttacatttttctcatttccataatgtactctctggaaataatcactttgggcagttcatactttaagactggggagttatgtgtcacctccttgaggatggagtatccacctacattatttggaattcttgtgcactggagatgtatctgttcctgctcatttatttatttgttcaatcatttatttatataagtatgtacacatgtatatcatgtatatttattttaaactttggattatagtccaatactgctttattttgtttctcaaattgtttcagctttggccattgggagctttttttggttgactcctgtgtccctttgacataccttcaccatgtggtttaatttgttttttcttttgagattgatttttgttttgccttctgccatgaaaaacttaagctctccagcatgtgacagcccttcagatttataaaaacatccaccattaccccctctagtgttctccagactaaacatttcccactcattcctttacacattcctcatgtgacagatttattgaccccttactcatctagcagctttcttctggaaacattccattttgtcagttacctgaaatacctcctttcactctccttaccctccacaacaattataaaatttaagagaaatcaaaggtagttcttctactagaaactatgtatgatagtaaatagtacccaggctgtgtcactgaatgaaaaaaattatccccatattagaattaagacccttagaaattagaggagaaatatgtttccattttgtgcagagcttactatttttcaaagctatttaggaaactattagtttgactctcctaacccatgtgggaggtaggtagggcagttagtggtatgcccagaaagccaaagcccagagaaggtgccttatccaaagtcaccatatgagttagacagactgggttctcttgactcttactccagtaaccttaaaattaggtttaaactttaactgtgtaggctaatttttgtttgtcagaccctcaaccattaatcagaattgccaatacattttcttttgagccgaacttagcctcccaatataatatgagatatgaaaggtaagtctgaaatgcaaacacttaagaaatgtttctagaaatcaaaatcatttttgtatgctagtagatatcaattgggtgatcaagccagaacttagaaagcatatggttagctttgggaacagaagtgtcaacagaacaaaaatgaatattttctaattgtccttgcttgctgcggatattaggcagctagctttgtgtctttttcagcacttatcaaattctaatggaaaggtgctgaggtgtggctaatcccaaacagtgtataatccccaaataatttatacagtaatatcctgtcacacatacacactccagtgcccagtctctgctcttctattttggaggttgcagagactgcactagatttggcagatggcaccagtttttattcctgggctgtctctgctcattcacacccagggtaaggaattagtgggagccttttcatgtattcctttataaactgagcaggagagaaaagaaagagctagaaaacttttctctcttactacctgaccactccttcaatcttaaaaccagttcgtgcaaaccagaaattgtagtatgtacagaatatttcaagtcacaactttctgggatgaatggtttccatacccaaagagcctcctgcctttaaggagtcatcagttgaaaagaaacagtcagatatctgtggcattacctactggccagagtgggatggagaaagtggtctgaagtttagttagcaaatgttgaatttcagggttgaggaaggggaagtatggtatctagataaggaagaaggcagcaaaggggctgagagcttttcaactttggtgacaaggatggggaggagtaagtgggaacagacactatccttacttggagagtggtggttgctgaggagaaggacttattgctttatattgaattttagcattaatactttctggatctctgagatggagagttgacagaagaacctaggaagcatgactaagtggttgaatctgctatggaaaaaggggaaacggggcaggcttttacttatttgaacctaggtactttgtttctttgccacctaaaagttctgggatgaactgaatgaggaatatgaattgagcagataagattccttttactggagaaaaactaagtcctttggaaacttgaacttttttctcattcaaattcatttctaggccttattcattcattctatgtttttttttttttttacacagtagccaccgcccccgcttcacacccctaccccctacccttcccagcctctggtaactatccttctactctctgtcttcatgacttcaattgttttgatttttaaatcccacaaataagtaagagcatgtgatgttcttggcaactttgtggaaaatgagttcactgtaggtgtgtggaattgtttctggattttttattctgttccattggtctatgcacctgttttttatgccagtaccatgctcttttagttactatacctctgtagtataatttaaagtcaggtaatgtgattcctccagttttgttctttttgcttaggaaggttttggctattctgagtcttttgttgttccatatacattttaggatttttttctatttctgtgaataatgtcattgatattttgatagagattgcattgaatctgtaaattgtttgagtagtatgcacattttaacaatattgattcttccaacccacaaacatggaatatctttccattttttggtgtccttttcaatttctcttatcagtgctttatatttttcattgtagagaactttcacttatttggttaattcctaggtatttaactttatttgtggctgttgtaattgggactactttttgatttctttttcagattgttcactgttggcatatagaaatgctattgttttttgtatgttgattttgtctcctgaaacatcaccgaatttgtttactatttctaacagttttctattggtttttccaaatataagatgatatcatatgcaaacaaggataatttgacttcttcctttccaatttggatgccctttctatctttctcttgtctgattgctctagctagggctgccagtactatgttgaataacagtgatgacagtgggcatccttgtagtgttccagatcttagaggaaaggctttctgtttctcccaattcagtgtgatactagctgtgtgtctgtcatagatggcttttattatgttgaggtatgttccttctttgagggtttttattatgaaggaatgttgaattttatcaaatgctttttcagcatagattgatatgatcatattgtttttatcctttattttgttgatatgatgtatcacattgattgatttgtgagtgttggaccatccttgcatcccagggataaatcccacttggtcatgataaatgatctttctaatgtattgttgaatttggtttgctagtattttgttgaggatttctgaatcaatatttatcagagatattggcctgtagttttctttttttgatgtgattttgtctggtttcagtatcagggtattactgacctcatagaataagtttggaagtattccttcctcctttattttttggcatagtctgagtaagattgataatagttgcttatagtagctactaatgatcctttggatttctgaagtatcagttgtaatgccgtctttttcagttctgattgtatttctttggctcttctctctttttaatttattttattttattttttgacagaatctcgctctgccacccaggctggagtgcagtgctgtgattggctcactgcagcctccgcctgccaggctcaagtgatcctctccctcagcctcctaagtaactgggactacaggtgcgtgccaccatgcccagatatatttttttttttgtacttttagtagagaagggttttcactctgtggcccaggctggtcttgaactcctggactcaagtgatctgcctgccttagcctcccaaagttctgggatttcaagcgtgagccaccatagcctggctctttttatctcagttagtctggctaatggtttgtctattttgcttaatttttcaaaaagtcaactgttttggaaactggaactttttaattctccctcacccacaaaaggattattcattgtaaattgaattaacatactcttccctagatggggtatctcagttaatgggaaagccaggtcatgactccaggtccaaatggccctgtctgatcctggtggttgggcagctttgcataaatttaggatgctataatttctgcaaagcgtcttatgattccaatattagactttcagaaaaaccttccacatcatccatgcactgtgtgtacatgtgtgctgaatatttttaaaatcttacaacttgcctaaatagagtttttccatctccatcttgggtgcttaatcacctcatcttcttttatctcttctttctctcctatgtttgttgaggaaacaagattaaatataacaatttttacattgcacacaaaataaaatggcttgtttagctgtgactttaaggccacgcatgagacagtctgtacaggacttacctccctcatcagaggaaccctttgagtctttaaaaaaggtgaggatgaaaaacaagaaaactcttttagattttcagctctccatttgctctgcagcatgagaactaagaagcaggtggcaaagatagacagtaaactagaaggaaacaaaacaaggtcattttcctccttgtaccttagcttcttgaatgataatttaagataccttcaattttctgttatctgaagtagtctgctttatggattacttagactcttgtttcttcatcctttaactgtttggtgtcacttcttccaaagctttttaaaatatattttctgattctactggaagagcagtcatagggtgtaggcatgtaggaggaaacaaaattatagggacagaaatcagtctattttctagtactttaattccttaagacctaagtcagtatccttatttttaaaaactactgtctagctccccatccttgcccatttctttttctatacatacatattctctctctctccatcctttccttctcagcaagtctggtagacagactagtctgatgcctcaaaaatactctaattcgtagaaagaaagtaaattctgcctctgacgttccattccccctgtggttttaattagggtaaattctcctatgctcactttgaaacatgccttgggatcttagggagatggcaggcagatggcgtattaatgcagggtgatgtttctcacttcatggtgcccatgcaacatttattgtcattaaaatagtgtcattcaaatgaggtggctgatgttggaaaatgaatgcaaagttgatcattgttctgtggatctgagctttgatgaagaaattgaattagaggcagcatttcaactctgtttaagtaataagtatatatgtatctataactcagtagtgaaacctttcagactgacaggagggcaaagcctctaagactatattagggtttacgggtataaaaatacgtgcctctcctgctttaccaggctgtggggagaatgaggaaaataatatctgtaaagtgacctgagcacccagaaagaaaaatttagatgttttattagacctacgcaagatctttggttagttccccagagccctgtaaagtcttggaagccctgtaacaaatttctcttttcccttgtcaggtttttgttttcccctggtgcccaggttaaagagaaattgatttctttccatcttgtgtttagcttttgtccctctgcattgaggctttgaattgagaatatttctttgggtctgtagggctgtccaatgatagttaggcttaaacattaaacaaccttacagaactaattaggctttattgcctgtggccaagtcaacgaattttgcttcatagaatttctgagagaaaaaaaaatacatatttaggacttggtaaaacttttcttaaaatgtctccttgtaaatgccagcgttgctgaccctgtgcaaatattttgtaatagcccggcttgagaacatcccccacatttctctgttgtattctttatgacttccctccaggttgagctgtgaaagggtgaggggaaaggagccatgtcggagaagtagaagagactgaatcaaatgtttagagaacatagcttgattaattcaaaactgaagccctggcctctctagtctcatgttccacagcaataatttctccttggccagaagcctaagcatctgtgtccaaatctcatactctttcctaaatggattcatcaagtcagaccttgagttgcttggttttttctgaaccaccccctaatttaagttaaacttaaaaatgggagccattaaatagcaaaacaaacaaatacaacaataataacaggacattatgtcctggccctcagaggtcaatttaatgtgattagcagcataaaacttcacaacgcctttcactggaagattaccagaagcaacatcattcagtatgttgccatgcactgccattctttcactttggcattatttattgattgtagcagaaacacaatatttgtacctcttaagcattttagtttcctttaggcttttctctagtaaatgtggaactgcatcattttgttaaactgttctgaagtctaaaaaaaaaaaaaaaccctcctgaatattgtttacatccctggttacaaaggccagtactgaggcggagctgctctgcctgctttgattcttatcaagggcaacactgtatgtgtgcatatgtatgtgtgtgtgttcacacaggagagggtagtaagtggagcaagagttttaaggaaggagcggggctggaaggaaaaaaactttcaatgaattgaaactgcataatgaaaagattctgaaatttaattacaaaaatggctctgttttttctctcacctcctcctcgctcccttttctcctctccatcctctccaaaagcactgaagtaaaatgagactgtcagatcaaagccacacacccactctaggtctgttttgagaaagggatttttttctccccttatttactttgtagcagtggcagcatgtctactgcaggatgcagtgacagtgtggagccttgtcactgttctgcttgatctcctcccgtgtgccactccctggtctggtgagcagggtcaaagtttcaaatgatgactgtggccacagttctcaccatctcttgtgttttcacacttggccattcagtatttaggcattgtccctctgacatatggcctgaaagagttgaagattaagtttccaagtttggaaatgcccaagcgtagccatggagggtgtatttgtcccatgtggctgcgggttctgttgagtatttttgcaaaaatattaaaatgtctacttaggatttaagaatatgtttgatgatatgtacataattcatagcgcattttagggcacacctgcattatttaatattggagtttctctttttaagtttttttatttttgtctaggactctttagagtgcctgtgcctgggttccttaatattctttcagaccagttgtcaatttccaagtgccttaaaatagagctattgggttttcttggccttttctggccctcattctcttctagttcatgatttttcctcaaaataaagttgtacctaattaataaaggtatataggtattcagttttaatactgtctataaagtatgactcatactttctctattaggaacatctttgttacattgaatgcatatctctcctgtagttggttgagagaaacatgtaggtctaggatcaaagtcctagaacaggatcagagtcactggaaatgcaaccaaaatggggatagaggctcatgggacaagaactggaatgtgtgttgtattgagctacagggagaaggaagaaactaagtaccgatttggtagagagaaagaggggcagagagagagagagagagagggagagagagaaagagaatgagagagaatgagagagagagagagagagagagagagacagattaggttaggattaggttaggaagaaccttgaaacatcagacaaaaagaagaaaactaaagcagactgaagagcagtgtgtctttgattatggctattcaccaaaccattcttattgctctttctgttattattaagctatctctgagatgtacacagtgtatatctcagtgcacaacagacctaccagtgtagatcttttaactcattcctttaatgaatttttatcactttcacagtccttattagctctctttttaatggtttttttggagcccataactagatatgccacctcaggaagaattttatcagtgctctgggaagatggatttactattttgagttgtatttgtacaccatgcaaccatgaaccacttagaaaccaccttagtgactcatactttctttatggtccattctgattctgaaatcctttgagtgttacatttctcaatctgattttaacaaggattaaaataaataagtaaataaataaaaagttttctaaggtttgcgaaacactattactgaaatttagaggacttgaggcctttaaatcaaacaatattttcattataatttgcctttccatccccatttggtcttgccacatctatgctgcgacaaaagaaaacctttagtacctaatatcggtacttggtgttcattcatctcactgtggttttcactttcaaagcacaatacattgcttccccatcccattccttttgtttctaccattctactttggccttggaaattaaatattgcatcctgtccctcacagcttatttctgcctctcaattttgcagatctgggcattaacggaaataataagcactttataattttatagtgctttataattttcaaggtattttcacatccattgtcttgagtgatcctctccacacctcactatataagcagggcatggattattaccccattctagctcaaggccatatagctaactaagggaagaaccaataaagtttctagatgaatttgtttcactacacttcttccaccatcagttccatggccaaatttttttcctgctactttttgaaaactgagtatatataggaattttctttttggtatataaattttgggaacaatgaactattcgtctaggtgagtaaaagtgtatgtctgcatccatttgtttatgtgaataatatgtgttcgctaaaacttgaaaatgtttgacatcattctttttgtttgtttgttttctttagtttttttattgtactttagattctgggatacatgtgcagagggtgcaggtttgttacataggtatacacgtgccatgatggtttgctgcacccatcaactcgtcatctacattaggtatttctcctaatgctatccctcccctagcccctcacccctcaacatgccccggtgtgtgatgttcccctccctgtgtccatgttttctcattgttcaactcccacttatgagtgagaacatgcagtgtttggttttctgttcctgtgttagttttctgagaatgatgttttccagcttcatccatgtccctgcaagggacatgaactcatccttttttatagctgcatagcattccatggtgtatatgtgccacattttctttttttttttgtttgtttgtttattattattattatactttaagttttagggtacatgtgcacaacgtgaaggtttgttacatatgtatacatgtgccatgtttgtgtgctgcacccattaaatcctcatttagcattaggtatatctcctactgctatccttcccccctgcccccaccccacaacagtcccaggtgtgtgatgttccccttcctgtgtccatgtgttctcattcttcagttcccacctatgagtgagaacatgccgtgtttggttttttgtccttgtgatagtttgctgagaatgatggtttcatccatgtccctacaaaggacatgaactcatccttttttatagctgcatagtattccatggtgtatatgtgccacattttcttaatccagtctaccattgttggacatttgggttggttccaagtctttgctattgtgaatagtgccgcaataaacatatgtgtgcatgtgtctttatagcagcatgatttataatcctttgggtatatacccagtaatgggatggctgggtcaatggtgtttctagttctagatccctgaggaatcaccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttcttcatgtgttttttggctgaataaatgtcttcttttgagaagtgtctgttaatatccttcgcccactttttgatggggttgtttgtttttttcttgtaaatttgagttcattgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgctgccattgcttttggtgttttcgacatgaagtccttgcccatgcctatgtcctgaatggtaatgcctaggttttcttctagggtttttatggttttaggtctaacctgtaagtctttaatccatcttgaattaatttttgtataaggtgtaaggaagggatccagtttcagctttctacatctggctagccagtttttccagcaccatttattaaatagggaatcctttccccattgcttgtttttgtcagctttgtcaaagatcagatagttgtacatacgcggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattgtcatgatattgattcttcctacccatgagcatggaatgttcttccatttgtttgtatcctcttttatttccttgagcagtggtttgtagttctccttgaagaggtccttcacatcccttgtaagttggattcctaggtatttcattttctttgaagcaattgtgaatgggatttcactcatgatttggctctctgtttgtctgtttttggtgtataagaatgcttgtgatttttgtacattgattttctatcctgagactttgctgaagtagcttatcagcttgaggagattttgggctgagacgatggggttttccagatatgcaatcatgtcatctgcaaacagggacaatttgacttcctcttttcctaattgaataccctttatttccttctcctgcctcattgccctagccagaacttccaacactatgttgaataggagtggtgagagagggcatccctgtcttgtgccagttttcaaagggaatgcttccagtttttgtccattcagtatgatattggctgtgggtttgtcatagatagctcttattatcttgagatacgtcccatcaatacctaatttattgagagtttttagcatgaaaggctgttgaattttgtcaaaggccttttctgcatctattgagataaccatgtggtttttgtcattggttctgtttatatgctggattatgtttattgatttgcatatgttgaaccagccttgcatcccagggatgaagcacacttgatcatggtgggtaagctttttgatgtgttgctggatttggttttccagtatttcattgaggatttttgcatcaatgttcatcaaggatattggtctaaaattctctttttttgttgtgtctctgcccggctttggtatcaggatgatgctggcctcataaaatgagttagggaggattccctctttttctattgattggaatagtttcagaatgaatggtaccagctcctccttgtacctctggtagaattcagctgtgaatccgtctggtccctggactttttttggttggtaagctattaattattgccacaatttcagatcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgggatcagtggtgatatcccctttgtcattttttattgcgtctatttgattcttctcccttttcttctttattattcttgctagcggtctatcaattttgttgatcttttcaaaaaaccagctccagggttcactgattttttgaagggttttttgtgtctctatttccttcagttctgctctgatcttagttatttcttgctttctgctagcttttgaatttttttgctgttgcttctctagttcttttaattgtgatgctagagtgtcaatttcagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggactgctttacttccaagaatgtggtcagttttggaataggtgtggtgtggtgctgaaaagaatgtatattctgttgatttggggtggggaattctgtagatgtctattaggcccgcttggtgcagagctgagttcaattcctggatatccttgttaactctctgtcacattgatttgtctaatgttgacagtggggtgttaaaatctcccattattattgtgtgggagtctaagtcactttgtaggccactaaggacttgctttatgaatctgggtgctcctgtattgtgcgcatatatatttaggatagttagttcttcttgttgaattgattcctttaccattatataatggcctgctttgtctcttttgatctttgttggtttaaagtttgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgttccttttaattggagcatttagcccatttacatttaaggttagtattgttatgtatgaatttgatcctgtcactatgatgttagctggttattttgctcattagttgatgcagtttcttcctagcctgggtggtctttacaatttggcatgtgtttgcagtggctggtactggttgttcctttccatgtttagtgcttccttcaggagctttttagggcaggcctggtggttacaaaatctctcagcatttgcttgtctgtaaagaattttatttctccttcacttatgaagcttagtttggctggatatgaaattctgggttgaaaattcttttctttaagaatgttgaatattggcccccactctcttctggcttgtagattttctgcagagagatccgctgttagtctgatgggcttccctttgtgggtaacccaacctttctctctggctgcccttaacattttttccttcatttcaactttggtgaatctgacaattatgtgtcttggagttgctcttcttgaggagtatctttgtggcgttctctgtatttcctgtatttgaatgttggcctgctttgctagattggggaagttctcctggagaatatcctgcagagtgttttccagcttggttccattctgcccgtcactttcagatacaccaattagacgtagatttggtcttttcacatagtcccatatttcttggaggctttgtttgtttctttttattcttttttctctaaacttctcttcacacttcatttcattcatttcgtcttccatcgctgataccctttctttcagttgattgcattggtcactgaggcttgtgcattcgtcacgtaattctcatgccatggttttcatctccatcaggtcctttaaggtcttctctccattggtttttctagttatccattcatctaattttttttcaaagtttttaacttctttgccattggttcgaacttccttctttagctcggagtagtttggtcttctgaagccttcctctctcaactcgtcaaagtcattctccatccagcttcttccgttgctggtgaggagctgctttcctttggaggaggagaggcactctgatttttagagtttccggtttttctgctctgtttttttccctatctttgtggttttatgtacctttgttctttgatgatggtgacgtacagatgggtttttggtgtgtatgtcctttctttttgttagttttccttctaacagtcaggaccctcacctgcaggtctgttggagtttgctggaggtctactccagaccctgtttgcctaggtatcagcagtggtggctgcagaacagcggatattggtgaaccgcaaatgctgctccctgatcattcctctggaagttttgtctcagaggagtacccagttgtgtgaggtgtcagtccacccctactagggggcgcctcccatttaggctactcaggggtcagggacccacttgaggaggcagtctgcccattctcagatctcaagctgcatgctgggagaaccactactctcttcaaagctgtcagacagggacatttaagtctgcagaggttattgctgtcttttgtttttctgtgccctgtctccagaggtggagcctacagaggcaggcaggcctctttgagctgtgatgggctccacccagttcgagcttcctggacacttcgtttacctactcaagcctgagcaatggtgggcgcccctcccccaacctcactgccaccttgcagtttgatctcagactgctgtgctagcaatgagtgaggctccgtgggcgtaggaccctccgagccagttgtgggatataatctcctggtgtgctgtttgataagcccgttggaaaagcacagtattagggtgggagtgacccgattttccaggtgccgtctgtcacccctttctttgactaggaaagggaattccctgaccctttgcacttcccgggtgaggcgaagccttgacctccttcgactcacgcacggtgcactgcacccactgtcctgcaccaactgtccagcactccccagtgagatgaacccgttacctcagttggaaatgcagaaatcacccatcttctgcgtcgctcacgctgggagctgtagaccggagctgttcctattcggccatcttggctccaccccaccacattttctttatccagtctatcattgatggatatttgggttggttccaagtctttgctattgtgaataggaattttcttagcaaatatgaaaatttgctgagagaggaagtgtgcaaaatggtttggcaggaaatcacacatggaagggcccaactgggtcactttgtgtttgaacactacatgggagactatgttgaaatcctagatttcaacaatcctagattagaccatcacggaaaagactcactactaggtggcagaggccctttcctgttgctcagagggacttctagtcgtgaaaacccataacctcctccttgactgtgtactagaagcactgctaagtgaaactggttaattctgcatctatttttgtaatgtggcaatttacatgctgattggagccaggctgtgggaatgtttttggtctaaggccatggttctcatggtggagaattttgccatttaggacatttggcaatgcctggagacatttttagtcacaagtgggttggggggtgctactggcttctaatgggtagaggacacagatgcttccaaacctcctaaaattcacagggcagctcttccctacaccacacatacaaaaagaagtacctgacccaagatgtcaacagtacctggattgagaaacactggtttaagtgaagaagcctgggtctcagagaattatttgtatttagtctctgcctttttcccctgtatttgctctgtgtgtgtgtgtgtgtgtgtgtgtgtgtgtgcatgtgtatgtgtgtgtgtgtgttggaatttatccatttaagtaaatgtaggaaagccctcagagtaccttaagagtatcactgtgctatgaagaaatgattgtgctttacagtgaacttgaggggagattcacttggggtaccaggctccccaaaggttgtaggtacagcacacatgcctgaaaacacagaaacatctgccaacactcacctgggtgtgtctttttgtctctatctttcttttctctagcaatttccaaactttataggcctcaattcttacttgaggagtgagcagcaggggttactgtcagttttagggcatacatctggcgagaagtgcctcaaagctgtctgcagaagtgcttttggggtttgaggatggcttgggttctttcttttaaataggtggagctgagatgaaggatgagggacagtgttcatgatcgttgtttaggctcttctccaactgtcatatttcttatgtgtcaaaggatactgtgacaaacccagtcactgatgttgggaatgtgagggatctaaggagagagcagtgtatatgggaagaagaagtacagccatttgatgtgcagaaggaatgtctgagcatctgggtatgtgtttgcagttttgtattttggctccaattcaagcccctttcattttgtatgataaataatttcttttctacacctaatttccattgactaatggtgattaatcttcaactttgacattagagataacaagtgatgctcattccattaggctttaccaaaatgctggtatttgagtagaaacaaagactgggataacaattgcttgcattcattgtggccctaaagtaattgtgaacccttgtaaagcctctacttatggtgcacagaattgtaacgtttgtaatgtaggggtggggctctgagaattaccaaatgttataaccaagggcaggtgttggtaaagtcctggaaaactggccccagtttcctccttccctcttctcttaggccatcatcatgaagtcacatgaaattcatgagtggcacaatgctgagctacgagttccattgctggtgaaagagggtggttcagtctgtctgtggaagttatgtttgatttccacctctcctttgctcatccctctgactttgtgtggagtttctccactggggtgtagagagtgtttattcacaataagtgtaacgtaaggtgatgtggaaatgagtagtcctctaattatagagtgacttacataaaaactatgccattggaaatagatgcatttaagttcctaaaggtcaggaggtatggttgagcctggcagccattagcaaatgtgatacagttcaatggtgagtacttacgagtttatacatgtatacataatattggggatatgtcattggtatgttaattagagaatgcgtttgagtatcaatgtatgatcatttccccattatcgatgacaatggaaaaaagcagtagtacaaataatcccaagcgttaggtgattttaaaatattttctatcaagtttgagtgttttattatgatttttttaactgaggttcacctatatatgtcaacagactatggaaagtcatagtgaggttaaaaagaaaatatgaagtaattatatcaaatagtccacaaaggaaaacattctgaaaagtgaatagttcaattaggtggcctataaatgttaagaccagtgttcggcaacagctcagtttcagacccccattccaaatgtcagtacattcttgaaatgggagtggtctttactatgtatgctttgtacacctttcctgaaatttgcttccaggtgttcttgtatattaaataccacagccttgatctttaaatgatgacaaattgtccaaatgtattaacttttcccctttatttttctctttgctttattctcagtaacctcttttctctaattcttacattaacatataaataaaataattccagatgaattcatcatagatgataattataacgtgttcaggtgtggatctctttgaatctatcctacttggaatttgttgagctccttggatgtgtagattaatgtttgtcatcaaattttgaaagtttggctattattcaatacagtcatgcatcacttaaaaataggaatactttctgagaaatgtgttcttcggaaatttaacccttgtaccaacatcatagagtgtacttacacaaacgtagatgatttagcctactacacacttaggctatgtggtatagcctatggctcctaggctacaaacctcacagcatgttactgtactggatactgtagaaaattgtaacacagtggtatttgtgtgtgcaaacatatataaaaagataaaaaataatgcgagggaggagccaagatggccgaataggaacagctgcggtctacagctcccagcatgagcgacgcagaagacgggtgatttctgcatttccatctgaggtaccgggttcatctcattgggagtgccagacagtgggcgcaggtcagtgggtgcgcgcaccatgcgcgagctgaagcagggcaaggcattgcttcacacgggaagcgcaaggggtcagggagttccctttcctagtcaaagaaaggggtgacagacggcacctggaaaatcgggtcactcccacccgaatactgcgcttttccaacaggcttaaaaaacggcgcatcaggagattctatcctgcacctggctcgcaggatcctacgcccacggagtcccgctgattgcgagcactgcagtctgagatcaatctgcaaggtggcagcgaggctgggggaggggcgcctgccattgcccaggcttgcttaggtaaacaaagcagccaggaagcttgaactgggtggagaccaccacagctcaaggaggcctgcctgcctctgtaggctccacctctgggggcagggcacacacaaacacaaagacagcagtaacctctgccgacttaaatgtccctgtctgacagctttgaagagagcagtggttctcccagcacgcagctggagatctgagaacgggcagactgcctcctcaagtgggtccctgacccctgacccctgagcagcctaactgggaagcacacccgagcaggggcagactcatacctcacacggccgggtactccaacagacctgcagctgagggtcccgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgactctcctcctccaaaggaacacagttcctcaccagcaatggaataaagctggatggagaatgactgacaagctgagagaagaaggcttcagacgatcaaattactccgagccaggggaggacattcaaaccaaaggcaaagaagttgaaaactttgaaaacaatttagaagaatgtataattagaataaccaatacagagaagtgcttaaaggagctgatggagctgaaaaccaaggctcgagaactacgtgaagaatgcagaagcctcaggagccgatgcgatcaactgcaagaaacggtatcagtgatggaagatgaaatgaatgaaatgaagcgagaagggaagtttagagaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcaggccaacgttcagattcaggaaatacagagaacgccccagagatactcctcgagaagagcaactccaagacacataattgtcagattcaccaaagttgaaattaaggaaaaaatgctaagggcagccagagagaaaggtcggttactctcaaagggaagcccatcagactaacagcagatctctcagcagaaactctacaagccagaagagagtgggggccaatattcaacattcttaaagaaaagaattttcaacccagaatttcatatccagccaaactaagcttcataagtgaaggagaaataaaatactttacagataagcaaatgctgagagattttgtcaccaccaggcctgccctaaaagagctcctgaaggaagcgctaaacatggaaaggaacgacctgtaccagctgctgcaaaatcatgccaaaatgtaaagaccatcaagactaggaagaaactgcatcaactaacgagcaaaatacccagctaacatcgtaaagacaggatcaaattcacacataacaatattaactttaaatgtaaatggactaaatgctccaattaaaagacacagactggcaaattggataaagagtcaagacccatcagtgtgttgtattcgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcgaacctaatagacatctacagaactctccaccccaaatccacagaatatacatttttttcagcaccacactacacctattccaaaattgaccatatacttggaagcaaagcagtcctcagcaaatgtaaaagaacagaaattataacaaactgtctctcagaccacagtgcaatcaaactagaactcaggattaagaatctcactcaaaaccgctcaactacattgaaactgagcaacctgctcctgaatgactactgggtacataatgaaacgaaggcagaaataaagatgttctttgaaaccaacgagaacaaagacacaacataccagaatctctgggacacattcaaagcagtgtgtggagggaaatttatagcactaaatgcccacaagagaaagcaggaaagatccaaaattgacaccctaacatcacaaaggaactagaaaagcaagagcaaacacattcaaaagctagcagaaggcaagaaataatgaaaatcagagcagaactgaaggaaatagagacacaaaaaaaccttcaaaaaattaatgaatctaggagctggttttttgaaaggatcaacaaaattgatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatagataaatttctggacacatacactctcccaagactaaaccaggaagaagttgaatctctgaatagaccaataacacgctcggaaattgtagcaataatcaatagcttaccaaccaaaaagagtccaggaccagatggattcacagccgaactctaccagaggtacaaggaggaactggtaccattccttctgaaactattccaatcaatagaaaaagagggactcctccctaactcattttatgaggccagcgtcatcctgataccaaagcctggcagagacacaaccaaaaaagagaattttagaccaatatccttgatgaacattgatgcaaaaatcctcaataaaataccagcaaaccaaatccagcagcgcagcaaaaagcttatccatcatgatcaagtgtgcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatgtttcaaaataataagagctatctatgacaaactcacagccaatatcatactgaagggacaaaaactggaagcattccctttgaaaactggcacaagacagggatgccctctctcaccactcctattcaacatagtgttggaagttctggccagggcaatgaggcaggagaaggaaataaaatgtattcaattaggaaaagaggaagtcaaattgtccctgtttgcagatgacatggttgtatatctagaaaaccccatcgtctcagcccaaaatatccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaagctactttaaagttcatatggaaccaaaaaagagcccacatcaccaagtcaatcctaagctaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagaaatggggaaaggattccctatttaataaatggtgctgggaaaactggctagccagatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattcaaccaaagagcttctgcacagcaaaagaaactaccatcagagtgaacaggcagcctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacatttctgaaaaaaagacatttatgcagccaaaaaacacatgaaaaaatgctcatcatcactggccatcagagaaatgcaaatcaaaaccacaatgagatcaccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgtttcctcagggatctagaactagaaataccatttgacccagccatcccattactgggtatatacccaaaggactttaaatcatgctgctataaagacacttgcacacgtatgtttattgtggcattattcacaatagcaaagacttggaaccaacccaaacatccaacaatgatagactggattaagaaaatgtggcacatatacaccatggaatactatgcagccataaaaaatgatgagttcatgtcctttgtagggacatggacgaatgtggaaatcatcattctcagtaaactatcacaagaacaaaaaaccaaacaccgcatattctcactcataggtgggaattgaacaatgagaacacatggacactggaaggggaacatcacactctggggactgttgtggggttgggggatgggggagggatagcattgggagatatacctaatgctagatgacgagttagtgggtgcagcgcaccagcatggcacatgtatacataagtaatgaacctgcacattttgcacatgtatcctaaaacttaaagtataataataataaattaattaattaaaaaaaaaccaaaacaattttaaaaaaaataaaaactaaaaaaataaaaaataaaaaaataaggcattgcactacagcattatggcagctagtgtgtcagtaggtgacaggtatttttctactccattataatatttttaaaaaattgtttatttttaaatttttgttgacacatagtaggtatgtatatgtttatgggttacatgagatattttgatacaggaatgcagtgggtaataaccacatcagggtatatgggctagccatcacctcaagcatttatcctttgtgttataatttaattatactgttttagttatttttaaaatgtataattatgtacatttaaatatagtaaatattgtgactgtagtaaaacataatttactacagtcacaatatttactatatttactaagtgactatagtaaattactttttactatagtcagtctgatgtgctagcaaatactaggtcttattcattatttctgattttttgtaaccactaactgtcatttccccccaccaccccccacccacacactacccttaacatcctctgataaccatccttctgctgtctatccctatgtgttaaattattttgatttttagcttccacaaataagtgacagcatgtgaagtttgtctttctgtgcctggtttatttcacttaatagaatgacctccagttccatccatgctgttgcaaatgacaggatctcattctttttatggcccagtagcactccattatgtagatgtaacacatttttgttgcgggaagtcagggaccctgaacggggggaccggctgaagctgtagcagaagaacataaattttgaagatttcatggacatttagcagtttccaaagttaatacttttatcatttcttaggcctgtctttactgcagtctctgaacgtgaattgtgaagatttcatggacatttatcacttccccaattaatactcttataatttcttatgcctgtctttaatctcttaatcacattatctttgtaagctgaggatgtatgtcacctcaggaccctgtaatgattgcgttaactgtacaaattgtttgtaaaatgtgtgtttcaacaatatgaaatctgattgtgaaacaagggtgtttgaacaatatgaaaccagtgcaccctgaaaaaacagaataatagcaattttcagggaaaaagggaagataaccataagggctgactgcctgtggggtcgagcagaatagagacatatttttcttctcacagaaagcctatagatggatgtgcgagtaggagaaatattgctgaattattttcccagcatggagtaaccctcaggaaggaatgcattcctgggggtaggtctatagatggctgctctgggagtgtctgtcttatgcggttgagataggactgaaatacgccctggtctcctgcagtgccctcaggcttactaggattgggaaattccagcctggtaaattctagtcagaccagttgtctgctctcgaaccctgtttcctgttaagatgtttatcaagacaatgtgtgcacagtgggacacagaccttcatcagtaattctaatttttgcctctgccttttgatcttttattgccctttgaagcatctgatctctgtgacctactccctgttcgtacaccccctcccctttcaaaatccctaataaaaacttgctgattttgcagcttgaggtcaccatcatggtcctaccaatatgtgatgacacccccggaggcccagctataaaatttctctctttgtactctttttgtttatttctcagaccggccgacacttagggaaaatagaaaagaacctacattgaaatattgggggctggttcccccgatacattttctgtatctattcatctattgatggacaggtaggttgcatccaaatcctggctattgtgaatactgctgcaataaacacaggagtaccaatatctcttcgatgtaccattttcctttcttttgggtatacacccagcagtgggattgctagattttgtggtagctctatctttagttttttgaggaccctacaaactgttctgcatagcgattgtactaatatataatacattcccaccaacagtgtaagaggattcccttttctccatattctcaccagcatttgttattgcctgtcttttagataaaagccactttaactggtgtgagatgatatcttattgtagtttgatttgcatttctctgatgattgatgatgttgagccattgtacctgtttgccatttgtatgtcttgttttgagaaatgtctgttcagatctatggcccattttttattcagattattagatttcttcctgtaaagtcgattgagctccttatatattctggttattaatcccttgtcagatgggtattttgcaaatattttctcctgttctgtgggttaccctttcactttgttgattgtttcctttgctgtgcagaagcttttcagcttgatgtgaccccatttgtccatttttgctttggttgtcagtgcttgtggggtattactctagaaatccttgcacagactgatgtcctggagagtttcctcaaggtttttagtggattcatagcttgaggtcttagatttcagtctttaatctattttgatttgatttttgtatatgatgagagatggggggtcaagtttcctttttctgtatatggatatccagtttccccgcaccgtttattgaggatactctcctttctccaatgtatattcttggcacctttgtcaaaaatgagttcactgtggatgtatggattttcttgaggttctctattctgttccactgatatatgtatctgttttttatgacaatacagtgctcttttggttactatagctctgtagtataatttgagaaattaatataatgtgattccttcagatttgttctttttgctcaggatagctttggctattctgggtctgttttggttccagataaactttaggatttttttttctatttctgtgaataatgtcattggtattttgatagggattgcattggatctgtagatttatttgggtagtatagacattttaacattattgattcttgcaatccattaacatggatatatctttccattttttggtgtcctattcaattttttgcatcaacgttgtatagttttcattgcacagatatttcacttctttggttaagctaattcctaggtatttaattttatttatagctattgtaaatggaattattttctttatttcattttcagattgctgttggcatataaaaatatgactgatttctgcatgttgatagcatattctgcaactttactgaatttgtttttcagctctaattgttttttgtggagtcattagtttttccaaatataagatcatatcatctggaaataaggatattttgacttcttcatttccaatttggatgccctttagttctttcttttgtctgattgctctagctaggacttccagtaatatgttgaatatcagtggtgatagtgggcatctttgtcatgttccagatcttagaggaaatgctttccatttttcctcattcagtatgatactaacttttggtctgtcatagatggcttttattattttgacatatgttccttctatccccagttttttgagggtttttatcatgaaggtatgttgaattttgttaaatgctttttcagcatccatggaaatgatcacatgatttttgtcctgtattctattgctacaatgtatgatattgattgatttgcatatgttgaaccaccctttcattcctgggataaatctcagttataataaatgatctttttaatgttttgttgaactttgctagtatattgttgaggatttttgcatcaatattcatcagtcatattgttttatagttttcttttttgatgtgtcattgtctagttttggtatcagggtaatactggccttgtacaatgagattggaagtattttcttctcctctatttattggaatagttggagtagtattggtattagttcttctttaaatgtttggtagaactcagcagtgaagccatcagggtcattggctttgctttgctgggagactttttattatggcttcgaactcattacttttttttctaattttaatttaattttattttattttaagctctgggatacatgtgaaggatgggaggtttgttacataggtaaacatgtgccctggtggtttgctgcacctatcaacccatcacctaggtattaagccccacatgtattagctatttatcctgatgctcttcttcccccccaccccccaacaggccccagtgcatgttgttcccctccctgtgtccatgtggtctcattgtccagctccaacttataagtgagaacatgtgatgcttggttttctgttcctgtgttagtttgctgaagataatggcttccagctctatccatgtccctgcaaataacataatcttgttcctttttatgcctgcatagtattcaatggtgtatatataccacattttctttatccagtctatcactgatgggcatttgggttgattccatgtctttgctattgtgaatagtgctgcaattaacacatgcctgcatgtatgtttataatagaatgatttatattcctttgggtatatacccagtaacaggattgctgggtcaaatggtatttctggtttctaggtctttgaggaattgccatactatcttccacaatggttgaactaatttacattcccaccaacagtgtgaaagtgttcctatttctgcacagcctcaccagtatctgttgtttcttgactttttaatagtcaccattctgactggcataagatggtatcttattgtggttttgatttgcatttctctaatgatcagtgctattgagctttttttcatgtctcttggccatgtgagtgtcttcttttaagaagtgtccatgttctttgcccactttttaacgggattttctgtttcttataaatttgtttaagttccttgtagactctggatattagacctttgtcagatggagagattgcaaaaaatttctcccattctgtaggttgtctcttcactctgatgatagtttattttgctgtgcagaagctctttagtttaattagatcacacttgtcaatttttacttttgttgccattgcttttgatgtctttgtcattaaatctttgcctgtgtccaagtcctgaatggtattgcttaggttgtcttccaggttttatatagttttgggttttacatttaagtctttagtccatcttcagcatattttgtatatggtgtaaggaaggggtccagtttctatcttctgcacatggctagccagttatctcagcaccatttattgaataaggattcctttcttcattgcttgtttttgtcaagtttgttgaagatcagatggttgtagatgtgtggtcttatttctgagatctctattctgttccattggtctatgtgtctgtttttgtaccagtaccatgctgctttggttactgtagccttgtagtatagtttgaagttgggtggcatgatgtgatgcctccagctttgctctttttgcttaggattgtcatggctatacgggctcttttttggttccatacgaattttaaagtagttttttctacttttgtgaagaatgtcaatggtagtgtaatggtaatagcgtggaatctataaattactttgggcagtgtggccattttcatgatattgattctttctatccatgagcatggaatgttttttcatgtttgtgtcctttctgatttttttgagcagtggtttgtatttctccttgaagaggtccttcacttcccatgttagctgtattcctaggtattctattctctgtagtaattgtaaatgggagttcatttatgatttgtttctccccttgtctattgtttgtgtataggaatgcttgtcattcttgcacattggttttgtattctgagtgtattagtcctttctcatgctgctataaggacatacccgagactgggtagtttataaagcaaggaggtttagtggactcaatagtttcacatggctaaggaggcctcacaatcatggcggaaggtgaagggggagcaaaggcacatctgacatggcagcatgccagagcacatgttcaggggaactgccctatataaaaccaacaggctttttgagacttattcactatcatgagaacagcatggtaaaaacccactcccatgattcaattatgtcccaccaggtccctcccaccacatatggtgattatgggagctacaattcaagatgagatttgcgtggggacacaaccaaaccatatcattccacccttggccccttccaaatctcatgttctcacattttgaaaccaataatgccttcctaacagtcccccaaagtcttaactcattccaacattaacttaaaattcacagtccaaagtctcatctgagacaagacaagtcccttccacctatgagcctgtaaaatcagaagcaagttagttacttcctagatacaatgggtgtgcaggcattgggcaaatacaccccttccaaatgggagaaattggccaaaacaaaggggctgcaggctctatggaagtccaaaatccaatcaggctgtcattaaaccttaaagttccaatgtgatctcctttgaccccatgtctcacatccaggtcacactgatgcaagcagtgggatcccacggccttgggcagctccatccctgtggcttggaagcatatagccccctcccagctgctttcaccgattagctttgagtttctgtggcatttccgggaacatggtgcaagctgtcggcagatctaccattctgggttctggagtacagtggccctcttctcacagctccactaggcagtgccccagtggagattctgtgtggggacttccaccccatatttgccttccacagttctctagcagaggttctccatgagggccccaccccggcagcaaacttctgcctggacatccaggcatttccataccaccactgaaatctaggcagaggttcccaaacctcaatccttgaacttctgtgtacccacaagctcaacaacacatggaagctgccaaggttttgggcttgaaccctctgaagccatggcccaagctgtactttagccatggctagagaggctgggatgcaggtctccaagtccctaggctgcacataacagaggggccctggacctgacctaagaaaccatttttcccttctaggcctccaggcctttgatgggaggctctgccatgaaggtctctgacatggcctggagatgttttccccattgtcttggtgattaacattcagctccttgttatttatgcaaatttctgcaggaggcttgagtttctccccagaaaatgggtttttcttggcaggctgcaagtttttcaaacttttatgctcttcttccttttgaatgctttgcagattagaaatttcttctgccagataccctaagttatctctctcaagttcaaagttccacagatctctagggcaggagccaaatgccacccatctctttgctaaatcataacaacagtcactttccctccagttcccaacaaattcctcatctccatctaagaccacctcagtctggatcttattgtccatatcactatcagcattttggtcaaagccattgaacaagtctctaggaagttccaaactttcccacatcttactaccttcttatgagcactccaaactgttccaacctctacttactaagcagtacaaaagttgcttccacattttcaggtatcttaatagcagtactccactctactggtaccatttgactgtattagtccattttcctactgctatgaagaaatacctgatggccgggtatggttgctcatgcctgtaatcctggcactgtaggaggccaaggtgggcagatcacctgaggtcaggagttcaagaccagtctggccaacatggtgaaacccagtctctactaaaaatataaaaattagctggaggtggtggtgggtgcctatagtcccagctactcaggaggctgaggcatgagaattgcttgaacccaggaggctgaggttgcattgagccaagatcataccactgcactccagcctgggcaacaagagcgaaactccatctcagaaaaaaaaaaaagaaatacctgagactgggtaatttataaaggaaaaaggtttaatggactcacagttccccatggctgggaaggcctcacaatcatagtggaaggcaaaggaggagtaaaggcacgtcttacatggcagcaggcaagagcacatgtgtagtggacctgccctttataaaaccatcagatcccttgagacttatccactattataacaacagcatgggaaaaacctgcccccatgattcaattacttccaactgggtccctcccacatggggattatgagagctacattcaagatgtggtttgggtggggacacagccaaaccatatcactaagactttgctgaagttgcttattagcttaagaagctttggggctgagacgatggggttttctagatatagaatcatgtcatttgcaaacagacagtttggcttcctctcttcctatttgaataccctgtatttctttctcttgaccgattgccctggccagaacttccaatacgatattgagtaggagtgatgagagaggacatcctcgtcttgtgccagttttcaaatggaatgcttccagctttcatgaattgctcttattatattgatgtatatcctttcaatacctagtttattgagagtttttaacatgaagggatgtttaattttattgaaggccttttctgcatctattgagataatcaatgtggtttttgtctttagttctgtctatgtgatcagttatgtttattgatttgcttatgttgaaccagccttgcatccaaggaatgaagctgacttgattgtggtgaataagctttttgatgtgctgttggatttggtttgccagtattttactgaggatttttgcattgctgttcatgagagatattggcctgaagttttctttttttattgtatctctgccaggttttggtatcaagatgatgctggcctcataaaatgagttatggagaagtccctccttttcaattgtttagaatagtttcagaagaaatggtaccagctccactttgtacctttggtagaattcagctctaaatccatcttgtcctgggcttttatttattactacctcaatttcagaacttgttattggtctattcagggattcaactccttcctggttcagtcttgggagggtgtatgtgtccaggattttatccattttgtctagattttttagtttatttgcatagaggtgtttatattaaatagtattctctgatggttttttgtatttctgtggagtcagtggtgatatctttatcatttttgttgtgtttatttgattcttctctctcattagtctagctagaggtctatctattttattatttttttgaagaaaccagcctctggattcattgattgtttgaacagttttttgtgtctctatctccttcagttcactctgatcttggttattttttgtcttctgctagctttgaagtttgtttgctcttggttctctagttcttttagttgtgatgctatggtgctgattggagacttttttttttttttgagatgtagtcctgctctgtcacccaggctggagtccagtggcatggactcagctcactgcaacctctgcctcctgggttcaagtgattctcatgcctcagcctcccgaataggggggactacaagcacatgccaccacacccggctaagttttgtatttttttgtagggaccgagtttcaccatgttagccaggctggtctcaaacccctgacctcaagtgatccatccacttcagcctcccaaattgctgggattacaggcatgagccactgtgcctggctttctagctttttcatatgggcatatagtgctataaatttcccttttaacactgctttagctgcgttccagagattctgatatgttatctgtttgttctcgttggtttcaaagaactttttgatttctgccttaatttctttatttacccagtagtcattcaggagcaggttgttcaatttccatgtagttgtgtgactttgagtgagtttcttaatcttgagttctaatttgattgtgctgtggtctgagcgactgtttgttatgatatcagtccttttgcatttgctgaggaattttttactttcatttatgtgatcaattttagagtaaacgccatgtggcacagggaagaatgtatattctgttgtgttttggtggagagttctgtagatatgtatcaggtccacttggtgagctgagttcaagtcctgaaaatttttgttaattttctgtctcgatggtctgtataatattgacaatggggtgttaaagtctcccactattattgtgtgggagtgtaagtctctttgtaggtctctaagaacttgttttacgaatctgggtgcttctgtattgggtgtatatatatttacaatagttaactcttcttgttgaattgatccctttaccattatgtaatgtccctctttgtctttttttatctttgtcgttttaaagtctgttttgtcagaaactaggattgtcactcctgtcttttctgctttccattggctgggtaaattttcctccatccctttattttgagcctatgtgtgtctttgcacgtgagatgggtctcttgaatacagcaaagcaatgggtcttgactacccagcttaccattctgtgtcttttaatttgggcattagtccatttacatttaaggttaatattgttatgtgtgaatttggtcctttcatcatgatgctagctggttattttgcagacttgttgatgtagttgcttcatagtgtcattggtctttgtaattcagtgtgtttttgcagtggctggtattgatttttccttttcatatttagtgcttcattcaggagttcttgcaaggcaggtctggtggtgatgaattccctaagcattttcttgtctgaaaaggactttatttcttcttcacttatgaagcttagtttgatcagatatgaaattctgggttggaaattcttttctttaagaatgttgaatattagctcccaatctcttctggcttgtagggtttctgctgagagatccactcttagtctgatggacttctctttgtaggtgacatggcctttctctctgactgcccttaacatttgttttcattttgaacttggacaatctgatgattatgtgtcttggggttgatcttctcatggagtatcttattgggtttctctgggtttcctgagtttgaatgtttgcctgtcttgttaggttgtggaagttctcctggatgatattctgtagtatgttttccaacttatttccgttctgtctctgtctctttcaggtaccccaattagtcgtaagttcagtctttttacataatcccatagttctcagaggttttgttcattccttgttattctgtttcttctaatcttgcctgcctgtcttatttcagcaagatagtcttcaagctctgaaattctttcttctacttggtctattcagttactgatacttgtggttgcattatgaagttcttatgttgtgttttcagctctatcaagttatttgtgttcctctttaaactggttattctggttaacagctcttataatgttttatcatcgttcttagcatctttgctttgggttaggacatccttttttagctccgattttgtttatttgtgcgttctctctttttctgagttattctaactaaaggtttgtcagtttcatttatcttttcaaatagccaggttttggttttgttgatcttttgttattgttttctttatttcagtttcatttgtttctgctctgatctttcttatttcttttcttctactaattttgggtttggtttgctcttctctagttcattaagatgcatcattaggttgtttatttgaagttgttcttcttttttgatgtacacacttatagctataaacttccctcttagcactgctttggctatatctcattggtttttatatgttgtatttccataatcatttgttttcactctatatttgaattttttcttaatttattcattgaccattggtcattcaggagcatgttgtttaatttccatgtgtttgtatagtttccaaaattattcttatttatttctagttttattccattgtggtggagaagatgcttgatataatttcaatttttgaatgttttaagacttgttttgtgacctaacatatggtctctttgagaatgatattcatgtgctgaagaaaagaatatatattctgcagccattggatgaaatgttctgtaaatatctgttagagccatttggtctattgtgcagaataaatcagatgtttctttgttcgttttttgtttgggagatatgtccaatgctgaaagtgatttgttgaagtctctagattttattgtattggagtctatttctttccttagctgtaataatatttgctttatatatctgggtgctccagtattgagtgcatatatatttaaaattggtatatcctcttgttgaattaaccctttatcattttatactgactttcttataggtgaagtatgtttcttgtaggtcatagatcattgggcctttttaaaaatttattcaaccactccttatcttctgactggagagattagtccatttacagtcaatgttattatcaataagtaggaacttactctaccattttgttacttctctgctggttgttttgtggccttctctttcttccttctttccttcctgtcttgcttttggtgaaggtaattttcttaggtggtgttatttaattcctttctttttattttttgtgtatcaattatatgttacttgatttgaggttaccacgaggctttttaagctgacaacaacatagcattgtttccataaacaaacaagcaagcaaaatgtaaactaataaacactctaccccttaacttcatcctcccgctttttaactttttgttgtttctatttatatcttattgtattgtgtcttgaaaagttgttgtagttattatctttgattggctcattgtttagcctttctacttaagagtagtttacacaccacagttatggtgttataatattctagtttttcagtatacttactattaccagtgagttttgtaccttcaagtgattatttattgctcattaatgtccttttctttctgattgaagtactccatttagcatttcttgtatacaggtctggtattgatgaaatctcttagcttttgtttgtgtgggaaagtctttatttctccttcatgtttgaaggcaattttcacgggatatactattttagggtaaaagttattttctgtcatcactttaaatatttcatgccactctctcctggcctgtaaggtttctaccgaaaagtctgctgcaagatgtaatggagctttattgtgtgttgtttcttttctcttgctgcttttcggatccttctttatccctgacctttggaagtttgatgactaaatgctttgaggtattcttttggtaaaatctgttgggtgttctataaccttctcgtacttggatggtgatatctttctctgtttggggcagttctctgttattatctctgaataaactttctacctcacctctttctctaccttctctttaaggtcaattactcttagatttccccttttgagactattttctagattttataggcatgcatcattcttttctatttttttcttttgtctactcttactgtgtattttcaaataacctgtcttcattcttactaattctttcttctgcttgatcaattctgctattaaaagactgatgcattcttcagtgtgtccattgcatttttcaactccagaatttctgcttgatttttaattatttcaatctctttgttaatcttatctgatagagtgctgaatttcttctttgtgttatctttgaatttcctcaaaacagctattttgaactctctgtctgaatgttcacatatctgtttctccaggattggcccctggtgcctaatttagtttgcttggtaatttcatgtttctcctggatggattttaagcttgtggacattcatccgtgtctactaattgaagaattaagtgtgtattgtaatcttcgtagtctgcgtttatttgtacccatccttcttgggaaagctttccaggtatttaaaaggacttgcatgttgtgatccatgctgtatctgcatcagggggctccccaaacccagtaatgctgtgactcttgtagtcttatagaggtaccaccttgctggtcttggataagaatccacagaaattatctgcattaccagacagagagactcttgttttcttcccttactttcttccaaacaaatggagtctctctctttctgtgctgagctgcctggagcttgggatgaggtgacacaagtacctctgtggccaccaccactgggactccactgggtcagacctgaagccagcacagcactgggtctcacccaaggtcccctgtaatactgcctggctactgcctgtgttttcttaaggtcgcagagctctacagtcaacaggtggcaaatcgagtgacaattttgttcttcccttcagggcagcaagtttctctaggtcccaggcagctcttgagatgccatccaggccaggaactagagtcaaaaatcctagaaatctacctggtgttctattatattgcagctgagctggcactcaaatcaggcgacacagttcttcttcccactcttccactctattcttttcacaggcagaagagactcactccatggcttccaccagcacaggcccacagggagttctgccaggctactgccaatgttcacttgaagcccaagggctcttcaatcagcttgtggcaaatgctgccaggcctgggactcattcttcatggaagtcagcctccctttggcccagggcaggtccagaaatgccatccaagagccagggcttagaatcggagaccccaagagcccagttggttctctacacccctgtggctgagttggtacctaaagtgcaaaattccctttacttttccctctgtttttctcaagcaggagtctctcactatagccactacaattgagaatgtgctgggtctcacccaaagccagcacatctcagagtcttacccaaggcccacagtgtactacctgagtatcactactggttattcagggcccaagtgctctttagtcagcagatgatgggtccttccaggaccaggtccttcccttgaaggcaacgggtacccttctgtttcagaatgtgtctagaaatgttgttcaggagctagggcctggaactggggtgctaagactctgaccagtgccctattctgctttggctgagcagggagccaagatgcaagaccaagtcttctttactcttccctctcctctcctgaagaggaaggaaggggtctcttttggagccatgagctgtgcagcctgggatttgggtagtggtggtgcaagcactcccttcactgccctggcttgtgtatgttacatgccctccaagcccactagctctaagcccagctcagcatacatactcacctaggagttgcagttcttgtgtcctagaccgcctttcaaatttacttagagcccagagcactttagcagatgatggcaaagcttgccagaactcacattccaactgctgggaaatgggattcccttctagttagggctgctctacatgcgttctccatgggtaagtgtcagctgcattcagtgcagttttgctttccactgggacaaggcagcactgagtttaatgcagtctcacaattgcttcattctccttctcctaagcacagagattctctctccatgccacacagccactgctgggggaatgggggaggggtcatgtcagtggttcaagactgtctttcctaccctgtttagtgcctctttcagaaatattaagttaaaacaggtactgtgggggctcacctgattttcagctcttatgaaggtgcttttttgtgtgtagatagttgtcagttttggtgttcctgtgggataggagagatgatcagtagagccttctattcagccatcttgctctgccctctcccctccattataatcttatgtggccactgttgtatatgtggtctattgttcactgaaacattacgcagtgcattactgtattcttttcgtcctttttctctctcctccgcttctgggcatatcatcatgtgtatgttggggcactagatggttcccacagttctcttaggctctctttgtttttcttcattgtctgtgttccttagactggttaatctcaatcaatatatcttcaagttcactgatgctttcttctacctgctgaaatgtgcagtcatcttgctcttctagtgaatttttcatatgatttatacttttgagtctagaatgtctactttgtctttacaacttatgtgtctttattcatagtctgtatttggtgagacattgttttcctactttagttctttagacatggtttctttcagtttatgaacatatttataataactggtttaaagtgtttgtctagtaagttcaatatttgggcttcctcaggaacagtttctattgattgctttttttctgtgtttgggccatactttcttgttttttgcatgtttcataatggtgttttgttgaaaactagatattttgaataatacaatgtagcatatctgcaaatcagattcttttcctatctccccaggtctttttgttgctcctgtagtttgtttagtgactttcctgaactaattctgtaaagtctgtattcttttgtcatatgtgtccactgaaatctttgcttggttaggttagtggtcagctaatgaatgaacagagatttctttaagcacctggaaccaataaatctcccagtctttgtgaagggactctgtgtgcatgttggaagtatgccttcaatgctcaggcaggtagttgacagctttgccttagccttcacttcccacttgcttagaacctcagggtcagtcacaggtgggagcttaggcctttttcaggtatttcctgtgcatgcacccagcctcgagcaacaacacagccctacacatgcatgtggccatggagaattccaggaatatgtgagtttttcaaatcgccccatagaaatttcattcctcagctttaagctatttggttaacctattgttggccccatctattatgcattgcctcagacagccatgataatacacaattgccactgattgttttcagcaaatgccactggagggatagggatccagtttccttcttctacatatgaatatccatttttcccagcaacatgtattgaagagagtatttttccccaatgtacgttctttgtgccttcatagaaatcagttgactgtaaatatgggctttgtttctgggttctctgttctatttcatttatctgtgtgtctgtttttataccaatatcatgctgttttgggtactacagctttgtaatatattttgaagtcagatagtgtgatgcctccagttctgtaccttttgctcagaattcttttggctacttggactactttgagttccatataaattttagggttttttttccatttctgtgaaaaatgacattgatattttgatagggactgaaattattttttacattgctttgtgcagtatggtcattggaaaaatattaatttttctgatccatgagtatgggatgtatttttatttgtttgttttctgtttcatttctttcatcagtgttttgtagttttctttaaaagaggtcatttatctccttggttaaatataatactaggtattttatttttgtaactcttttttataactattgtaaatgggattgccttcttgatttcttctcagctagttgattatttatgtgtagaaatactactgatttgtgtgtgttgattttgtgttctgtaactttactaagagtttttggtgaagtctttaggtttttctagatacaagatcatgttgtctgcagaggtggatagtttgacttcctcttttccaatgtgaatgccttttatttctttctcttgcctgattgctttggctaggtacagaaagacctagccaagtggtgagtggtgaaagtgggcatccttttcttgctccagttctcagaggaaaggcttccagcttttccccatatcattacctgtgctctttattatgtttacatacggtctttagtatgttgagttatgttccttctatgcccagtttctgagtgctgttatcataaagggctgttgaattttatcaaatatttttcctgtgcctattgagattatcatattattgttgtccgtcattctgttgatttgatgtattgtgtttattgttttgtatatgttgaaccatccttgcatccctgggatagatcccatttgatcatggtgtattatctttttcatgtgctgttggatttgatttgctagtatgtagttaaggagttttgcatctatattcatcagggatattggcctgtagtttttgttgttgttgtatacttgtctagttttggtattagggcaatggtgcctcatggaatgaattagggagaaatccatttgcttcaatttttttgaatagtttgaggagaagtgatgttagttctttttaaatttggtagaattcaacagtgaagccatctggtcctgggcttttctttgttgagagactttattagtgattaaatctcattattcgttattagtctgttaaggttttctacttcttcctgattcaatcttggtaagttgtatgggtccaggaatttatttttttcctctaggtcttccagtttgttaatgtatagttgttcttaataggctctgatgatcttttatatttctgtgctatcagttgtaatatctccttttctatttgtgattttgagtcttctctctctttttttggttagcttaactagtaatacaggagttattaagaaattatttttaggcagctagaaagggtgaaaactcccagtgtaatttttctttaataaaaagcagtccccaaaccatttcttctctaacaggaagcagcctgagaagtcaggcatagatatgcaaactaggagcttttatatgtaaatgatggcagctgtacctggaagccaggtacattcaatgtggcatctcccatcctcttttgcttgtcactatgttaatgggtatcatggcagcctccaggtaaaaccgtgtgtacaggcatcatggcctccaccaggtggaggccgcatttgcataataaaagactagggtcagagggccagtctttttgcaagctatgtaaatggcacacctggtaaacccaatcccctgagccctatgtaaatcaatcactgcctcctcaagcctctgtacaaaaccgattatgttttgccacaaactagagaccctcttttgggcgacccactttttcagcatgaggaagctttttttctctttcttctttttctattaaactttccgctcctaaatccactccttgtgtgtgtccatgtcttgaattctttctcaactgtgacaaagaaccagggtatataccccagaaaatggagccatttcactagcagtttatcaattttatctttttttgaaaaaaaacttttcattttgttgatgctttgtaaattttttagtctctatttaatttagttctgctctgatctttattatttccttcctcctactaattttgggtttgatttgttcttgcttttctagtacttggggtgcatcattagactatttatttgaaatctctctgcttttttgatctagatgcttattgctataaacttccctcttagcagtgcttttgtgtgtcctgtaagttttggtgtcttgcgtttccattttcatttgtttcaggaaatttttaaaacattttttccttaactttttctttaatccagtggtcattcaggagcatgttgtttaatttccatgtgtttgtagtttccaaagttcctcttattattgatttagagtttcagaccattgtgatcttgatatgattttgattttttaaaaactgttgagatttgttgtgtggcctatatcttggagaatgttccatgtgctgatgagaataatgtgtattctgtagctgttggatgaaatgttctgtaaatgtctgttaggtccatttggtctaaagtgccgtttaaatccaatgtttctttattaattttctgtttagatgatctgtcttatgctgtgagcggagtgttgaagttcccaactattattgtattggagtctatctctccctttagatctaaaaatatttgctttacatatctgggtggcctggtgttgggtgcatatgtatttggaattgttatattctcttgctgaattgatctctgtatcattatatattgaccttctttgtttctttttattgttttcaagttaaagtatcttttgtcttatttaaacatagctacccttgctcatttttttatttcaatttgcatggaatatctttttttcatccctttactttcaatctatatgtgtctttacaggtgaaatgagttcttatagggattctatacataggtcatttttttttaaatccattcagcccatctatatcttttaagtggaatgcctcatttgtttacattcaagattattattaatatgtgagggcttattcctatcattttacttggtttcttgttgtttgtatatcttttgtgtctttctttctgtcttattgtttattcattatggtttggtggttttccgtagtcataacatttgagtccttttttgtccttgtttgtctgtttgctctaccagtggttttatacttttgtgtctttttgtgatagtagatagtgtccttttgcttccaggtgtaggactaccttaaacatttcttgtaggattggtcttatgctgatgaattccctcagctttggcttgtctgggaaagactttatcttttgtttatgaatgttaactttgctgggtatagtatccttggctggcagttattttttttttttcctttaagcactttgaagatgtcatcccattctcttctggcctgttaagtttctgctgagaaaccaactgttagtctgttaggggttcccttataagtggctagatgcttttctcttgctgtttttaaaattatctctttgtctttgacttttggcaatttgactataatacacagtggataagacctttttagacgatatgtatttggagatctctgagcttcctgtgtctggatgtctaaatctcctgctagacttgagatgttttcagctattattttgttcaataggttttctaccccctttgttcttctattcaccttttggaacactgaaggtcaagtatttggtcaatttgtggtctcctttatgtcatgtaggttttgttcatttttaaaaattatttctttaaaaaaaatttgactgactgggtgatttcaaaagacctgtcgtcaagtcctgaaattttttcttctgcttgatctagtctattgttgaagctttagaatgtatttttttttcattcagtgaattcttcagttccaggatttctgtttgtttctttttttaataatatctctttgataaatttctcattaatatactgaattgtttttctgatttttttgtgctgtttatgaggttctcttgtctctcactgaggtttttaatatcaacacttttaataatttttctaggatttcataaatctctttttttggggatcttttgctggagaataattatttttatttggaggtgtcatatttccttgctttttcatgtttcttgtgtccctccattgatatctgcacatctggtgtgccagttgcttcttccaaaattttggattttctttcatacgggaggacttttcctgaagatgtatctgttgtgttggctgggtagggcaccttggctttgattctgggtacgtgcaatagtgtattctctatatgatttcttcagttgtaaacagcttcagtagtgtttgtgatttcctcagtagcttagggtgtggttgttagtgaaggctgtggtgaagctttgctgggcactgggatgccaggtaggaatgtcatcaggcccactgtggtaatggtaggcctagcatacctgtcattgggcctcagggcaacataggctggcaacaatgttagttggtcctggcaggccaatggttgcacctccatgtggctcaggtgccagaagtggtagtggtggtcctcgggtccctgggcagtgggcttggaaagagtgatggcagtagcagtggcagaacaactctttggccccaaaatggtttgtgctggtgttagcagtggctgtggaaggctgggtgggccagtctcaggtctgcaagtcacacatgcaggtgagtgtcagctgctgtagttgtggcaggttgggtgggtctgtcctcaggcccctgggagaagtgctcaagtgctaatggtggtagatgagacagtgaaatccccaggcctccaggtggcatgctcagacactgggagtgggacagagctggaccaggtcatcctttcctcaatcctcagtcatatgtgtgggcactggctgtgttggcagagccagggtgattccaaagtttctagtggaatgcttggatgggaacagcagtgactgtgctgtggctctactgttggagcgtgcaaggttgctttcattggtagcagtaataggcaggaagctgtggagcacatgccttggtctcaggtggtagctgtaggcagggtagcctgtcctcagagtcactaccagtagctcacacttcagccctggcagcatcagccagcagtggcagtgactgcagatggagaaatctgtcttcagggagtgggaaaatgcaccctatagcagggtcacgccaacggcttatggttctgctctggatgcaccagacagcagtggtggtggctacagatggatgatgtgaattcagctccagggatgtggagatgcaaggcctgctgggctccagtgcaggatgcagcctggtggggcctggcctttcaaaatggagacatgctgcagcttcttaggagttggagggtgtgtgggtctcagtgtgatctccctctctggagcatgccatcatgcagtctccaggcagatccctatgttagtctcaggacccaagagggtggatgggctctttgaaggctgagattgcaggagtctgcagtgggaatgtggactgctgagggtttctcacatacccttttcctgcactggagagcctctctgggctcccacccaatctggctgagcagagtgcctttcttccctctccttccttgccttaggtgtttcctgtctcttctctgttgaattctagtgttgtcttttggatgatcaattcaaagtgtgattctaatactattttggttcctctttctggaggaggcaagtaccggatgcttccagtcagccaccttgaacagacatactggaagaccaagttgtaccatctttataggcagatgtggctgaagagatgaaatttatgccctctctccatcagtttgggctgctataacaaatcaccacagactggctggcttagaaacaacagaaatttatttttcacaattctggaggctggcaagtccaagatcaagaaatcagtagattcggtgtctggtgagggctcacttcctggttcacagactatgccttcttgctgtttcttcatgtggtggaagaaatgagagaactctctggggtctcttttatgaaggcactaatctcattcatgagtggtccactctcatgtcctaatcacctcccaaaggaccccaccttcaaataccatcacattggggattagatttcagcatatttattttggagggacacaaactgctcttttaatattcattttttttaccaagacctacttattaatttctcagctattttgatctttataggatattctaataagtgtttttatgttttaagtattaatcattgtagtgggctgaatagtggccctctaaaaggtctgtcaatgtcctaatccctggaacctgtgaatgttaccttatttggacaaagtgcctttgcagagcctccagaggagggtacagacctactgacactttgattttacagtctggcctctctaactatgagagaataaattactgttgttttatgccactgactttgttgtaatttattacagcagccatagaaaactaatacaattattaatgtgttttaaatccatggtgttttgagaatacaattcaaatacaggttcaatattaaccatctggcttccttgccagctagcttgaaattcatttgtttatcatggaggagtaggtcatttgtgttaattactagctcaactagtagttttgctaaaagtaattttcattttttaaataaacaaggacacattttttgaccaaggagaaaaatcaagcatagagaataatcataacctttgaatactattcaacaggagggatttttttgtctatgggaatacagaagaaaattggtaaacaagcagtctagaccagacataagctgtatgtcagtgattataaggcaagtaaataattgtgccttagaattgatcaattcagttagaagaagggggaggagtcagccaagcctctaactagatggtctgaccatttacttgactaaagagtcatttgatgagatgagtgagatgaatatttatgctcagcaagtgtctgacatagtatgtactcaaaatttaatttaatattattattattactatcattaattaactcacagccttgagttgacatggatactttttaaaaataatgaagaaggtgttaaagactgcatgctgccacttgaaaatgtccttgccaacaggcccttataattgaggtagagagacaacatatgtgggctgcgattacaaagtaataaatatttgctttaaaaaatcagtagttacatatgaaaattcatgctgtccctttccaaattggctactttaggaaacttacattattttcacaaaaccgatgttacttaaaagtgtttttgagatcatctccagaccctccagtatgttgcttagaacctactttgaaatgacagtcctttttcctttgagggtggagcagctatgtcatttggaactaagttcacattttctaggttaacgtctttaaagtagaatgcttatatgtatgcatgtacttgagtttgtcttcttttggggagaaactatatttattttgttatcaaggaatccacttctatgactcgtgaagcccaggctgagttaacagtgatgagttctagagggacctacttcccagtctgaattttctggtttcaattcatcttctctcttaacctgaactgaaaacccagacttatgaagcctcaatccttgccctcttattcctggaaaattgcaaagccaaatatgtaggaggctttttcagaagagaaaatgactttgtgttttcagaaaacaaacccttcactttgctttatgaggcagatagcagccccaaaccatgtacaggttgggtcctgcacagatcttaattggtttcttttctaaagatgaatttatgtcattacttaatgggcacaccccatatatcatcagcattaaaatgggacattttgaatattctagttccatccccttcacccagcatgggatccttgcctccaacagttctgaggaaaagagcttattactttataagacacactagtacattgtttgaatcagttatactgttagaaaaacctattatagttaaatgatacaagatatgggtatgtgcccaatatagcacatagaacatagtaaaatacatgatagatatttataacctgctcatgtagccctaaaatgtgcttccttcaaactctatcttctggagcaacaaaggttaattcttaattcttcttctatatgacaaagcttcaatcgtttaaaaatatatttacctaatgtgtccttgaaacatctcccctccaggccaagcaccctcaagttcttctgtcattctcatatgtcaggatttctagacaggatacacttgaaacaggtaataatactaaataatatatgataagggagaaataagtggtattgagagctagttaaatagtccatagacaggatatccataggctagagtggtcttgagaaggtttagtggtgggagtggaatttatgcaaggccttaaaattcaagtagaatttggaaggactgagaacagactagaatagatctcctaagtgaggtaaagggccttttaatttagtccagtacagtgataggtgtttttattatttgttctatcttcctggagatgaaggttttaaaacaaaccctaaacaaaaaggaggagataaaattaaagatggtttcactctttaaagctgggcccttcggcaagtagctgtactagttgagggtggctgggagaagaaccagtggtttctgacaaagtagagcctttagcattgggaaagaagatattaattacaatggatgctaatagtttctatttgaaaattattgtagtggtttttctgaaaacacaataagtaagcattaggtgggtaactaaatcactgctgataaagaatcttctttactactagtgtgggaagacagttgcataaggaaatgtgcttggtgcctccatttctgttatacctttctcaggagctgataattggaaatgttttaagagaggttataattagggcttgggggcttcatgtatagttttttttttaattctcttggatttttatgtttattttcaaggcaaataagttgtggctcacttgtaggaggaaagactcaacttttgtcagtgttcaaaaaaagttgccattatacattgtccacttaaattattgaattatatcacaaataggtttgtatattagagtagcactatgtatactgagagcagtagagcttgcttcacttgttattatttgactagccatataaacccatgtacttagcatctacactctccctttctttctttctcactgtctcctttgcaccctcccgtaaatataccttgagttcttgaactatatctattgtataccaacatgtttgaatcttttggttggggtttctaacccccaccccaaacaaagacatagaatatgagttatttgaacaatgagaatttgtttttttggaaacagcacctttatttttgtttatttttgatccatgtgtatcctcagagtagactattttctaaaaagggtaaacaacacacagtataacagtggcagtgcaaggtgtgtggggtattttttattccacaggggagactatgatggagtcatctttatttaagatggcttctaatactctatgtcactcctgccactcagcatgtattactgagtcatgcacctagtagatactcaaataaggtctaattcagggcttctgtttcctggagcctaggagcacctaatagttaagaagtgatatatgtacataatcattaattctctttaccaatagcttccctggttgggtttgtttagtaacattatttatttagctaaacccattgctctatatgtgaacactaatcaatcagggcaagccctagcccagttaaaaaatccatgtctagttagttttgttgaaaaaaatggtgttggatgtattaatagatataattaagggagtatcctagttctctcatgtttgtattgcttctcaccttgtacataggaggctctctgaaaatgcttgttgaattattgagctggattgcaggacttaagtatcacaattattagcattacctcttccaaaatgttttgcagttatggtacagttaaagccaaaagtatagagacgatttgttattatggtttagatgagtaacagaggctccttagctcacttaaagagaaatcaggcaagtcacctgtggactagaaatctcctcagtctctcctctctagcccccctgtattaggtgttcatgaggctcgccaggggagttgaggaggtttactgcaaacaactgttcttttttcttttggggtaaatggtggtgcaaggagtaaggggacctggaagatggagaaagtgttgaaaacccaaagcacaacccattagttttgagagtataatgattaatcatcatttaaaatcccaggttggctgggaaacatatttcagaatatcatccatgaaaatttccccaaccttgctagagaggccaacagtgaaattcaggaaatacagagaactcctgcaagattctacacaagaagatcatccccaagacacacaatcatcagattttccaaggtcaaaatgaaagaaagaatgttaaaggcagctagagagaatgggcaggtcacctacaaaggggttatcagtctaacagcagacctctcagctgaagccctacaagccagaagagactgggagcctatatttaatattcttaaagaaaaaaatcttcaaccaagaatttcatatccagctaaactaagcttcctaagtgaaggagaaataagatccttttcagataagcaaatgttgaggggattcattaacaccagacctgccttacaagagatcttgaaagaagcactaaatatcgaaaggaaaggctgctactggctaatacaaaaacacacttaaacacacagaccagtgtcattgtaaagcaaccacataaacaagccaacatcataaccagctaacagcacaatgacaggatcaaatccacacatatcaatactaaccttgaatgcaaatgggctaaatgcccaacttaaaaggcagagagtggcaagctggattaaaaaagcaagacccggctgggcacggtggctcacgcctgtaatcccagcactttgggaggctgaggcaggcggatcacgaggtcaggagatcaacaccatcctccctaacatggtgaaaccctgtctctactaaaaatacaaaaaattagctgtgcgtgttggcaggcgcctgtagtcccagctactcgggaggctgaggcaggaggatgatgtgaacctgggaggtggaggttgcagtaagccgagatcacaccactgcactccagcctggggaacagagcaagactccatctcaaacaaacaaaaaaaaaaagcaagacccaatagtatgctatcttcaagagacccatctcacacataatgacacttacaggctcaaaataaagggatgcatgaaaatctaccaagcaaatggaaaacagagcaaaaacaagggttgcaatcctaatttcagacaaaacagatttcaaacgaagaaagatcaaaaaagcctaagagcattacataatggtaaaggtttcaattcaacgagaaaatctaaccatcctaagtatatatgcacccaacacaggagcacccatattcataaagcaagttcttagaaacataaaaagagacttagattcccacacaataatagtgggagacttcaacactccactgacagtattagacagatcatcaaggcagaaaattaacaaaggtattcaggacctaaactcaacattggaccaaatggatctgatagaccatgacagaactctccacccgcaaacaacagaatgtacattattctcattgccacgtggcacatactctaaaactgaccacataattagacataaaacaatcgtcagcaactgcaaaagatccacattcataccaaacacactctcaggaccacagcacaataaaaatagaaataaaaactatgaaaattgctcaaaaccatacaattacatggaaattaaacagcatgctcctgaatgacttttgggtaaataatgaaattaagacagaagtcaagaagttctttgaaaagaatgagaatcaagatacaacatgccagaatctctgggacacagctagggcaatgttaagagggaaactaatagcactaaatgcccacgtcaaaaagttagaaagatctcaaattaacaacctaacatcgcaactgaaagaattagagaagtaagaacaaatcaactccaaagctcgcagaagacaagaaataaaaaaaatcagaactgaactgaaggaaattgagacatgaaaaatcaaaagatcagtgaatccagaagtttgtttcttggaaaaattaataagatagataggcctctagctagactaataaagaagaaaataagatacaaataaacacaattagaaatgatgaaggggatgttactactgaccccacagaaataaaaacaaccatcagaaactactatgaacacctctgtgcacacaaactagaaaacctagaagagatggataaatttctggacacatactctctcccaagactgagccagaaagaacttgattccctgaatagaccaataacaagctccaaaattgaatcagtaacaaatagcctaccaaccaaaaaaatcccagaacctgatagattcacaatagaattcaaccagattacaaagaagagctggtactattctcacagaaactattccaaaaagttgaggaggaagatctcctccccaactcatcctgtgaggccagcatcatcttgatttcaaaacctggcggagacacaacagcaaaagaaaacttcaggtcaatatccttgatgaacattgatacaaaaattctcaacaacagacttgcaaaccgaatccagcagcacgtcaaaagctaattcaccatgatcaaccaggcttcatcaccatgatgcaaggctggttcaacataagcaaatcaaaaaaatgtgattcatcacataaacagaactaaaaacaaaacccacatgattatctcaatagatgcacaaaaagcctttgataaaattcaacatccgtttatgttaaaaactctcaataaactaggtattgaaggaacatacctcaaaataataagagccatctatgacagtcccacagccaacaacatgcggaatggggaaaagctggaagcataccccttgaaaaccagcacaagacaaggatggcttctctcaccacttctattcagcatagtaaggggaagtcctagacagagccatcaggcaagagaaagaaataaaaggcatccacatagaaagagaggaagtcaaactatctctgtttgcagacgacatgattctacatcaagaaaaccccatagtcttggcccaaaacctccttcagctgataaacaacttcaacaaagtttcaggatacaaaatcaatgtacaagaatcactagcattcctataaaccaacaacagccagaccgagagccaaatcagaaagacaaattcattcacaattgccacaaaagaataaaatacctaggaatacagctatccagggaggtgaaatatctctacaatgagaattacaaaacactgcaaaaaaaatcagagaggacacaaataaagggaaaaacatcccatgctcagctgggaagaatcaatgtcattaaaattatcatactgcccaaagcaacttacagattcaattctattcctatcaaactaccaatgacattcttcacagaattagaaaaaactattttaaaattcatatggaaccaaaatagagcctgaatatccaagacaatactaagcaagaagaacaaacctggaggtatcacattatctgacttcaaactatactacagggctacagtaaccaaaacagcatgatactggtacaaaacaggcacatagaacagtggaacagaatagaaagcccagaagtgaggcctttcacctacaaccatctgatcttggacaaacctgacaaaaacaagcaattgggaaaagacttcctattcaataaatagtgacgagataactggctagccatatacagaagattgaaactggacaccttccttacaccatatacaaaactaacaagatggattaaagacttaaatgtaaaacccaaaactataaaaaccctggaagacaacctaggcaataccatcctagacataggaatggccaaagatttcataacaaagacaccaaaggcaattccaacaaatgcaaaaattgacaagtgggatctaattaaacttaagggcttctgcaccacaaaagaaactatcaacagagtaaagaaacaacctgcagctgagcatcccagcggagcatgggatgtttttccctttatttgtgtcctctctgatttttttgcaacctacagaatgggagaacatatttgcaaaccatgcatctgacaaaggtctcataatcagcatctatagggaacttacacaaatttacaagagaaaaacaaccccacttaaaagtgggcaaaggatatgaacagacagttctcaaaagaagacatacatgcagccaacaagcatatgaaaaatagctcaaaatcactgatcattagagatatgcaaatcaaaaccacaatgagatgccgtctcaccccagacagaatggctattattaaaaagtcaataaatactggatgttggcgaggttgtggagaaaaggaaacacttatacactattggtgagtgtgtaaattagttcaactattgtggaaagcagtatggtgattcctcaaagagctgaaagcagaactgccattcaatccagtgatcccatgactgggtatatacccagaggaatataaatcatcctaccataaagacacaggcatctgaatgttcattgcagcactattcacaatagtgaagatatggaataagtctaaatgtccatcaatgacagattggataacgaaaatgtgatacacatacaccatagaataccatgcagaaataaaaagaacaagatcatgtcttttgtgggaacatggatggagctggaggctattattcttagcaaactaacgcaggaacagaaaaccaaataccgcgtgttctcacttgtaagtgggagctaaatgataagaacttatgaacacaaagaaggaaacaacagacactggggtctacttgagggtgaagggtgggaggacagagaggagcagaaaagataactattgggtactgggcttaatacctgtgtgatgaaataatctgtaaaacaaactcccatgttacaacctcctatgtaacaaaccatcacatgtacccccaaacctaaaataaaagtttttaaaaatcccaatttgggcaattaaaaatgctacagttgtagttagaaggctcttctagtgataccacctaaggaagagtatgggtctgggatatttctctcatatctctaggaaaggaccaaatgtcatttttaagtaggcattgaatacctacaatatgaaaagttctgtgtggaatgcagtgatgaactggattcccaccctttttccacctactggtttatagtgttttaggtaaagataaataaaggaacaatggaaggcagaatgtattaactgttctaagtggtacaaggtgcgagaagaggaaagagtgatttgtaatgattcagtaagtgagattatcacaaggtaggggatgcatgtttacttttccagggtaattatttttaatggcaactgaacttagttcacactgacaattgacagcactcctttgagaaaaggataataatttatatcctaagtaaggactgagcagattactagaattttaccataaaactataaagaggaattaaaattgtaggcttatactcacatatttgcaggttttcattatatatttttctcattctatgttttctttataccataatgatgtacaaggatgataataaatgatgtataagaatcatgttttccttataactggggatggtagggtgcagtttgatggggagagatcttcagtttcagcaagactgagtggttaaagcagagccttaaaaaccaacaatttaaataaaaagaagggaccttggagcacagcaaaagctgtgtacactgcctgaagtttaaaaagacatccctgtattgttaccatatgttgttaatagcactcattcaaggaaaagcccattggcaaactggttgatgaggctggccagttcaaatatagaggaaacttcacagggagcataataaaatggtaatcaaaagatattattgtatgctttaaaaacctgatttaaaaaatcaaatttaatgtaaatttaccccactttgattcagttgcttcaaactaattttctatttaacttaatatctagtaatatcagaatttttctttggtaaaaagctcaatttaaaatgtttttaaattaaaagttgggggttctaaaccctttgctttccccaagttcagggtagttagaattatcacccagattgtttggatcaggttcgcccatatacaggcttagcacattgtacatacacacatacctacattaagtcatgaggattttctggattcaatattttattcttttaataaaaatttgtaattgctcagattccaatttattctggactgaaactagtttttccttcaggttcagggcttgtaagtccagggcacttgctgtttgaggcctatttttattatttcctccatccacaatgggcactatgttcttctttttcaccacttacttataaaagacacacatgcatgcacacacacatacatagaaacatacgtatttatagacaggaaactgctatgccgtttaaataagaaatcactgcgcctttctcataagctcagttttttttccttttgatgcctgatttattctttcttataagaatctgagctgttagttacatataacaattgtcccccttgatgactactttctgatagcctgaccctttcattttcagacctgtattgctgttcttgttttcttttactaacagtggtctcttctcttcagctcttctctggtgtttgcagttctgcctttgtagatgacaaagaatcttggaaaaaatgcagaaatggtaggaataaagaggagcaggacaagatagtgaagagattcttattctgctattcattactcttctgttggaggggctgaattgtaaaatgtgacaaaagcagggaacaggaaaattataatgatacggtcttctgttaggaggtaatatttacttattgggtaaccaaaatgagtatctggttagtgtaaggaagatgagaaagacagtccttatgtttgctggtatataaaactattgggaggggcagaacaagatggcagaatacaaacctgcaacgttagtactccccacaggaacaccaaattttaacaactatctgcacacagaaagcactgtcacaaaaaaacaaaaatcaggtgagcaatcacagtaccggactttatattgttgaaagaggtattgaggagggtcagagagacagtcttgaatcaccagatccacccctcccctatcccccagcagcagccatgcagcacagagtgtctgtgcactttcaggagggagagtgaagtgactggggacattatattgatttcagtgctacactgtcacagtggagaaaaaagccatgctgggctcagtcagcacctgtgcacagagggggcatttgcagcagccctagccagagagggatcaatcatccatcccatcagtcagaactccactctctcagcaagcctcaccaccacaggcaaaagagctctggggtcctaggtaaacttgaaaggcagtctaggacacagtgactgcaatttccaggtggcccttagtgctgggctaggctcagagccagaggactagggtggcacgtgacctagggagacaccagccagggcagctaaaggagtgcttgccccatgcctccccccaaccccaggcaatgcagttcacagcaacgaaattgtctccttccttctgcttaaggggaggaaaacaaagatgaaagaggacttcgtcttgcatcttggataccagctaagccacaatagggtagggtaccaggcagagtcgtgaggcccttattccagggcctaggtcctggacaacatttctagctataccttggtccaaaagagaaactgctgccttgagggaaggactcactcctggcaggattcatcacctgctaactaaagagctcttgggacctgaataaccagcaccaataccctagtagtatgctgtgggctttgggttctaagacgttctgaccacagatgtgatccagcacattcccagctgtgttgtctacagtaaacaactccttctgtatgagaaaagcagacagaaaagtaaaggggacttcgtcttgcaccttaggtaccaacttgaccaaagtggggtagagcaacaagcaggctcttgggttccctgagtctaggcctaggctcctggatggcatttctggacctgccctgggtcagaccatagccctgaagggtgagtcacaggcctggcagtattcagcacaagctaactgaagaggccttaggctttaagggaacattggcagtggccaggcagaagcccgccctcctccttcccccaccatgggcaagtggtggtgatggtgacagggagaggcctctctgcctgtggaaagaagaagaaagagtgggaaagactgcatgtcatggttttagcaccagcttagccacttatctatttagtaggatagaacatcaggctaatttctgatgtttttttaactccaatccctggcacccagacaacatctcctgaccagcttgtggcatggaggaacttgtcaccctgaagggaaggacaccaaacagtctgactttgccacctgctggttgtagagcccaaggacttgagtaaatgtgggtggtagccaggtagtggtttcagcagaccttgggtaagatccagtgttgtgctggcttcaggtatgaacaagtgcagtctcagggatggtggccacaggagtgcttccatcaccatacccccacctccagacagctcagctcagagacagagactgtttgtgagaaagtagggacaaaaaaaaacaagagttcctttctggtcatccagaaaattcttccagattttatttaagaccaccaaggtggtacctcttatgagtctgcaaaaaccacagaaatattgggcttggggtccagtctcttaaaatacttgtaaagcctcctcaagaaaggcagaagcaaataagcccagactgtgaagactacaataaatacctaactcatcaatgttcagacaccggtgaacatctacaagcagcaagatcatccaggaaaacatgagctcatcaaacgaactaaataaggcaccaggacctatcctaaagaaacagcgatatgtgacctttcagacagaattcagaatagctgttttgaggaaacttaaagaaattcaaggtaacacagggaaggaattcagaattctgtcagataaacttaacaaagagattaaaataattaaaaagaatcaagcagaaattctagagttgaaaatgaaattgacgtactgaagaatgaatgcatcagagtctcttagcagaactgatcgagcacaagaaagaattagtgagcttgaagacagactatttgacaatacacagtagacgaaagaaaaaagaatgaaaaacaatgaagcacacctacaatatctagaaaacagcctcaacagggcaaatctaagagctattgcatttagatgggggatagagaaacagatagaggtagaaattttattcagggggataatatcaaagaacttcccaaacctacggaaatatatcagcattcaggtacaaggttatagaacactaagcagctttaacccaaagaagactacctcaaggcatctaataatcaaacctcctaaaggtcaaggataaagaaaggatcctaaaagcagcaagagaaaagaaacaacataacatactatggaactccaatacctgtggcagcagtcttttcagtggaaaccttacaggccaggagagagtggcatgacatatttaaagggctaaaggaaacatattttaccctagaagagtatttctggtgaaaatatccttcaagcatgaagcagaaataaagaccttcccagagaaacaaaagctgggcatttcaacaccagacctgtcctacaacaaatgctacagggaattcttcaatctgaaataaaaggatgtcaatgagcaaaaagaagttgtctgaaggtacaaaactcactggtaataataagtacacagaaaaacacagaatattataatgatataattatggtattttaactacccttatcataagtagaaagatgaaatgatgaaccaatcaaaaataatatctacactacaacaacttttcaagacatagacaatacaacaagacacaaagagaaacaacaaaaagttaaaaagtggaaaggatgaagtttaagcgtagaacttttattagttttcttttcttttctttctttttttttttttttttgagatggagtttcgctcttgttgcccaggctggagtgcaatggtgcaatcttggctcaccgcaacctccgcctcctgggttcaagcaattctcctgcctcagcctcccgagtagctgggattacaggcatgcaccaccatgcctggctaattttgtatttttagtagagatggggtttctccatgtcggtcagactcccgacctcaggtgatctgcctgcctcggcctcccaaagtgctggaattagtcatgagccaccgcacccagccttattagttttctttttgtgtgtttgtttgtttacgtaatcagtgttaagttgttatcagttgaaaacaatgagttataaaatcgtatttgcaagcctctcagtaacctcaaatcaaaaaacatgcaatggatcacacaaaataaaaggcaaacaattaaatcataccaccagagaaaatcacctttactaaaaggaaaggaagggaagtaggaagagaagaccacaaaacaactggaaatcaagaaacaaatgacagaaataaatcactacttatgaataataccagtgaatgtaaatggactaaactgtccaatcaaaagatataaaatagctgaatggatgaaaatacaagaccccatgatccattgcctacaagaaacacatttcaactataaagatatacatggactgaaaataaagggatgaaaaaagatatttcatgccaatggaaacaaaaaaggagcaggaatagctataaacactctaagaagacacaaagaacatcattatataatgataaagggttcaatccagtgacaggatagaacgattgtaaatatatatgcaacaaacactggaacacacatatataaagcaaatattattagagctaaagagagagatagacctcaatacagtaatagctggagacttcaacactctactttcagcattaggcagatgttccagacaatcaacaaagaaacatggaacttaatcttctctatagaacaaatggacctaatagatatttacagaacatttcatccaaaggctgcagaatacatattcttctcagcacatggatcattctcagggatagaccatatgttaggtcacaaaacaactcttaaagcattcaaaaaattaaaataatgtcaagcatcttctctcatacaatggaataaaacaaaaaattaagaacaaaacgaattttggaaactatacaaacacatggaaactaaacaatgttcttcctaatgaccagtgagtcagtgaaaaaattaagaaggaaattggaaattttcttgaagccaatgataatggaaacacagcatacaaaaacatgtgggacacaatgaaaacagtactcagagggaagcttatagctataagtgactacctcaaaaaagaaaaagaacttcaaataaacaacctaccaatgcatcttaaagaattaaaaaagcaagagcaaaccaaacccagaattagaaggaaagaaataatgatcggagcaaagataaatgaaaatgaagaaaacaatacaaaaaatcaatgaaaccaaaccttggttttttttattttgttttcattttgttttgttttgagaagataaaattgacaaactgtaacccagactaactaataaaaaaagagagaaagtccaaataaataaaatcagagatgaaaatggagacatataactgataccacgggaatgtaaaggatcaccagtggctactatcagcaactatatgctaataaactgaaaaatgtagaagaaataaataaattttgagacacatacaacctaccatgtttgaaccaggaaaaaattcaaaacctgaacagaccaattacaagtaatgagatcaaaaccataataaaagtctcttagtaaagaaaagcccaggaactgatggcttcactggggaattattccaagtatttaaagaggaactaataccaatcctactcaaactatctggaaaaaaagagcaggagggaaactcattctgtgagggcggtattactctaataaccaaaacaaacaaagacacaacagaaaaagaaaactacaggccaatatctctgatgaatattgctgtaaaagtcctcattaaaatactagcaaactgaattcaacaatacattagtatgatcattcattgtgaccaagtgggatttatcccagggatacaaggatggtacagcatacacaaatcaatatgatacatcatatgaatggagtgtagcacaaaaaccgtgtgatcatttcagttgatactgaaaaagcatttgctaaaatttgaaattccttcatgataaaaattctcaaaaaactagggatagaaggaacatatcttgataaaataaaagccatatatgacagaccacagctagtattataatgaatgggataaaactgaaagtctttccttcacccaaaggattataaatcatgctgctataaagacacatgcacacgtatgtttattgcggcactattcacaatagcaaagacttggaaccaacccaaatgtccaacaacgatagactggattaagaaaatttggcacatatacaccatggaatactatgcagccataaaaaatgaagagttcatgtcctttgtagggacatggatgaaactggaaaccatcattctcagcaaactatcgcaaggacaaaaaaccaaacaccgcatgttctcactcataggtgggaattgaacaatgagaacacatggacacaggaagggggacatcacactccggggactgttgtggggttgggggaggggggcgggatagcattaggagatatacgtaatgctaaatgacgagttaatgggtacagcacaccaacatggcacatgtatacatatgtaacaaacctgcacattgtgcacatgtaccctaaaacttaaagtataataataattttaaaaaatgttcattatgggaaatttggaaaaatatataaaagttgaaggcataaaaaaaaagaaagtctttccttcaagattggaaaaaacaaggatgctgactgtctccactattatttaacatactagtggaagtcctagctagagaaaggtattaaaggcattcaaattggaaaggaagaagtcaaagtatccttgtttgcagatgatataatcttacatttgaaaaaaaacaacgatgccaccaaaaaactattagaactgataaacaaattcagtaaagttggatgataccaaatcaacatacaaaaatcagtagcatttctatataccaagagtgaataatctgaaaaaggaataaaaaagtaatctctttcataatagccaccaataaaatcaaatacctaggaattaatttaaccaaagaagtgaaagatctctacaatgaaaagtacaaaatgctgatgaaagaaattgaagaggacaccaaaaaatggaaagatattccatgttcatggattggaagaatcaatattgttaaaatgtttgtagtacccaaagcaatctgtagattcaatgcaatccttatcaaaataccagtgacatttttcacataatttttttttaaaacctaaagtttatttggaaccacaaaagtctcagaattgccaaggctatctggagcataaaggacaaaactgaaggaatcacattacctgagttcttcaagttatactatagagctatggtaaccaaaacagcaaggtactggcatgaaaacagacacattgatcaatggaacagaatagagaacccagaaataaatccatacacctatgatgagctcgtgttcgacaaagatgccaagaacatacaatggagaaaggactgtcttttcaatgaatggtgctgggaaaactggatatccatatgcagaagaatgaaacttgatccccatctcttgccatatactaaaatgaaatcaaaatggattaaagacttaaatcttagacctcaaactatgaaactactacaagaaaacattggagaaactctccaggacattggtctgggcaaaaatttcttgagtaatactccacaagcataggcaaccaaagcaaaagtggacaaatgggatcatatcaagttaaaaagattctgtacagcaaaggaaacaatcaacaaagtgaagagacaactcacggattaggaaaaaatatttgcaaactacccatctgacaagggatcaataaccagaataagaagctcaaacaactccataggaaaaaaaatctaataatcagatttaaaaactgacagaagatttgaacagacatttccaaaaagaagaaatataaatggcaaacaggaatatgaaaaggtgctcaacattattgatcatcagagatgatcaaaggtacaatgagaagatatcatctcaccccagttaaaatggcttttatccaaaagacaggcaataacaaatgctggtaagaatgtggagaaaagggaactctcctacactgttgtgggaatgtaaattagtgcaagcactgtggagaacagtttggaggttcctcaaaaaaatgcaaatagggctatgatatgatccagcaattccactgctgggtatataccctaaagaaaggaaatcagtatatcaaagtgatatctgcactcccacgtttgttgcagcactgttcacaatagccaagatttggaagcaacctaagtgtctatcaacagatgaatggagaaagaaaatatggtacatatacaccatgaagtactattcaaccataaagaagaataagatcctgccatttgcaacaacgtagatggaattggaggtcattttgttaagtgaaatcaaccaagcacagaaatacaaacatcacatgttctgtcacttgtttgtgggatctaataatcaaaacgattaaactcatggacataattgcacatttaaaaataactaagagtataattggattgtttgtaacacaaaggataaatgcttgagtggatggataccccatttaccattatgtgattattattcattgcatgcatgtattaaaatatctcatgtaccccataaacatatgtacctactatgtacccacaaaaattttaaaaatttaaaaacttggaatgtgtagaagaatggaggaaaattaatttgtcctgcttagacctattatgtatcgccttttctagataactgtgcaaggtgtattcccagcatgtgcaggtgttgtcggtcatgagtgctttagttttagatgcaaagcagtaaatgtggcccctaataaggtttgttgactgctgattccgtagcacaaatgagcaaagaagagattagataagggaagatttcagaggctgtagtgaaaatgaaattttctttgcttttttaaggctaggatgacaaaacctcaaagtaacactgctttcaagcagtgacttgttgccctgagtgatttcaacttaatttgttgtttcacggttgcctggtaggcaagaagaccactaaaaccagaagctatcataggctattttatcaataagatacagcatattcctattgcttaaagtctgctatttttgagaaggcatcctatgccaagaagcaagggactgacctgagattgcacagcaagttggtaacattcattttatgacaacaccaacctagacttccacttttttcttattgaaaccttggataggttgatcaattttatggttaattatatgataataagcatgaatattttaacttttactggatacctgtagcacagcaatagagttggagtctttgaagtgttgtagtacttggaactttatgtagtgtgtattcctacaactgctgtatcatgtattcaaacataatactccaaataccttccactgcagtttaagccctgttttcttttccaattccccttggagattattcgctcatcatactccctcctcttttccttttgtctcttcctaaacaaatgaacagcctttccaattaaataatgatttttctctctacaaacccacccatccaccttctttctctactccatgctgaaagatgccagtaatttagacccatcttcatcccttgtttccattatctttgtagtttgctttctctcttcttaactccttattgatgtggtatggggcatgctattttttccactacataattaggaaactatatgcaccaattttatgggatatctgttttcatctggctcctgtgctctccacccatgaaggcaacaagacaaaaatatcttgggaatcacttttctttctcacagggatggggtgggttggagaggggtcttttctgatttgtttctgctctatatccagtggtgtactagaattggtttgcattggcttttgacaactaattgtacacatctcttcccaacttcaagttcatgtttagtgattggtagcttgaaattgaccatggtggaattgtttaatccatggaaatcagcaaagctaacaaataagggctccccacccatcaggcttgttgttaaacatttaccagcatattactgcctgtttcaaaattagtcttgataagaaagtctatcttaagtacctgtccagttggaatcaactaggcaagaacctgggcaatgaaactaaggcatcatggtagatcagaggaatactatatctgttttggttctatgcttctgagttctcagtccaagaatacttatttaccctacctaggggatgaaatgacccaacaactggaatggagttgggcccacctgctggagcttgactttagctgtgggaattagaaggtggtagtgaggtggaaatcaggactgactgtacccttcagcagccagattctcttgttacatgtttcaggcctacctcccttgttgatttatcaagcaacttgctggtagaggttggtgcatctgacccttcacaagaactagatatgaaatatgcaaactagtatttacttcagctttagtgctgacaggcttgggggtcatttaggttgtctgagcctcagctgttcttgtcagtgaaagggaaaagctagagtggacattaatttgcatttatgtaaaagtgattacttataattagtgggtagataagtagaagctatagtctgtagtggcaaagatgtgacttagctttcttggcaaataagtccctgtaggtcaaggtctatgtctttgactaattttatactgtaccatatttggagagggatttattaagtatatttcaagaggaattaatcctcccaacaataaatttaatattagaatcataacacttcagaattgaaaggaacccttagaaattcatctagtccaatatcctttagtttaaaacatgcatggctataaaagtcaactcaaaatggaataaagacttaaatgtaagcctgaaactataaaattacttgaaaaaaacacagggggaaactacaatacattggtctgggcagtaattttttggatttgaccccaaaagtgcagacaacaaaagaaaaaaggacaaaggggattgtatcaaactaaaaactttcttcacagcaaaggaaacaattaacagtgtgaagaaacaacctacagattgggagaaaatatgtgtaagccatacattcgataaggggttattatccaaaatatataaggaactcagacaacttagtagccaggaaacaaatgacccaattaaaaaatggacaagaaacaatgcatctgacaaaggtctaatgtccagaatctataaggaatttcaacaaatttacaagaagaaaacaaacaaccccattaaaaagtgggcaaagtatgtgaacagacacttttcaaaagaagacatacatgtggccagcaatcatatgaaaaaaagctcaatatcactgatagagaaatgtaaatcaaaaccacaatgagatgccatttcatgctagtcagaatggctattactaaaaagccaaaaaataacagatgctggcaaaattttagagaaaaaggaacacttatacactgttgttaggagtgtaaattaattcaatcattgtaaaaaacagtgtggcaattcctcaaagagctaaaaacagaactaccattccagccagcaatcccattactgggtatatgaccaaaggaatataaattattctattataaatacacaagtacacctatgttcattgcagcatgttcacaatagcaaagacatgggatccacctaaatgcctatcagtggcagataggataaaggaaatgtggtacatatacactatatgcagccataaaaaagaacaagatcatggccgggtggtggctcacacctgtaatcccagcactttgggaggccaaggctggtggatcacgaggtcaggtgttcaaaaccagcctggccaacatggcaaaacaccatctctactaaaaatacaaaaattagccagacatgatggtgggcgcctgtaatcccagctactcgggaagctgaagcaggagaatcacttgaacctgggaggtgaaggttgcaatgagccgagatcatgcctttgcacttcagcctgggcgacaagagcaagactctgtcaaaaaaaagaacaagatcatgtactttgcaggaacatggttgctggaggccattatccttaccaaactaacacaggaacagaaaaccaaatactacttgttcttactgataagtggcagctaaatgatgcaaacacatgggcacaaagaggaacaacagacactgaggacttccagatggtggggggtgggaggagggagaggatcaggagaaataactaatgggtactaggttcaatacctgggtgatgaaataaactgtacaacgcaaccccatgacacgagtttacctatttaataaacctgcacatgtatctctgaacttaaagtaaaagtttttttaaatgggcaagggacctgaataggcaattctcaaaaggacttgtaaaaatggccaacagaaaagatatgaaaaaatgctcaatattgctaattgttagggaaagccaaattaaaaccacagtgaaatataacctcatattcatcaaaatagctattatccaaaagatgaaagttaacaagtattggtgaggatgtgaagaaaagagaacccttgtatactgttgataggaatgtaaattagtacagccattatggaaaactgaatagggattccttaaaaaactaggccgggctcgggggcttatacctgtaatcccagcactttgggaggccgaggtgggcggatcacgacgtcaggagatagagaccatcctggctaacacggtgaaactctgtctgtactaaaaataaaaaaaattagctgggcgtggtggcgggtgcctgtagccccagctgctggggaggctgaggcaggagaatggcgtgaatccgggaggcggagctttctatgagccaagatcgcaccactgcactccagcctgggcgacagagtgagactctgtctcaaaaaaaaaaaaaactaaaagcagaattaccatatgatccatcaatcccacttctgggtatttacccaaaatatttgaagacagtttgtcaaagaaatgtctgcactcccatgttcattgccaagttatagaatcagcctaagtgtccatcaaggaataaatggctaaagaaaatgtggtacatatacacaatggaatgctattcagcctttaaaaagaaggaactgctgtcatttacagtaacatagatgaacctggagttatgctaagtgaaagaagccaggcacagaaagacaaataccgcatgttttcacttgtggaatctaaaacaatcaaactcatggaatcagatagtagatggtggttacacaggctggggcttgtggggaatggggagatgatagtcaaaagacacaaagtctcaggtaagagaaatacaggtttttttgagatctattgcacatcatggtgattatagttaataataatatactgtgcatttcaaaattgctaagacacatacatcttagattttattgttccttggagagctgttgcatcttgaacagaacacttttttcatactgaatatagaaacttgccctgagacttgaatggtatgaggaccaactggaggggaagcaattaaactttggtcgagaagactgaatatttctctagatattcaaatacagtctctgaaatacaactctaaatgtatacagttgatataagttggttttcctttaatttttaattttgaaataatttaggacttacagaaaatttgcaagaataaattgtaaaacgaactcctgtatacaccttccccagatttcccaaatgttaacgttttttacatttactttatccttctctcccccatctattttctcattcatagtcttacacagtgttcattttgccctatctatctatctatctatctatctatctatctatctatctgtctttctctgtctctttctgcttctctctctttctctccttttttttctgaagcatttgagaacaaatacatagtgtccccaatactatagtgtatatttcctaaaaacaagataattctctttcataacaacggtactacaatcaaaatttggaatttcatcaattgtcacaattatgtttttatagaaaatgaaaagctcaaattgtgtttagcattcagatgtcacaatgttttagtgccctttaactcagaatagttcctcagtctgtcttttaaggcattgacttttttgaagagtatagaccagttatttttagcagctttatcaagatgtaattagcatactatacaattcactcgtataaggcatttaaggcatacagttcattgttctttagtatattttcaggactgtgcaaccatcaccacaatctaattttagaatatttttgtcctcgataaaagaaaatcattactcattagcagttactccccaccatttctgatcctaggtaaccactaatttactttctgtttttatatatttgcctattatggacatattttataaatggatctgtagcaatatgtggccttttgtgtctggcttcttttagttggcataatgttttcaaggttcacctatgttatagtgtgtacttcgttcctttttgcagcggaataatataccattgtatgggtatgctacattatttatttattcataatgtgaggaacatttaggtttttaacacattttggctattgtgaaaaatgctgctatgaacattcatgtacaagtgtttctgcggacatatgttttcaactgagtggaattgctgggtcacatggtaacctaactttataagaaattaccaaactgttttctaaagcagttgcaccattttacattcccaccagtcagagggaccaatttatctacatccatgccaacattattatcttttttataatagccatcatagtgggtatgaagtggtatctcattgtcatttttatttgcatttctctgctgaccagtgatgtgaaacatctttgcatgtgcatattggccatttgtatatcttctttgaagaaatgtctattcagactctttgcccatttttaattgatttacttgacttttttattgttgagttgtaggtattctttgtatattctagatacatgttccttatcagatatatgatttacaaataccttattacattctgtgagttgtttctccatttttggtggtgtcttttgcagcacaaaagattttacttttggaaataattttcttaaataccttattgaaacttcaaagaaaaaggttttaattttgaagttcaatttatctatttatacagttggtgcttgtgcttttgttgtcatatccaagaaaccattgtctaaccaagatcaagaagatttacttccatgttttcttctgagggttttgtagttttagctcttccgtttgggtctttgattcactttgtgttaatttttaagtatggtgtgaggaaggggtgcaactttattcttttgcatgtggatattcagttttcccagcaacatttgttgaaaagactcttctttccctcattgaatgatcttggcactcaaaaaaatcaactgagaccgggtgtgatggctcactcctgtaatcccaacactgggaggccgaggcggaaggatctcttgagccaaagagttccagacctgcctgagctacgtggcaaaacctcgtctctacaaaaaaatgcaaaaattagccgagcgtggtggtgcatgcctgtagtcccagctacttggtagcctgaggtgggaggatagcttgatcctgttaattagcttgattaaaccagaggtggaggctgcagtgagccaggattgagccacggcgctccggcctggttgacagaaatctttgtctcagaaacacacacacacacacacaattttcaaccccttaaaattttattaacttttttgtttttattattcctctgtccttgcttccagttaatcttgctacttaggtaaaagagggaaagggaggagattgaaaactaatgaattaaattaagttttgatgcagtcgatattattcattttctctctgtcccccatcttaggatactgaaaattgttcatctataggagtaatggaaaacctgatagtgctaaagaaatatcccatggcagaaacaaaggactttttcccctttcaggaatcattgacccaaaattcagtctgagacaaaataaaagtcaaaaagaacctatttgagttataggtttttgtgatttttttccctcataaaacctccacagggacaaactcacctgatttttaaaatatagaacaggagtcaaggtgagtataacaaataattgaaatgttctttacttttatgtcatgggtagttagaggatagagaagaaaaagaaaagggtgagagagagaaagaagataatgttggaaaggaatgggagaggtataagaagagagggcaggaaagggtccatctcagaagagacaaacagttgttttctactaaagtatgagagattttttttttctggacagcagcctggacaacatagtgagactctctctgcaaaaaaaattacttatttcttatttttttccttcaaagttttattttaggttgaggggacacatgtacaggttggttacattggtaaattgcatgtggctggggtttcagttgccaattatttcatgttcacccaggcagtgaacatagtactcgataggtagtttctcaatgttcaccctccttccaccctctgccctcaggtaggccccagtgtccattgttcccgtctttatgtccatgtgtttagctcccacttgtaagtgagaatatgtggtatttggttttgcattaggaaattaggaacagaaatgttcctgcattaatttgcttaaggtaatggcctccagctgcatccacgttgctgcaaaggacatgatttcattcttttttatggatgcatagtattccatgatgtacagcacagtttctttatccagtccaccgtcgatggacacctaggttgattccttatctttgctaagtgaatagtgctatcatgaacatactcatgcatgtgtcttaatggtagaatagttaatattcctttgggtatatacccaatagtgggattgctgggtcaaatggtaattctattttaagttctttgaaaaatcatcacattgattttccaatggctgaactaatttgcattcccaacaacagtatataagctttcccttttctccacaaccttgccagcataggttattattattattattattattatactttaagttctagggtacatgtgcacaatgtgcaggtttgatacataggtatacatgggtcatgttggtttgctgcacccatcaactggtcatttacattaggtatttctcctaatgctatccctcctccaaccctcaccccccaacaggccccagtgtgtgatgttccccaccctgtgtccaagtgatctcattgtccatttcccacctatgagtgagaaaatgtggtgtttggttttctgtccttgtgatagtttgctgagaatgatggtttccagcttcatccatgtccctgcaaaggacatgaactcatcctttttcatggctgcatagtattccatggtgtatatgtgccgcattttcttaatccagtctatcattgatggacatttcagttggttccaagtctttgctattgtgaacagtgccgcaataaacatatgtgtgcatgtgtctttatagtagcatgatttataatcctttgggtatatacccagtaatgggattgctgggtcaaatggtatttctagttctagaatcttgagggatcgctacactgtcttccagaatggttgaactaatttacactcccaccaacagtgtaaaagcatttctatttctccacatcctctccagcatctgttctttcctgactttttaatgatcgccattctaactggcgtgggatggtatctcattgtggttttgatttgcatttctctaatgagcagtgatgatgagctttttttcagatgtttattggctgcataaatgtcttcgtttgaaaagtgtcttttcatatccttcgctccctttttgatggggttgtttgatttttttcttgtaaatttgtttaagttctttgtagattctggatatcagccctttgtcagatgggtagattacaaaaattttctcccattctttaggttgcctattcactctgatgatagtttcttttgccgtgcagaagctctttaagtttaattagatctcatttgtctattttggcttttgttgccattgcttttggtgttttagtcatgaagtccttgcccatgcctatgtcctgaatggtattgcctaggttttcttctggggtttttatggtttttggtctaacatttaagtctttaatccatcttgaattaatttttgtacaaggtgtaaggaagggatccagtttcagctttctacatacggctagccagtttttccaacaccatttattaaatagggaatccttttcccatttcttgtttttgtaaggtttgtcaaagatcagatggttgtagatgtgtggtgttatttctgaggcctctgttctgttccgttggtctatatatctgttttggtaccagtaccagcagcattggttgttttttgacttttgaatgatagctattctgactggtctgagagggtatctcattgtggttttgatttgcatttctctaatgattagtgatgttgagcattttttcatatgcttgttggccacatgcatgtcttgttttgaaaagtgtctcttcatgttctttgcctactttttaatggggttgttttttgctcattgatttaagttccttatagatgctagatattagacctttgtcagatgcatagtttgcaaatattttatcccattctgtgagttgtctgtttactttgttaatagtttcttttgctgtgcagaaaatctttagtttaattaggtcccacatgtcaatttttgtttttgttataattccttttgaggtcttcatcatgaaatctttgccaggacctgtgttcagaatggtattttctgggtttttatagttttaggatttacatttaagtctttaatccatcttgagttgatttttgtatatggtgaaaggaagaggtccagttttaatcttctgcacatggctagccagttatcccatcaccattttttgaatagggagtcctttccccattgcttgttcttgttgacactgttgaagatcagatggttgtaggtgtgcggctttatttctaggttctttaacctgattccttggtctatgtgtctgtttttgtaccagtaccatgttttggttactgtaaccttgtagtatagtttgaaatcaggtagtgtgatacctccagctttgttctttttgcttaggatggcattggctatttgggctcttttttggttctgaattttataagttttttttataattttttttataatttttttttaattctgtgaaaaatgtcattggtggtttcataggaatagcattgaatctttaaattactttgggcagtatagccattttaacattattgagtcttcttattcatgagcatggaatgtttttcttatttgtttgtgtcatctttcatttctttcagcagtattttgtcatttttttgtatagatcttcaacctctttggttagctgtattcctaagtattttattaatttttggctactgaagcatggcagactgaaagttaatatttctactgtgtaaaatcacctagaagtaaagagaataagactattatgaggaaaatggaattgtaggaagattagagatgctagaattgtttatcccagagaagagaagactaggggaaggtggcatgattactgcctttatctaccttaaagccctaaaggaaaagagtaaatatacttctattttaaggcagaagctatagggaaacaaagtttttctcaacataggtgagcaatggaatgggatggtaggaaatctattttcaggaggcaaggatggtagtattcactaaagttactttaacatcgaatgcaactttagtttagatgattattaaggtcttcctgaccctttagtatatggactgtatttaaagaactttagtgtatttttttcactattcataaatgatggtttggaaagtgtttgttgccttgccttagtcttccggaagatgggtcatgattgtgcagtttgtgcaatggctagtgtagaatgggcctccttcaataggaaccggcagtttaagacttaggccatggcattaatgctatagtaaccttccattcttgtcgggctctttgaagtagctaaagaccaatggcataaaatagcaaattcaaattcaagaattgaatttctgtttagcttgctatttccaatactaattattcatttcacatagggcttttgtctaggttagaagccttacttaaaaaaaaaatctgaatctctcaagtccttttatttcacaccagtgaacttccatattctaatagtgcaaacgaagacaaaatagggtgagtggatgaataagaatcaatagtataaatggagaaatccgatttcaaattggactttcaagtgtattgaaatgcattgtgtaagaaatctatgtaagatgcttcttaatatgttactactcacagattataacatgatttaagttgttggaaaagtttaatagatcacagcagatggtatactatctcagacccattttcctgccaagtcctcaactgctgaagaaaaggagttacttgtgataggggtattttcctgtcatcccttcatacaaaagtaagaaatttcagggttaaggataactcattcaggaatctatgtttactgatgagattttaaaggaagtcatgccatgtgaaggggatgcacttaagcataaggattattgaaaagcattaaaatattaatctagcttttaaaagcaatgcttttatctctgagtgtaaagagagtgtttgcttattcattatcttttcattctaaatagaataaatcacttaagaattaaaaaagaagcaactcatctttttcaatctataaaggaaatggttgaataaattaactacaaaagccaatattttcatttctttttatatttactgggcttcaattttttatttagagacttaccttagattcttaatattcaaagatgtgttaatttaacctaacacatagataattttgctctaaataaaaacagcataagtgtgcattgtttttgatgacaggaatattcccagtataaatttgtgaggatctgtccacttgggaagactcaacttacacaaaaagaaaaacaatataaagtaactaagatatatgaggttcaaaggtagtacgtactctggagtttaaagaaagaaagaggttgttgtgagctaggttagtggagaaaactttttgagaaatgtaggatttcaacaagatggtaaaggaagaccaatacttaaggaaaagaatggaatttcctatgtagttaataagcagtgttaagttgtggacaggaatggaaatagtgtcatatgggggaaacagtaagtggaccagtttgttagagaacaagaattcatattaaaaagtagttgtaggccaggcacggtggttcctgcctataatcccagcactttgggatgccgaggcgggtggatcacgaggtcaggagatcaagaccatcctggctaacacgatgaaaccccatctctactaaagatacaaaaaattagccgggaatggtggcacgtgcctgtaatcccagctactcaggaggctgaggcaggagaatggcatgaacccgggaggcggagcttgcagtgagccgagatcgcgccactgcactccagcctgggagacagagcgagactccatctcaaaaaaaaaaaaaaaaagtagttgtagaaaatgttaaaatatactagggtcagatcatgaagtgctttaatgcaagtaggcagtaagaaccactggttttttaataggggaatgagaatatgtggaaaggaatatttttcaagagagtgttctgctggcagtgtggaaaatgttttggaggcacggagagcaactagaaagttcttgccttaacccaaatgtgacaatgagggaataacatagggtattgctagcatcgtattaataaaaagatgcaagagagataagacttggtagctgtactagatttaggggaaaaggaatagcttaaggatgactctcagtcacttagacttaaaacccatgatccattcctttgacagaaataagatagtgaccttaattctagctattctccagtgatcttgaaaggatttatttcaattagctttgatacataaaataaaaaattcatcattcacttttctgatgaagctggaaaattaatctaaataatgtaaaatataaatcactactttaattacatacctatgtgtcttctaaaaataaatcctacatctgtctgagttatgaagaatatgtattaagggtaaatcaaacaagtatacattctttacagaaatattgattaaattgactcttcctgattagtgatttaaattgacatgatttattccattcatgcaaagattctgtgccctctggggggtctgtctggaatagcaaagcagctcactgacagcagtgactggaatattgccaagctagtcccagagctcagcctactttgtttagaaattaagcaaatggaaagtttcctgaggttctcttacaatgcaagaatgtatggggtttcatttgtgaaccaacagggagttaaaaagcaggaagtcaattatatattaagtctcacattgttctgtaattgttttcatcaattatatttttagttgtatatttttggccaattcgcttgtgtcaattacatatacttccttatattgttgtcaaattgtttcatgtgcatcagtcatagcattcctatgtaaactggaaattccccagggatagggaccatgattctcttttgtttcccccaggaaatagcaagagacctggcacatgttttgagtgttgaactagaataaggtatttcagaatacttaagtctaggtctgtagtactattgtggatcccctaaaacactttagattccacaatagcactgtgaatgttgacttaaagcagtagcatgactttatattccttatagagttgtttccagggacactgttaatgtatacagtcattcaggatacaaactagaaagtagaaacatacacttatctttaaaatgagaggatctaactgattcatggcctgttcttggcttttccacttgtgtctaccaattaaactctttggactcaagagtttttctacctgcaaaatgggatagtaattcctacctcggcaacttgttgtgatgattaaatacaatatcatgtcaatatcctggcagtaccagttccttggagtgagaacaggtaacctgttgtccattttcttggaatgtgctacagggatgacaatgaatctttctgcaaatctattcagaaattctggttctgaggagtagtatccatgactgatatgataatactaaagttctgtcaagctctaaaattctgtgattataattttcattatcccttttcatgtgtattatatattgccatttagagtaaacaaaatgttttcccaaccccttatctcatttgaccctcacaactgaaagaaatgcatgaaaagctttagcttattcattgagtccttaatatatactacatgagtacatgtgttcaataaaaccactgagtattggtgatactggtaatacatcattgatacatacagatgaaaatttctgctttcatggaattcacatactggtggattgaaatctgagtgaagaaacctggattctagttctgttgtagctactagctcactagttgtgagagaaaatgtgtatatgggtattcatgtgtgcacatgctcttacctagatgctttcacaggatgcttattgtcttgaagagaacactggtttcaactttacccattgtcagagtttacaaaacacatttttaaaatgcgtacaattgcactgggctctgtttggtggcaactgtgggcagctcttggaaaagcttcttttctaaaggaaggacctggggacaattatttacccttttttatagcatgttttttttcttaatttccttttcttttattgaatattggatataggtatatcttttttgtgtgtagcatgttattttatatatctgccttatgttttgtttttgttttatttaaatgttggacttaatgcagagtaatgtggaggctctaaattgtttgcttccttttgtttaattaaggctatgccatctacttattccacctccttaaagaatctcaattaactaaaatatttcttttccaagtgttttctcacctctcttctttaacctcacatcatccctaggaattttgtgcctgttattatgatttctgtttgacagagaagaaactaaggtataaagaaagtaaacagctaggccagtattctctgggataaaaagcagtcaatgttactcttagacttgtgctttttttcactacagcaggttttccaagttcagcaccaatcacattaggagaaaaggctgcagttgcactgatcttggaatcaaaagatttggtctgtgcccctggttctgcctctcttatgaccttggacaagcatttaaggtctctgagatcctacaaaattgggtaaatgccagcttttcttgaaactgtctctcaaacttttctactcttcagatatctttctctaatatcatcttctttcctctgattttcttgtacttagcttttctttcttctatttttcttcctgagactttctctgtctgttgcagccctgactatcttttctggcctgcccctcctcctattggtatcatgttatcctatgtaatatttatctgatcagtttcttgcattatctttggatgaagagaaagtaagcctcatttggcatctttataaaggatacagtaccttaattgattacttgtcagaaagaatataaaatattaaacacgatgaagattaaagattccaaataagttggtaaaaatctattttactttaaggaactaacaaagaagtttatttaaataaatttttttaatgaagaggccatcaagctagggaaactatgtgttaatttggtgttgggagagatatatgtatatgtgtgtatagtttcaattaagtttggatagtgtttgtatatgatatataaattgtgtgtaccaaatgagttattgctagtgattaacagtgaataaaataacttctaagatgtgttagttactatttactgaggctgaatgctagaaatactgatagcatgaaactctatttcctaattattctcagagtccaattctgccttctgtctaatcttcactaaatcacagcagcatatttttcagcaaattgtgaaactcaggtaacctggttagaggagaaaagattaattgaatcacataaatattctctttgaagctagacttttcttcctcttatgttcagatgggaataaatcatatccacccaccccaccttacttagagagttttctccatgcctggaaggcaagggcaaagaacacagagatttcctgtctacagtcacttaggagtttagcatcctgggacactgtgaggaacaagggaatcttgttactgtgctgtagggagcccagaaagggggaacctagttttatgatgcaactggtttcctccccaagtttagggcatgtaggttcaaagaatgtaatagcctacaggctcagaaagatggctaggtaaatccagcttgtttagaagaatgattgacttttgcccacagcaggtaaactcagtctcgttcctgactgctagtctcttcagtctagactgtgtgacagttgctactagctaaggaatagagctacaagtgaatattttaagctgataaaggatttgggtttgtctgtaagattacgctaaatatgtgaattgtggttttaatgttagacataagagaataccatcaacaatgagaccttgaaatgcagacttcaactttacttcaagtgggacgttttcttatgttcttatgggaaggagccagtcccacgtcacatagcctacagatggaatgcggaaggaaagggaaaatggaaggggaagtcatatttggagatgagattggaaggtagacaatgtaagccttatcttagaagacctttattgccaggctgaggggatctaaacttcattgtatatacaaacaattggagaaagccttgtgatctggactgaaaaggtgtagaataatgcagctttagggtttaaacaagcctggctttgaagtcctctttctgatacttactatgggctcttagctatgttgccccttctttcaaatgcctcacttttctctcttgtagaatatggatagtagtaatttcccttgcatagctgttaatactaaatattgtaaatattaagtgagataatatatataaagtccagtgcctagcgttgtaggtactcagtgaatagtagctattatgagtaatccttggacctcattacagccctttgattccagtttggtaattgagctttagaagaaacaaatgaggttgctctctgtttagtcgttaagtcactttcaatttgtacagcagttggtaaccttcattcatattattccatttgatctttagaatgattcttcgaagttgttaagatcattgtacacaagaaaaacctgaggcccgtacaggaaatggattacttaaggtgacgtaacaatgtcagagctaggactagaacccagacagatttcctttttttttttttttgtagagggagggttttgccatgttgctcaggctggtccctcactccctgactcctaacctcaagcagtccacccgcctcggcctcccaaagagctgggattacaagcgtgagccacctcacccggcctagaacccaggtttcttaatgcttttactcccaattcagtgctcttactcttaactggagtttaggtaactttgacttttacttttttctgtcaaacctatggtagaccacattgtgtagcttttaaagttaaagctacttgaatgacaaaagattaggctacacagtaatttacataccaatgttgtatgttacttatggtaaatccactagaaagcccccatccctacatctccctatgttttatccttgaagtctagcatttattaaaacttaaatataaataaaaaggcttcttactcctgagataagctttctgcagttgtaatttgctaaaaaaatattctaattacaaaggattgcaactttcaagtagtacaaggatgattccatttataatttgcaatcattaatcttactctgtctagagaagaaaacacgtggaagtttccttttttcaagaataccaaagccatattaatatattttgtttcttcctcttggtagatcttgctctcatagaactattttgtaatcctatttaaaacccagttgtactaataacggtcctttgagtttcccgggttccactgtttattactcagctcttatttctgctcctttgcatgcagtaaaccaaacaccctcattattcagccaaataatgagtatctactgtgtgctaaacatcacacaagatgcaagtatgattgatactggactgtgttgaaacccaagtactctgggtatgggtgttggcaggggctgcagaagcagtttgtatcatagtaaactagaaagagcaatggatttggcatcaggaaacacgaattcaacctctagcatgtcatatgactcagtttcttcatctattaagtgaggctactaaactaaagtctttgcttagcaatttttgggccaacattggcccaaaattcttggttgggtgcatcaaaacttttaagctaaacattgtagttctgaaggtgaccagttcctctgcaggttttgtaaatgaataaagaaacacaatgcaaagacagttctctaatttgtctagggatttcatgttcagatttcctatgagtgcaggatcagccaggctccatgcttgacagattgcagctcatattccctaaagtagacagttgcctttgccttcatctgggcacaagacatggttctacaattttaattgcattatgacttttactttttatttttattcctaatggaaataatggtctgggtgtgacaagggaatgttaagacttatttttttttaagcagtgttttagtctgtgctgctataacagaataccagactgggtaattgagtaggaaaagaaattcatttctcacacttctggaggctgggaagtccaagatcaaggtgctgctctctggtgaggcccttcttactgtgtcttcacatggcagaagatcagaaaagagcagacccactcctgcaagctctttttataacagcactaatccattcatgagagcaaagcctagagccccaatgaccaaaacaccttttattaggccccacttcccaacactgttgcattggagattcagtttccaacacatgcattttggaaggaacaaaagcattgaaatcatagcatgcaaaaaccgcttccctcctccagccgttaaagctcctttccattccattttaagttgaagggatcatctttatttagaggtgagatagctttggaatgttatcagtaaaagctaatagagcctatatatgttaaagaaattgaatcaacaattaaccttccaaaacagaaagcaccaggcccagactggatcaccagtgaattctaccaaacttttaacgaagaagttataccagttctctgtaatcgcttccagaaagttgaggtagatggaatacttcctaacttattttataagaccagcattacactaataccaaagccagacaaagacattacaagaaaggaaaactacataccaatatctctcattaatacagatgtagaaatcctcagtaaaagattatcaaattaagtctaacaatgtacaaaaagaattatacctcacaccaagtagatttttttttgagacagagtctcactcactttgtcacccaggctggagtgcagtggtgcaatcttggctcactgcagcctctgactcctgggttcaagggatcctcctgcctcagcctcccaagtagctgagattacagtcttatgccaccacacctggctaatttttgaatttttagtagagacagggttgtaccattttggccaggctggtctcgaactcctgacctcaagtgatctgcccaccttggcctcccaaggtgctgggattacaggtatgagccactgcacccagccccaagtagaatttattctaggtttacaaggctggttcaacatttgaaatacaattaatgtaatccatcatattaacagaaaaaaatcataagattatatcaatagatgcagaaaaagcatttgacagaattcaacacctattcataataaaagctcctagcaatctaagaatggaggggaacttcttcaatttgataaaggacatttagaaaaaaacctacagctaaaagtatactgaatggtgagaaactacatgctttccctctaagactgagaacgagacaaggctattcactcctaccactcctattcaatattgtactggaagttctagctaattcagtaagacaaggaaaagaatgtcagcatggtggctcacgcctgtattcccagcactttgggaagccaaggtggaagaatcacttgaggccaggagttcaagaccagcctggccaacatggtgaaaccccatctctactaaaaatacaaaaattagctgggtgtggtggcacgtgtctgtaatcccagctacttgtgaggccgaggcaggagaatcgcttgaacctgggagatggaggttgcagtgagccaagatggcgccactgcactccagcccaggcgacaaagcaagactccatgtcaaaaaaaaaaaggctgagcactgtagcatatgcctatagtcccagctactcaagaggctgaggcaggagtattgcttcagtccaggagtttttggtatgatcacactactgcactccagcttagatgacagagtgagaccctcaaaaccaaaacaaaagaaaaacaataccatttacattagcatccaaaaaaggaaatacttaggtataaatctaacaaaatatgtacaaaatctatatgagggaaactacaaaactctgatgaaaaaaatcaaaggagatctaaataaatggagatatttcacgtacatggataaaaagactcgatgttgtcaagatgtcacttcttcccaacttagtctttagattccacacaatccaaataaaaatcccagtaagttattttgtggatatcaacaaagtaattctaaagcttatatgggcaggtaaaagatagaatatccaacataatgttgaagaggaaaaacaaaattggagggctgacactatgcaattataagacttactataaagctacagtaatcaaaacgttgtggaattggcaacagacaaatagataatggaacagaatagatacacaaatacagtcaactgatcttccagaaagctgcaaaggcaatgcaataaggaaaagatagacttttcaacaaatagtttctgggacaattggacaaccatatacaaataaatgaatcgagacacagaccttacacctttcacaaaaattaacataaaaagtatcatagacctaaatataaaattaaaactattaacctactagaagaaaacataggagaaaatctacgtgatcttgggcttggtgatgacttttatttttaaaaatagattttatttttttgattagtttttgatttacaaaacaaaataagcaggcagcacagagtttctatataccctgcacctggtttcccttatagtatgatacatttgttacaattaaggaaccaatattgaaacattattattaattaatagctatagagtagtcagatttcctgaattttttataatttcaacttttatttcagattcatagggtacatgtgcaagtttgttacatgggtatgttgcatgatgctgaggtttgggatacacttgtctcatcacccaggtactgagcatagtacccaatagttagtttttcaatccttgccccactccctccgtcccacctcttatagtccccagtgtctattgttgccaggtaataactttttagataaaacatcaaaggcgtgatccatgaaagaaaaaaaacggtaagttgaacttcatttgagtttaaaacttctgctctgagaaaaacactgttaagagaataaaataacaaaccacagagtgggaaaaaatatttgcaaatcacgtatctgataaaggactggtatccaaaaaatatatagaactgttaaagctcaacaataagaaaacacacagcccaatgaaaaatgggcaaaaaaaaaatgaatagccaaagcaatcctaagcaaaaagagcaaagccagaggcatcgccttacccaacttcaaactatactacaaggctacagtaaccaaaatagcatggtactgataaagaaaacaacaacaacaaaaacagacacattgaccaatggatcagaatagagagccaagaaatgaagccaaacacctgtaatctctgatctttgacaaagttgacaaaaataagcaaaggagaaaagactccctattcaataaatggtgcttggaaaactggccacatgcagaagaatgaaactggacccctacttattaccacatacaaaaattaactcaagatctcaaactacaaaaatcatagaagaaaacctaggaaaaacccatgtcaacatgagcactggcaaagaatttatggctaagacctcaaaagcaattgtaacaaaaacaaaaatttacaagtgggacctcattaaactaaagagcttctgcacagcaaaagaagctatcaacagagtaaacaggcagcctacagaatgggtgaaaatatttgcatactatgcatctcacaaaggtctaattcagaatctataaggaacttaaatcaacacgcaaaaagcaaataacccattaaaaagtgggcaagggaggggtggagcaagatagccaaatagaaggctttaccaatcattccccaccacaaggacaccaatttaacaattatgtacacacacacacaaagcaccttcataagaaccaaaaatccggcgagcactcacagtacatggttttaacttcatattggtgaaagaggcactgaaaagggcaggaaatacagtcttgaattgcagatatgacccctcctctatgtcctggcagcagccatggggcatgaagaatctggggtttgaaagagggagagcacagcgattgtgagacattgcattgaactcagtgcttccccatcacagcagaaagcaaaaccaggctgaattcagctgattcccacccacagagggagtatttaaattaatcctagtgagaggggaatcgcacatctagtggttggaacttgagttccagcaagcctctgcaacacaggctaaaatgctctggggctctaaataaacttgaaaggcagcctaggtcacaaggactgcaacacctaggcgaatccttgtgcagaactgggcgcagagccagtggactgggcagtactgagacaccagctggggtggttaaggaactgcttgcaacaccccaccctcaaccccagactgcgcagcttgtggctacaaaagagacccattccgtccacttgaagagaggagagggaagagtgggaaggactttgtctagcatcttggataccacctgagccatagcaggataaggcagcaggcagagtcatgaggcacctggatgacattttgaaacacaacctgggccaaaaggaaacctgctgccttcaagggaaggacacaatgctggcatgacccatcacctgctcaggaaagagcccttggaccttgaataaccagcagctgtacccaggtactatgccattggccttggatgagactctgagactagctggcttcaggtaagactcagtacattcccagctctggtggctatgggaagagacttcttttacttgagaaaagtggaaggaaaagtaatgcagactttgtcttgcaccttaggtgaggcttgcaaatactatcttttaacccattattttaagctgataacaagttaacactgcataaacaaacaaatgagcaaaaagaaaaccaataaaaactctattccttaacttcatctcccgagtttttaactttttgttcttttatatcttattgtactatctatatcttcaaaagttgttgtagttattattttttgatttgctcattgttagtcttctacttaatagtaatttacacaccacaattacagttctataatatcctgtctttttctgtatacttactattatcagtgagttttataccttcagatgatttattcttgctcattaacacccttttctttctgattgaagtactccctttagcatttcttgtaggagaaatctggtgttgatgaaattcctcagcttttgtttgtctggaaagtctttatttctccttcgtgcttgaaggatattttcaccagatatactactctagggtaaaagtgtgtgtgttttttttttccttcagcactttaaatatgtcatgccactctctcctgacctgtaaggtttccactgaaaagtctgctgccacactatttgagctgcattgtatattgtttgtttcttttctgtttctgcttttaggaccctttctttatcattgacctttcacagtttgtattatttatttatttatttatttatttatttttttgagacagagtctcgctctgttgcccaggctggagtgcagtggcgcaatctctgctcactgcaagctccgcctcctgggttcacgtcgttctcctgcctcaccctcccaagtagctgggactacaggcgcctgccaccacgcctggctacttatttatttatttatttatttttgtatttttagaacagacagggtttcaccgtgttagccaggatggtctcgatctcctaacctcatgatctgcccgcctcagcctcccaaagtgctgggattacaggcgtgagcccggcccacagtttgattattaaatgccttgaggtagtctttgggtcaaatatgcttggtcttctataaccttttgcacttaaatgttgatacatttctccaggtttggggagttctcgttattttccctttgagtaagctttctacctttatctctgtctcttcctcctctttaaggccagtaattcatatttttcctttcgaggctattttctagatcttgtaagtgtgcttaattgtttttcattcttttttcttttgtctcctctgactgtgtattttcaaatagcctgtcttcgagctcacaaattcttccttctgcttgatcaattctgctgtgaaagagtctgatgccttcttcagtatgccggttccatttttcagctccagaatttctactttattctttttaattattttaatatctctgctaaatgtatctgatagaattctaaatttcttctctgtttgcttgaatttatttgcatttcctcaaaacagctattttgaattctctgtgtgaaacgtcacatatctctgttgctccagcattggtccccggtgccttatttagttcatttggtgtggttatgttttcctggatggtcttgatatttgtagatgttcatctgtgaacattgaagagttgtatatttattgtagtcttcgcagtctgggtttgtttgtacctgtccttcttggaaaggctttcgagatattcaaaaggacttaggtgttgtcacctaagctctatctactttaggagacaccccaagcccaataattctgcggcttttgcagactcttagaggtaccgccttggtgatcttgaataagaatctgaaagaattctctggattaccaagcagaaactcttgttctcttcccttactttctcccaaacaaacagacactctctctctgttctgagccacctggagctgggggtagactgacacaagcaccccgcgtgaccaccaccactaggactgtgctgggtcagatctgaagccagcacaacactgggtcttacacaaggcctgctgtaaccactccctggataccacctatgttcagagtacctgggactccacaatcaatatgtggcaaaagcacccaggcctgtgtcctacccttcagggtggcgagctccccacaggacccaggcaggtccagaggtgctgtacaggtgccagggactagagtccaaaaccttagaagtctacctggtgttctgttgttgcagctgagctggcactcaaatcacaagatacagttcttcccactcttccctcccatttccacaggcagaggagcctcaccccatggccaccacaaccacaggcccacagggagtactgccagactagcaccaatgttcccttaggcccaagggctcttcagtcagcttgtggtgaatactacctggtttcagactctcctttcagggcagtgggctctgctctggcccagtgcaggtccagaaatgtcatccaagagccagagcctgtaattggggaccctgatagttggcttgatgctctatgcccctgtgggcaagatggtatctgaggtgcaagacaaagtccccttcacttttccctttgcttttctcaggcaggagtcttgccctgcagccaccaaagctgggaatgtgatgagtctctcctgaagccagcaagtctcagagacccatcaagaccttcagtgtagtaccagggtaactcaagggctcttcagttagcagctgatgaatgtcaccaggactgggttcttcctttcaaggcagcattttcccttctggccttctagacatctggtggatgtctagaaatgtcatccaccatcttgctctgacccctccttggtgtggccattttggaaggcagtttgacagtttcttacaaagcttatcatattcttaccatatgatccagtaatcatgctacttgtatttatccaaatgagtggaaaacttgcatccacaaaaaacctgcacgagtgtttatagtagcattattcataattgctcaaacttctaagcaaccgtgatgtcttctaataggtgaattgataaatacactgttatatccatgcaatgaaatattattcagcactgaaaagaaatgagctatcaagccacaaaaagacatggagaaacttgaaatgcatattgctacatgaaagaagccaatctgaaaggctacataatgtatgattccgactatacgacattctggaaaaggcaaaactatggcgacaaaaaaaaattcagtggttaccaggtgttttgggggaagagagagagggatgagtaggtggagcacagagcatttttagggcagtgtaactattctgtatgatgctgtaatagtggatacatatcattatacattcctcaaaacccatagaatattcaacacaaagagtgagtcttaatataaactatagactttagttaacagtctatcaacattagtttggggtgggggaaaagaaaaaaattgctaaataaataaaatttagtaataacttcactaaataaattctattgtatggcctatctatacaatagaatatatttttaattttaattttttaaaaatagaatattttgcagctattaaaaaaggatgatacattatggaaagacaaaactatagggacagaaaacaggttagttgttacttaagaactaggggagggattgactacaaaggggtagcttgagggaatttttgggatcacggaactgttctgaattgtgattgtggagtgattatcccactgcatgtgtctgtaaaaactcatagaactgtacaatgaaaaattatttttactatgcgtaatttttaaagtaaataaaaataggatggggaattttaaaaagctttttataaaaaaaaaagctagtagtagccttccaattgtgaaagttctcacagcacgcaagggcattattttcagttaacaaatgtttcacttagactcagattactcaggatagaagggtccttcaagatcactaaagcccctacatgcaccctcactttacagagggagaaacaggcccagaaagaagggagtttcccaaggttacatgcaaattagtggatactttgtgtagtttcagtcttttgacatttattgagaattattttgtggcctaacatatatggcttgtcttggagtatgtgtattctgctgctgttgggtctggtgttctttgtatgtctgttaggtcttattggtgtttaggctttctattttctcattgatcttgtatttagttgttctgtctatcattaaaagtggggttttgaagtctccagctattattatagaaatgcctatttctcccttcaatactatgagtttttgcttcttatattttgggcctctcttgttaggtacttaacaagagaggtgtttataattattatgtcttcttgatgaattgactcttttatcaatgtataatgttcctggatgggcacagtggctcatgcctgtaatcccagcactttgggaggctgaggcaggagtatcccttgagcccaggaggtcgaggttgcagtgagccgtgatcgtgccggtgcactccagcctggacaacagagcaagaccctgtctccaaaaagaaaaatgttctgttacttgttttgagagttcattattgttcattatttgagctagatccctcaatttgaggaagtatgtatttgtttgtgtatatgtgcatgcatgcatgtgctgctgaccagtgtggtaaatagcgtggggctactctacttggtctttaattccatggaaaatgagaaacttttttttaatttttaatttgatgtatgtatgtatgcatgtatttctttatttattttgctggcagctctaaaaccagcacaaattgggatcataagctccctattctaataagatcttgtagttgagaatgagtcaggggactcactgtgaaggagaccaggtctttattgaggcctttgtgaaaatctctgctacacacagataacaattgaaatccaatttacttcacactcaacaggaagtcttagttttattgactcaacaactagtcaataaaattaaaaagcattagtggccaggtgtgatggctcatgcctgtaattccagcactttgggaggctgaggtgggaggatcacttgaggccaggggttcaagaccagcctaggcaacatggcaagaccccctccctacaaaaataaaaaataaagcagtaccaatttgagaattttcttcattgttcccttgtttcactgtcatcttttttttttttttactttattcctttttctttctctggtttttctccaactgttctattttccctgttttctttacatctttccttttttcttctctacttccccttctctttaccctttcctcccatgtatctttctctctgatttctccttttctgtattattctctttaccctgtgactgttgcattactggacactggcagtgagactaaatattttaagttagcatcaatagggatatgttaatagaagacataactataattttgtttctttgtgggagaaatatacacattaaaataaaaggcctatactctattgccatctaattggagcttctgtgctggcagaaaatgcactggaaaaaaagtaaaccaaaattacttgataagaaaagcatagtagctaggcccaaatgtccaccttgctctttattagaattatctaaatacaaagatgaaagcaagactcttctccaagaaacaatctctgcaaaaagcccctttggcatcaaagctatgaactttacgggaaagccagagtttctcaggttgtgtgccatatggatagtttggcctattataagttttgattgagagaagaatgcaatataaaagcagctattgggtttaagcacagctaagtgtggtggttgcagtgatagtcttgagtgcctttctgagttaggcactcttttattattttgttttggttttttgttttggtttggtttttggtgtttttgagacaggatttcaaaccatgatggtttgctgaatagatcaacctgtcacctagttattaaagccagcatccattagctattcttcctgatgctctcactccctcaagaatggcattttgaaggtacttgggtttactggcaatgtgtccttgcttagccagtgtggctggatggccagggcttgacaagaagtaacatttcttggccatagaaattcaagtttttgttcactttctgttcttcttaaaccccacctttagattggctttcacgttgccctcatttcccggagaacactgaatacttcccaggaaaagaggcttatgccatgcacagttccatccttcttcttactgaacccatctctctgggattgctggtgattggaattcacatggaacattctacgttgagcttggtaaagcagctggttttgttaagaaagcccaaggaaagctttggcctctgttcccacctcccacacagtcaaaaagaagcccagtctaggtagagctgaaagggcatttgaacaccatctagttccactcctcatggtacagatggaaaattcaagcctgaagttgaaaaaaggaacttgcttaaggtcacacagttagataatggttaccttctgacttcagaagactgttctcctccctaattgtatgttaaggaagaatctgacagacatctgtttaaactattaactctgtgtgtgtgtgtgaacatggtttaatttttaaactttatttgagatgacttttgtacttacagaaaagttgcaaagctagtacaaagagttccaatataccgtttgcccagtttcccctaatgttatcatctgtacattactatggtacatttataaaaactaagaaatcaacactggtatattactattaactaaactccagacttcattcagatttcaccagtttttccattaattatcatttttctaaaatatcaggatccaatccaagataatacattgcatttaatcatcatgtgtccttagtcttctctggtctgtggcagtttctctgcttttccataacgttaagatttttaagagtactggtcaggtattttgcagaatgtccttcaatttgtggtagtttgatgtttttcttatgattgcactggggttatagattttggagaagaatctcacagaggtaaagttccattttcattacattatttcaaggcgcacataatagcctttaacaagacatcactactaattatcacatttaactttggtcatttggttaaggttgtgtttgccatgtttttgcagtgtaaagcaactactttttcctttttcattctctattctttggaagtaagtccagcccacacccaagctctacctccttgaaaggggagtatctacatacattatttagaattcttctgttaggacgatatgtcttttctccaccatttatgcatttatttgatcatttatttatgctgtatatgtgggctaatatttatttattttatactttgggctttaatccgatactaccttatctattttgttactcaaatgctcctgctttagccattaggaattatttcaggttggttcctgcgtccctttaaacacatgccctcttccttttatctttttagtacttgctaattttctggtactacaagatactccaggctcatcttgtgttttccctgacctagccctagaatgaaccatttatccaaataactctggttccttttattggaaaatgttatttagaaaccaagatctaggagtggtcatttttaccaagctatcattgcttccagactttctcagtggacataactgggtaatatatgtttgtttatgtactaacctttgtatacatatatatctataatcatttgtgtgtctatccattgtgtgtgtgtgtgtatatatatataatatatataatatatatgtatatatataatatatataatatatatgtgtatatatatatatattatatatgtatatatatataatatatatgtatatatataatatatatgtatatatataatatatataatatatatgtatatatataatatatatattatatataaatatatatataatatatataaagctaaacatgagtttatattgatgtctctaactctaatccaatactacagggttcattctagccttcctttctttttatctgtaacttccccctataacaatgacaaacttagcttccactacccaccatccatttacttacttgttcaaacccagtacattcaaaccagtctcacaattgttcatctataccaccatgacaacagctttatcaactacagtacagtgtttatgtatggttatttgtcttttatctttatactttctagctaaaacacaatttttcaaagttaaatcagcttcgtacccccttcctcagtgcacttatgtcacacatttgtaatacagttagattcatttgtcacagtctgcatttcatcctgggatcctctgacatctggttgatgtttgcatttgcatatgttaaggctcattctttgtaaattacaggtctataggttttgacaaatgcataatgtcatgtgctcaccaccccaataccatacagaagagttccatcactctcaaaattcctctgtgaatcccctctgttatcaaccagttcccccacccctaatattcagaaactactgataagtatcccatccctatagttttatattttccagagtgtcatatgaatggaataatacaatatgtagtctttgggtatggcttctgtctcctagcaaaatgcatttaagactcattcatgttgtgtgaatcaatagctccttttatgtaagtagttccttttaaacactgaatagtattccattgtaagaatacttgtttatccattctcttgttgaaagacatcttgattgtttttagctttgagaaattaggaataaagttgctagagacatccacaagcaggtttttgtgtggatgtaaattttcaattcacttgggtaaatacctagaagtgtatttgctgtatcatatggtaggtctaacttttaacacaattcctttccaagaagtctgggttgagtatgtatgtatggtgcagtagaatatctgttcctgagctggactgaaatagtgatcactctcacaccatattccatgtggacggaaaatagaatatcaatgggatgggaggagccaagatggccgaataggaacagctccagtctacagctcccagcgtgagcaacacagaagacggtgatttctgcatttccatctgaggtaccaggttcatctcactagggagtgccagacagtgggcgtaggtcagtgggtgcgcgcactgtgcatgagccaaagcagggcgaggcattgcctcacttgggaagcgcaaggggtcagggagttccctttccgagtcaaagaaaggggtgacggacggcacctggaaaatcgggccactcccacccgaatatggcgcttttccgacgggcttaaaaaaaggcgcaccacgagattatatcccgcacctggcttggagggtcctatgcccacagagtctcgctgattgctagcacagcagtccgagatcaaactgcaaggcagcagcgaggctgggggaggggcgctcgccattgcccaggcttgataaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacacggcagggtattccaacagacctgcagctgagggtactgtctgttagaaggaaaactaataaacagaaaggacatccaaaccaaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacgaaacaaagctgggtggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaataagcaaagcctccaagaaatatgggactatgtgaaaagaccaaatctacgtctgattggtgtacctgaaagtgacggggagaatggaaccaagttggaaaacactctgcaggatattctccaggagaacttccccaatctagcaaggcagtccaaccttcagattcaggaaatacagagaacaccccagagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacatgcttaaagaaaagaattttcaacccagaatttcatatccagccaaactaagcttcataagtgaaggagaaattaaatactttacagacaagcaaatgctgagagattttgtcaccaccaggcctgccctaaaagagctcctgaaggaagcactaaacatggaaaggaacaaccggaaccagccgctgcaaaatcatgccaaaatgtaaagaccatcaagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtactgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctgtgcaccaagcagacctaatagacatctacagaactctccaccccaaatcaacagaatatacatttttttcagcaccacgccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactgcatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagggggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaacaacccttcaaaaaaatcagtgaatccaggagctggttttttgaaaggatcaacaaaattgatagaccgctatcaagactaataaagaaaaaaagaagaatctaatagacgcaataaaaaatgataaaggggatatcaccactgatcccacagaaatacaaactaccatcagagaatactaaaaacacctctatgcaaataaactagaaaatctagaagaaatggataaattcctcgtcacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggattagctggtaccattccttctgaaactattccaatcaatagaaaaagagggaatcctccctaactcattttatgaggccagcatcattctgataccaaagccaggcagagacacaacaaaaaaagagaattttagaccactatccttgatgaacattgatgcaaaaatcctcaataaaatactggcaaaccgaatccagcagcacatcaaaaagcttatccagcatgatcaagtgggcttcatccctgggatgcaaggctggttcaatatacacaaatcaataaatgtaatccagcacataaacagagccaaagacaaaaaccacatgattatctcaatagatgcagaaaaagcctttgacaaaattcaacaaccattcacgctaaaaactctcaataaattaggtattgatgggacgtatttcaaaataataagagctatctatgacaaacccacagccaatatcatactgaatgggcaaaaactggaagcattccctttgaaaactggcacaagacagggatgccgtctctcaccactcctattcaacatagtgttggaagttctggccagggcaattaggcaggagaaggagataaagggtattcaattaggaaaagaggaactcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcaggagtgaactcccattcgcaattgcttcaaagagaataaaatacctaggaatccaacttacaagggatgtgaaggacctcttcaaggagaactacaaactactgctcaatgaaataaaagaggatacaaacaaatggaagaacattccatgctcatgggtaggaagaatcagtattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactgtactacaaggctacagtaaccaaaacatcatggtactgttaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagagttaaacgttagacctaaaaccataaaaaccctagaagaaaacctaggcattaccattcaggacacaggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcatcatcactggccatcagagaaatgtaaatcaaaaccacaatgagataccatctcacaccagttagaatggcaatcattaaaaagtcaggaaacaacaggtgctggagaggatgtggagaaataggaacagttttatactgttggtgggactgtaaactagttcaaccattgtggaagtcagtgtggcaattcctcagggatctagaactggaaataccatttgacccagccatcccattactggatatatacccaaaggactataaatcatgctgctataaagacacatgcacacatatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagaacacatggacacaggaaggggaatatcacactggggactgtggtggggtggggggagggggagggatagcattgggagatatacctaatgctagatgatgagttagtgggtgcagtgcaccagcatggcatatgtatacatatgtaactaacctgcacaatgtgcacatgtaccctaaaacttaaaagtataataaaaaataaaaataaataaataaataaataaataaaagaatatcaatgggatgtcttcttctcctacctggaagatgaagtttctgcaaatgaccattagatggcggggtacttgctggcactctgagctggaagtctgggagattgtgggagactgaaaattatatcactctacccccttcccttttcttggcaaagggatattctagccacactcaggaaataaaatacctgatttatgactcctggcatgtacctttatactgcttcaggaagttaggcttgggtttcatgttggcaagtatcccaacagctaaatttgtgtaatggtaaactttaggttagataatgagttttgacctgaaatggggtaagcaacatcatgtcatgtttgtgccccttgctgacctcattgcaaagtaaaggaagcatagaaccttgattcctgggttctaatgccagccatctattgtcccaactctcttggcctcatattcatcatctttaaaataaggataatacctgcccattcatgctcacagggctgttgtcagagatcaacctaagatacataatgtgaaatatattgaaggactttataagtttaacatcatacaaatatgaatgattattaatgatcaaaccaaatagaatatgaaatactattgatattaggtggcatcatacattaataaatctgacttaaaaatacaatctgtttaccttgatcaggagaggtagatatttagtctctgaagtgatgcagtattttcctcagaacttagtgggtgggtaatttattattatctacttgtttaatttttggtgtagcagttacagaaaatacttgattccagattgaacgattttatagggtaattcctcaccctcataaaatccacattatttcaatttaccaagtaaatactggcacattcagtagatgttactattttgggttccaactggtactcatgattgactctggtgctctggatccagatcctttggtatgtaccaggggacagcaaacctcagttatagaggtggctttacctttaccctagaaatcatctgcagttgctctggttcaaagcttaaaggaaggtttgaggagtgtactttcaaggtttgaggagtgtactctctcttcccagcagtgcagaaaccaataatcatcaaaacattgtcaccataactgttgtcaggtttttttcaaccttgcccttgcatctcagcacagctctctcgcccaaagaggtaagctggggaaaacagaatctactcattgtaatcttttcagcttatttatctgcatttagaaagtctcaaccctctgggctcccctgcctgtcagagtcaaaaagaaaggccccatgtgtatgtgtgggcctgtatgtaagaagtaaggcttgaaggcatccttggcatctgtcatgtgacacatgcaatggtttgtaatagagtcagggaatcataggatatgacctgaggtgggaggtccagtttctacccttcattttacaattggggaaactgaaacccagaccaaaaagtaacaactaattagctatgtaggtcttgctttattattactggtcacggagagtgcatcttaacagtagccaaagaaggtattgatcaagtagagaagggacactgtcattcccatagcttcaatcttttttttttttcttttttcttttgagatggaatctcgctctgtcgcccagactggagtacagtggcgtgatcttggctcaccacaacctccgcctcctgggttcacgccattctcctgcctcagcctcccgagtagctgggactacaggcacccaccaccacgcctggctaattttttttcttttttttttttttttttttgtatttttggtagagacagggtttcaccatgttagccaggatggtctcgatctcctgacctcgtgatctgcccgcctcagcctcccaaaatgctgggattacaggcgtgagccactgtgcccggcccatagcttcaatctttatttttctccagtggaaggggcttagcctaactgaaaacagttgatgtaatttagggcatgggagggactagtgataggggtgtgtgtgtgtgtgtgcacacacgcacatgcacatgtgctcacgtgtgtgtgtgtgtgtgtgtgtacaaccttgttttcagttatctacttctctttggcctctaaattctacatattttccccttctcctgtcagaatcatttagtcaatatgtgcctttttgagtttgtaagtggaggctaggttaaagagtgtccttagtttaggaatgtcatgtgctcatttggctaggtgtgtggtgattgtgtgtgggggaatgtgctggattcagaatagtaatagttgcttaaaactggaactttttaatgagggagaatggtctaccttttttcttgcagagctcagttttattaatgtgatatgctgtgtgctagtctgtgccagaaagtatctctgtaggtaattgatctgcctcttcttcctttctctttagatattcccttccatgtatgataaaaaccaatcttggtgtgtttatctcttttttaagcactttatcaagggttttttccagctcttgaaaagacaacttgtatacccaccctccacactacactgtacaaccaacccaacattctctgcatagacaatcagtcttcttttctgtgtgatataaatctatgaaaactcccacacattatagtacaactggacttgctgattccaaaccctgagcagaaaaaccctctaggaagccattgccaaggataagattgattgctacactggcaggtgcctgcccatttccctcgctcagtggaaaatctggcccaccatgacaaaaaatagctcatcccagggccttaaaacccaccgaatgagattttagtgttggggataaaagcaaggctgtagactaactcattcatttgctttagtgttctctataaaatataaaacatatatttcataaacaccaaatttcatgaaagcagatttatttcataagttttgtctattaccttatctaagcacagtctcttcctccaccattctcaggacatatggcttagtcagacagactacacagatgaatgcagagtgttgagtgacaaagccagccctttaggcgtttggagcacagcaaggttatgttggcaaggccaggtcagacaaggctataaactttgcctttcatctttaccctaataatgccactgaacaaacccaaccaggatctttctcaaatccatgtgtacagtttttatttgtcagagactaagcagaatgcctgggggaaggcatgcataatagaactaatcattctttaaagtgtaattttccttgcctatgcattcttgtagagtttcagtagagcccttgacaccctaagatagaagtgaactatgcaaagggggaatgagtggagataacttgaaaaaaaattttttttttagttttacatcctcctttttttcatatggactttagacataaacagttaatgtctgtcagagctaaaaggtacctctgataccattttatctaccccttaaccacaaaaaaagattatatagggagcagttcagtatagtagaaagaacatgggatttggaaagaactgaattctacttccagctcaagccatttgatctcagtttctttatatgtaaaatggaggtggtaatcctcataatgacattgtaaagcaatgtactggtggcccccaatactatccccaggttcactgatttgctagaaggactcacaggactcataaattgttacaatcaggctacagtttattatatcaaaaggacagaaagcagaatcaataatgggaaaacgtacatcagtcagagaccggaggataccaggtgcaagcttccaagagtcttctcccaatagagtcacacaggttgtgcttaatcctccaacaatgaagttcagaaacatatgcaaagtgttttctgccggggaagcgtacttgagcctgaaactccaggatttttattggggtaactagtgactgaaactccatatcccttggaaagaaagcatgcattcaccataaatcatattttttgcacaagatacctagacaggctgttacagcatggttgaaagggcatacacaatgcccttaccagttactagaatagagaacattctaagacctcagttcccaggagctggccaaggaccagtcacacaagtgggcccttctaaaaatgtatacgatttgagcaactcaagactgctgggttaactctttctttcacagataggtattaaattattgtatgtgtgtatatatatatatatataaaatattgcatatacatacacacagtataaagcagtacattaaatgtgagggattattatacatatgagtaaagagagctagagctattctggggtgtgattaagtgcagtaagaatggaagtatctaagacaactctccagggcaatgaatggggaagctgtaaacaatcccactgaggattttatttttctctatgattagagataatttcgtcaccactaccattctgtccctcatcagtttcacattgtactttcttatcatagctatatatttcttgggatttttgcataagccaaattgtttcactacgcactgtggagttttggcaaggatgtgatcctcttaaggaaagtgcagaattgagcctttgcagaaggcataggcaggtgcttcctagaaaaccctgagcaagtcccaatgaaagactatggttaattatactataatcgtggtaactaataccaacagtgaattttagtctgaattgaattgaagtgaatttatgtgaacctaaatactattgaaatacgattttgagctaaatactgcactagatgcccagcctagcccaatcattttataaaaatttgccctctaaggatgacggaaatgactatagaaaggaagctcaggcattgtatgctaggatgtggaggggaacatcctgaggaagtgcacatactcatacctaaaactactgaaagcatttgccaagggtagcctgtactgcctgaactcaggtggtaatggcaccaagtagactggagaacagcttgagaaagtgggcatatcttacagatggacaataaacctcctgatggaactttggtaatggagtatttgttaatagcattttagctgctgtaagcctctttgtctgctttatacccccagagctgctgtagctctccccaaactcatgaatggggcctaaggcagctgcctttattctgcatgtaagctagagctggctcatttgtctacctggtatgttcttttaccctttacgttggagccatgtcaatggttctcctcaaattgaccctctgctgccagactttattgagccctatctgagactttttctgagccctctgctccaggtggccctaaaaacttcatatacaatgtaatgtaggctctttaatgtgctagcagaaaatgacagagattaaatggtggccctgccatcaagggaactcattgcttcttttgaaataaagtatttggcaggttttgcctagaattgagggatggaatcactcctttccctaccttatcttttcttaaaacagctcctacatttcaccccatttaaaatactagcccttgcatttgtatcacattctatacttttctaacactttcttatttattattttattcttacatattttcattcatgctccgaggccaagctcagatgctattttctacagagagattaattttaacttcctctgacctcttaaggaactttccatgatgctctcgtggtttttaaccatttttcctatttttattctaattatttatatatatatcatttattagactctaagatcctcaatggcaagatctagataggattcatcaacaacttacatatagcaggcaagcaatgaataataaagatgaaatagaatagaaaacaaacaaatgcttgaagcttagataactgcctctcatttactctaattactggaaggcctagaacttgaatcttcttctagtcctgtactgctatcttaaattctccaccacactgcctcccttacccaggccagatagcatttactcttcagaaggaaggaaattagctaagtctctaataatcaggaaaggctttaaggaggaggtagaccttgacaaatgagtataatgttactaagtgaaatgcagagcgaagggtattccagaattagcagtgaaagcacataaagagggtgggaggaagaacatggtctgtagagtaatgaggccaagcctaagaaccagggcagcaagaattgtttggggcaagtcttgaaaaccatacagaaatgttggaatgtgttgtagcaggaagtaagggccccatacagaaggccttatatgaaggaagggtctgtagtagggaggacttagggctttctggtctactggctcttttggaagtttgaaatcatggcagggacctaagaccctgaacctcctgcctcttgatttggtcaactctgaatgtgaagtatattttattaagatattctaacttgctcactagcatttaatgttagttgccaaatttccaaacctgagctcaaagggaactctcttacaagtttgaaagcatttcagaactctttttcatggtaataaggattttgcctggcctagaagaagctgccaactccagaggtctctctggcactctaactcagagaagtttaaagtaaatgtagctcctgagagagagtatgagtccttaaaccaccaacccctcatccttttaaatctctgggtttatcctctgggaaacactgtcattcagctactgttttgttcaggtctctcaagttcttgcctaccatccagcccttcagatgtctgtgtcatctggttagttccctatattgtgaggacttaacaaattttcagtcagtcattcagtcagtcagttcctgtcttgtcctccagaatatcaaatattgaaaaaccactggcctcaactaaactgagctacaccacaccctggtaaaagggaaaatcttagtataaatttcacatacacctaaggctttcacatacatttcacatacacataaaccactggcctccactaaactgagctacaccacatcctggtaagagggaaaatcttagtataaatttcacatacacctaaggctttcacatacacataaatcactggcctccactaaactgaactacaccacaccctggtaagagggaaaatcttagtatacatttcacatacacctaaggctttcacatacatttcacatacacataaaccactggcctccacgaaactgagctacaccacaccctggtaagagggaaaatcttagtataaatttcacatacacctaaggctttcacatacacctaaggcttcacatacacctaaggaaacctaaggcttccctcttgttctttctccctcttctcctccttcacctctccctccactcttcctctgatctctctttttcaaacgttatggtttgttgttccataccaactgcacatttggcaatagacaaaaatacaaaactcctgccctcatcgatttatgccactaacctgattcagttctctctaaaggagatcgtagcaacctctctcaatattcatttccagctaacattctcttactatttctccggagagcagtgaaactttatcaaagtctactttgtaacgatgccaaaagctggcctctgaaagctaaaaggagaagagctagaatgtggtaagtgggagctgggccctagcaacagaactgtgggaggcagtgtggaataatggaaggaccataggtctgaagacctcattttggacttaacagttgcccaggctttctatattctcacacatttatgtacctttagggtaaggataatcactcatatttgtctcatctgacagtacctatcacacagctcatgttcaggtgagtccccagggcccccactgtgctgtactctcccttccctgcccaacttctctgcaccttggattcatgtcttgtttctaccacttcctagccttgaggctttggtaggtttcttaacttctctgactgagtttgtttcatcttccctagaagagataatacatgcttcatagctttgttgtacagatcaaataaaataacagatatgaaatattttatagcctataaggtgctgtgaaaattttaagatggggctaggcgcagtggctcatgcctgtaatcacagcactttgggaggccacagcgggccgattgcctgagctcaggagttagagaccagtctgggcaacatagcgaaaccccatctctagagaaaatacaaaaaaaaaaaaattagccaggcatggtggcacacgcctgtagtcccgggagggactgaggcaggaggattgcttgagcccaggaggtaaagcccagtgagccatattcatgccactgcactccagcctgggtgacagagccagaccccatctctaagaaaaaaaaaaaaaaacagtaagatggttttatcagattagtcaacaaatgtcaaaaggcacacaatttttattacatccatgaaccatgcctccaactagatcatgtggtatatagagttccaggcctatttatagacccacatttgcttaggttcagttcatctgaacactgattaaagttaacattaggaaagacaaaaacctaacctttatctgtgtttgatacaaagaccagtagcaattacatcacttgaatgtggttagattttattttcctttggtattttggtgaagttcccaaacgaatgcccaggaataattacagcagactggctttggcggaggaagtatataaaggcaattagtaaaatgtaacaaacttaaatgataattgaacctacattcccccagccatttccaagtataaactatataaatctgtgtcccagattcaccaaatgaaatatttttgagggaatcaagcagcaaggatctagtgatcccttattgcagcccagctatgtgtttaggggcagggtatggtggtagatgtaaaatcctaaaagcctgctttccaggagctcatattctggttgggtctacaaaacagaaaaattaagtcttttgttagaagaaatgaaacaatctaagacaaaatagcatcaggtgtcaaatagtgtggagcaaaaggcattcagaaaagtagaggtcaaggtgggctgggcctttcagcttaagaaagacagaggaagaaggcagggagatcttgcctatgttgggaaagtaagggcaggagcctctgagttggaaagaacatgtcaggtgttgtgcatggtgccacgtaagactgctgaggtatgatagagccagattatagatgtccctgaaggcctggcaaaggagacttgactgtatatagtaagcagtggtgactcattgtgagttcttgagccaggagactgctgaaaaagtagtgtgttaaaaagcagcatgcagggtgaattagaacagagacagacacctactaccagaaacccatttgttagcttccattgtaagatgtggtcgtagtcatggaagaggatgattgaaaacaagatatggccaaagaaaagagaacaataagaacactggggcttagaaggtcagattacgtcttactcaatcagtcagaactctggcatcataggtgattttagtgaaaaacatatctatttgttggaaacaaatttttaactttaaatggttagcttataggcttaagatataagttcccagagatgaattggtgaatggcgtctgaacttgacctatttgcagcagcaagaatgtgcaagaatcttctccaggctttctcagagctggaggacccagcatttgtgttaatgtgactgggttaaaatgaaagcctttgttgtctctgaaaagaaattgaggaagtactgttaaaagatgatgagatcagccgggcacagtggctcatgcctgtaatcccagcactttgggaggctgaggtgggcggatcatttaaggtcaggggttcaaaaccagcctggccaacatggtgaaaccccagctggatgtggtggcatgcacctgtaatcccagctactctggaggttgaggcaggagaatcacttgaacccgggaggcagaggttgcagtgagacaaaatgtaatgtaaggtaaaagtgagacaaaaatgtctattgtgacctgaacatattggcctataatgatggtaaagctgtgtcactctgagaaagttacttaaactctctgagaagctttagagcttctcatttataatatagtaatgctaattcctacctgcttcacagggtttttgtaagggttaaatgtatatcaacataaagtttctagcacacagcaggtaattgcaccactgcactccagcctgggcgagagagcgagatgaaagaaaaaagaaaagaaggaaggaagggaggaagggagaaagggagatgagatccatggaggaaggaaaggagactttattttcagaggagatacaatctgtagatccgggagtgcagcttcagtacaagccccacagaaggggcaaggagctggggtcagccatccatacataattgagttaggttgggaaaaatctatgaatatttataagaggaatcaggcaccatgcacagtgggtaaacatgtatgtagcatgcatttcatgttcactttggggtgaggttttagtattaaaatgaggtggaatttggctctttacatctaaaggtgaactacaggacacaaagttcatgcacagtctttataagttggttgaaactggctcaaggtctgcagccatttatcagtaaaaaatgttcataagacaggtcctctgtccaatcagagctgtggtgggactgcaaggcaggggcttgggatagagagtggaggtcagtggattcaataggttggcatcaggcagtctatctcggtcaactgggaaattttccagctgtagttgtttcagtaatgctttttgggagctggtttctgcttaattacaggggaaaaagcttatggcagttaataacacagaaatacttaactaagccccaatcctgctggccatgagattctgtttttggtgtgtctcattttagccacagggagtccattttatctgtctgttggggcatattttaacagtacaaaagacaaactgagcaaaacaccagcacaaaaagactgtaaactaaggggaaattacatggaaaacgagaaaaatattgaagtagcaatgtattcttatagttactcaggaaactgctgttcactttgacacacacatgcatctcttccctccttaaactgcctatatgtgattcgatagtacagtagggaaattatatttaacagtaatttattgtatatttttaaatatctagaagagaaaaattgtaatgttcccaacacaaagaaaagatgaatgttggaggtgatggatatctcaattaccctgacttgatcattacacattgtatacatgtatcaaattatcacgtgtaccccaaaagtatgtacaactatgatatatcaattttaaaaatttaaacagggtcaaaaatgtctattctgacctgagcatattggcctataatgatggtaaagctgtgtgactctgagcaagttacttaaactctctgagaagctttagagcttctcatttataatatagtaatgctaattcctacctacttcacagggtttttgtaagggttaaatgtatatcaacataaagtttctagcacacagcaggtaattgatagatgttaatatccttatcattagaggggataggtcaacttagtgttggaacttaaacttgcactcatctaaaagcagcaaacatttcccccagcttgttgtttaagtagtcgctaatgtgtagaatttaacccagccccatcagcagctgctaaaatagcagcctgggtttcagtttacttgactgcatacaactgggctaaggttatgttggagaaatggtcagtaactagtaagtctaacgtataactggtcctggggaaatgccatatttttaatcttgaaaagtcgactcattcattgttatataagataatcctacttcctttttttgtttgttttttttttttttttttgagactgagtttcgctcttgttgcccaggctggagtgcagtggtgcgatctcagctcactgcaacctccacctcccaggttcaagcaattcttctgcctcagcctcccaagtagctgagattacaggtgcccgccaccacgcccaggttattttttgtatttttagtagagacggggtttcaccatgttggccaagctggtcttgaactcctgacctcaggtgatctacccacctcggcctcccaacgtgctgggattacaggcgtgagccaccgcgcccggccaagataatcctacttttctaggaataaagtgatcccactcctaagggtgatgtgactccagtttaactcattcatcttcatccctatatttccccatggaccttgattatggtgtagcttcacttggaaacgctcaagaaggaatgaaagataccatatgggaggcattgataatgagagctgtttattgccattcacctgcaaacactgtctgtgccgcctgttcatgcatatcagacacacaaacattcttcatttacttaaggtacatggagaaatgatgacatgctcacattttgggagaaattccccttctacttggatgggtttccttctttgttcaacagggccagaattttatctaaagggagtacaaaggccatgatgccttttccaggtaaaattctatatatcttgtccccttgtcctttatcacttttatggttaaatgaataagtaaatacataaaatgtgttttcagtataaataaatcatacagaaaataccaaataaatcacttgctgcaattaaatgtttggagatcattggctctaaggtgacacactattcttcacagtaatttagcaatgagcctactgtgacctctccatcaaaatggaatcaagtcacaatattgccttatctttctatggcttctcggtgacaacaatttgggtgactgcacagattttagtgtcagtaggtagagctgtcgctctgaggcaacaggattgaaccctagtccacttgggtgagattaggggtaagaagtagcagcaaactttgtcatgttaacccacctaaaaaatattcagcccttcatacccattggctggaaatctccagctccttaatctcagttcttcatattccaagaacctaagactgcctctctggtagagcaatcttggtagtgttcaaggcatcaacaaaatagcaggctctaaactgattctgtgatgtttttgcaaatggcaagatgccctttattagatagtctccataggggttctggatctttaattacttgatcatatttacggctctgtctttataataatactggccttcaccttttcaaggcccagtatcctggcaaaaacatcaatttggacatattatggaataggtggagatgagaatgccatatctgagtgtggtgcaattatttcagaattgttgtaaatatgctggaacattttgtgagaagaggtaaatgacagtacagaactggttgagacaagaaaattggaaaatgattggagcaaaaaatgaaaaggagctagaaaggaataaggcaggaagcaaggaataaaaacaacttgggtctgcttatccattagctgatgtgggggaaaaaacaacgtgggtcaggataacagtctcctttctccccccaaaaaaatattttaacaggggccagaatgacactgcttagtccataggtggcctaatagtggactcatttgatctaggcacataatgatatttttatcttagtatataatgagtggtaattaagctgtcactggcactgggaaaagatcaaaatgtgagtgtgcagttttcttcattcctcaccccataatggcagatgttaggagatattttgctgcacctctctatcctttgactcatcatcttactcactattcctgccttcttactggtggtatcttggcctttaaatgaagctgtttcctttggaccctagtgatccttagagttcagaggaaagaggctatgtaatatagtcagcaatatcatcacattcatcttattctcaactaatttttaaaagtacttacctaaagtatcaaagagctacagagcacattttaaggtgagctgtcatcttatttcttcacaaagaatgttttgagttgatatgacgatgtatcataagtgacaacagaatgcatgatccacagaatatttatttaaaactgactataactcttctaggctccaaaggtctgatttctttcaaagtagctgatgacattaagcactcttacattcattatttctctcatctgagcccccaacagccctgttaagtagaaatgacagggatcttcatctttattttacagggccacgtactaaggtgataaagccattactaaggtgataaagtaatatattattacttcccttgtccttagttttctcatctgtaaatcaagatgataattattttcctctcacagtgtaatgattttcaagtggtaggatggatatgatagttttattaaactgtaaagccctctataatcctgttaccatattcacttataaattccttaactttagttagaagtagcattggaaaaaataaaaagtatgactttctaagatgtgcaaaaagctgttcatagataagacactattgtgttcttttgataagtttgagccaacagaagtacctcaaataaatgccagctctcaattacagatgttcatcaagttcagaacctactgcaacctcttctctcgttttcttattttttttttttttttttttttttttttgagacggagtcttactctgtcgcccaggctgaagtgcagtggggcaatctcagctcactgcaacctctgcctcccaggatcaagggattctcctggctcagcctcccgagtagctggaattacaggcgcccgccactatgcccagctaatttttgtatttttagttagagacggggttttgccatagtggccagactggtctcaaactcctgaccttaggtgatccacccgcctcggcctcccaaagtgctgggattacaagcgtaagccaccgcacctgaccattacttttcttttaaaggatgttttatatgtaaagagttcaacttgattgtatagagcagcatataatgagttgaaggttgccctaccagtcttggggcgagtcagtccaccttgatggccccaccaaagactgaaccctagctctcagcccagacatctcaaaagcctgtgattgaatagcaggaccatgagctttgtactaactcaatgttaggtttgaatcctgattcccctcctgctaggcaggtgggcctgaaagagttacttaacttttactgagtctcagtttccttatatattaaaggagatagtaataactatcttgtaagaccattgtttgaattaaagtaataaatatatttaaagtgcttagtagaggatcactcaataaacattaatctttccttcccatattgtggacatatagtgtaaccaggtgagcttgtggatggatccttgtagaatcccccagtccccaactctgggagaaagtttttctgagagcatatctttaaaatggggcaggttacctacatcctatctgaatactaatgctagcactattatagatatacatgtgcagcacagacatcatttttaacagatgtgtttagttaagtaacagatttagaaagtgcagactttaatctatgttttctcctgagatttcatcaccatctgatttctttttttcttgctaaaaagtataattgtagcttgatttcccccaccccccagttatttccccaagaaataggggcctttttaaaaatttgaataagaagctggataagcatttgaaagacatgaggacagtggatacctgaagaggtaagaagttgaggactttaaagtaaaagccttaatgactaatatattttttcagaaggtcctgcttccaccatttctgcaaggaacagatgactctaaagatatcatatcaaggtctgctttctgcttgttgcataactggatggagtaataaccaagattgaaactgtcattggttaaaggagactaaatggagcaggtcatggaaattgaggtgtttctttctttccccaaggaggggctggagagaaaaagtagcagagacttttgtcatcagctttcaggggcagaaaacattggttcctctctcctctgacctgcctctccacctaaaaacctgaatggattctggattccacttcaggctgttttgagttttgatagaataagtttgttaagatgttggggaaaagcaaaatatggtcttccaggatagccctggtggggagaggtagaaaatggtgggataaaaagtaggattatactagggccatgtgaaaccatccacactgtagtggaggagcttgactgcatggcagaaggcaaggtttttcaatttatcctaaaccatatcccacaatgttccacggctctgtctccattcagcaaatatttgcagacactatataggctgtaggaactttatcattcccattgcttttggcaccacaaaatgtcttagagatcaacagaaaagatgaaggaaggacctgattgccccattcaggtagttctccccattcttgtagttctgcttagttgctttgagcactggtttctgtgtccccctccttgaattaccacaggatcctggggattccacttcacaatttaagagtatcctatcaggaattctttaaatggtactctgagtggtgaagagggagaagaagataagtactaccacttttgtggacccactatgagccaggtactgtacttctttacacatacacacacacacacacacagagtgagagttaaattttatttgtatgtaaaaattgtataaccatgtaagcctatgaggtaactattatttttattagacagataaggaaactggagcttggagagtttcagtgatttatccagcatcacatagctactaagtggaagacagagaccagaaagcagcctagtgatttcattcaatactgattaatttccctttctccccaccctcacctctacccagctccaaaagaagataacactacttaaatattagctattattatcattttcactattattattatattatataccgtatgcctttggaaccaaaataggtgtagagagaaagaaactaaactactaagccctgtactagacactgagagaatgtttagcagtaacaggtagctacttttagacaatatccctaaggttgatttaagactttttattccacagcccagattatacagctgaaatcagggatttcaaactaacctctaatgttagccaccaccaccaccttcatgctggagccattccctaggccaaaactacctcagtactgtcagtacccaaattcaagacctgaagatcgcgaccagtcatgagatactgggtggctaaggcaaagtacatttgttgtcttagaaacccagagcagccatatgccactaaataaatttatgaaatcaactttataagacatattgattataaatatactaaaacaaccaatttgataaaggtatagagtatgcaaattttgataaaggtatagagtatgcagatgtgtgggacgatagaatgttatataacaaaactggagctgcattgctaggctaaaaacaggttcttttattctctttgcctttattttttaacatatgcaacaatttaatctttgatgattaaaaaggttgcagagaattaaaatatattgctataagctattataaatatcagtctactgtatagtaggttcttattttcataaataaaaaactgaagctgagaaactaccacaagaccaaaagcttattttaatttttataagcaaaggtcaattctttgaacaaagtctaccccattgggctatgactgatagttaataagtaatcttatgaatttttctttatacataaagaacaaacatgggaaaatctgggctataatccttgacaagatatttcttacactgcttcttgcctaaagggttaaaaagtactagtatggttgcacatcatgcaatactgactttgcaaaaagggtttgtataactgtatatagattctccaagttggaaaactgaaaaatctaatttcaaaaatataagtaggcactgaacatatatatcaatatgccaatgacaaaaagaaacatacatatctatttactttctatttccagacacagcaaagataaactaattttgtaatgctttctacccactgtaggtattgttcacagattaaataaaacttttccaggaaaatatgccatatacataaagccaatcagatatacttcccagatatttaggaaaatccaatatagagaacagaatgaagaatgggtgaattcacaaagtaataagatataataaatcatctaaaatgagtaagaactagaattcaagtacaagattcaaatgaggttaagtgatagccagaaaaggtcatacaaagtaacatccaaatatcacctcagaagcttaacatacaaacaaatttcaagtcaggacagatacacacactaaatgaagaggggtttatgaacggggactaattttataagtggtacaagagtgaatattttgcttccctacacaatttctcctgcaacctcatagcagcagggatttggataacaaattcatagccaatgagaaacccctgtgtgtgtatttatattacctgtgtatataacaacaggggatataagtcttggtttgactatcttagggtggtacatacagtgtatcttgatcaggaccacatttataaatgatttttttatagtataatactgtaccaaggttgtcagggaggtccttttcatatacaatctctccaagtactgcagtccctcatctttcagtaactccagtggaaaatggtgcagattcctataatttaagaacaaattcttgtgcttttccagccttgccacagagttcgtcttacaaagttcggataccgtgactgaatatatcccatcagacacattgcagcagtacatctttacaaaattggtcggtttctcagcgctggcagagccagtgctccggagctcaagtggcactggaaggactctttgcctttatttctctgtagtttcttttcatagtgttggcatttgattttccttttaattttcaggttatatttgcacttaattggcactgtagcaggttcattgcatgttgtgtgccttctgcataccttgattgtaatcgaacctgggctagaagggaaattgaagagtacagcaggcaataaaatccagacaagtagagtgtcattttatccagctttcaaactctgtaccgagtcctggagatatgtggcagagccttctgaaaggaaacacaggtgttttgtttttgtttttgttttgatgggaaagaggtggtgccaaggtgctaagggcatgaaccctcatcttcctaggccagtttgcatgtatcttaattgctttggagacactatcatgattttggctgagaaaaaaaaaaaactatagatcagttctttaagattttcaaaaacctacagcattcctccagtgccctaagcctcttgttcctgacaaatctctctgtgctttataaaaacatgcccaacatgacttgagtccatacaaagaccatgctccttgttgctatgggcccatattaaaggctgtactttgtgtcagactgtacgaatgtgttctgtttttctttttctcacgcacatggctgggtagcctgagcgggacccagttttattagctttgctgtgttttcttttatgtcttttttaaagctcattgaattggtttaagatttgtacaagtgattttcttactgtcacatagagttaaaattatctagtccagcttctccatccaatgtttaaacctgttctttaatgttgctgaagttttgcccagccactgctttagtacttctattgatggggagctcactgttttccctatgctcttcttatagcacccgtttcatctttggacaaatctatcagtctacatgttgagctacagtcttcctccctcacgttactttccattgtggtctaactaaacacatttcatttcactcttttgtgatagctctttaaggatctgaagacagaaagcacatttcttaaattttctcaaaacatcagtttcggggaggctggccaagatggccaactagaagcagctaatgcgtgctgctttcatggagagaagtggcaagtagatacagcacctttaactgaaacatccaggtacatgcattgggatttatcagggaaacaatccaacccacagagaatggagaaaatcaaggcaggatgaccatccagccaggagtgacatggagccaggggaacctccctcacccagggaagtggtgaatgagtgagcaacactgaagacacatgctttttttcatggatctttgcaacccttgggtcaggagatcccttagtgaacccactccaccagggcctgcagtctgacacacaaagctatgtggagtcttggcagagcagctggtaaggcacacgtggagccctgggagctttagatatccgggcttcccagcaaaagaggctgcaactccagcaaacctggaggttagaccccccctcccatacatacctctagaaaaggggctgaatccaggaggctgagcagtgatggtctgcagaccctacttccatggaaccttgcaggataagacccactggcttggaactttaaccagccaccaatagcagtgttacacctccctaagacggagctcccagagggagggcaagctaccatctttgctgttattgccttcagtgcagccaccctttggtaaaccagtcagactgctttttttacatgggtccctcaccctacttctcctcactgggtgggacctcctgactggggtcaccagccacacttgccggggttttccagctgtcagtggttctgagcctccctgggatggagctcccaggggagggatgggtagccatctttgctgttccagttgactgactagagcagtcaactgccacagtacagcagctctacaaagaatcagccagactgccttttcacatgggtgctggatcccgtttctcttcactgggcagaatctcccaaccgaagcctacaaccatccttactggtgtgttcaggccagcaacaagtccatacctacctgggatggagctcccagagagagggacaggccgccatctttgctgtttcacagccttcactgtcgataccttaggtgctggaaaatctgaagtgattagggactggagcagacccccagcatactgcatctcagccctattgaaaagtggccagactgttatatgggtcctcaatcctatatttcctcactgggtgagtcctcccaacctgggcctccagccaccctctgctgggcctatcaagccagtagcagctctgcagctccctgggacagagctcccagtgggaggggcaggttgccctctttgctgtcttgcagccctcactctcgctgtctccaggctttggagagtccatgaggactaaagactggtctggacccctagcacagagaacccacctcatggaaaagtctgttctccatgcagttcgcagtcctcacttctcactagtcagggccactcgacctaggactgcagcacaaccaccctgcccctgcctgaccacttcaatcagaggcagccaagcagtgaaaggaagacccacacacagagatgagaaagaaccaatgtaagaactctggcaactcaaatggctagagtgtcttatgtcctccaaatgatcacactagttctccaacaagggttcttaaccagactgaattggctgaaataacaaatagaatgcagaatatgggtaggaaagatcattcagatttaggagaatgccaaagcccaattcaaggaaactaagaatcacaataaaatgatacaggagctgacagatgaaatagccagtataaaaaaggaaactaacagatctgatagagctgaaaaacacaagacaagaatttcacaatgcagtcacaactattaacagctgaatagaccaagctgaggaaagaatctcagaacttgaagactggctctctgaaataagacaaaaataaagaaaaaagaataaaaaggaacaaacaaaacctctgagtaatatggggttatgtaaagagggcaaagctacaaatcattggcatttctgaaaggaagggagagaaagcaaacaacttggaaaatatatttcaagatatcatacgtgaaaacttctccaaccttactagagatgccaacagtcaaatttgggaactacagacaatccctgcaagattcaacacaagatgatcatcccaagaaacatactcatcagacttcccaaggtcaaaatgaaagaaagaatgttaaaggtagctagagataaagggcaggtcacctacaaagggggcttcatcaggctaatagcagaaaccctacaagccagaagagattaggggcctatattcaacatttttttttttttttttggagacagagtctcactctgtcacccaggctggagtgcagtagtgcgatctcggctcactgcaacctctgtctcccaggttcaaacaattctactgactcagcctcctgagtagctgggactacaggtatgtgccaccacacctggttacttttttttttttttttttttgtattttcagtagagatgcggttttaccatgttgcccaggttggtctcaaactcttgaactcaggcaatctgcctgcctcagcctcccaaagtgctaggattacaggcatgagccaccacacccagtctcaacattcttaaagaaaaaaatcttcaaccgagaatttcatactcagccaaattaagcttcctcagcaaaggagaaataaggtccttttcagataagcaaatgcagaggaagtttattacaaccataactgccttacaagagatcttgaaaggagcactaaatatggaaaggaaaggctgctaccagccaatacgtaaacaaacttaagtacactgtccaatgacactataaagcaaccacacaaacaggtaggcataataaccagctaacaacataatgacaggatcaaatccgcacatatgaatactaatcttgaatgtaaatgggataaatgcctcatttaaaaagcacagagtggtaagctggataaaaagcaagacccaatgataagccatcttcaagaaacccaacttacatacagtgacacctacagtctcaaaacaaagggatgaaggaaaatctaccaagcaaatggaaatcagaaaaatgcaggggttgcagtcctaatttcagacaaaacagactttaaaccaacacagacttttaaaaagactaaaaagggcattacataatggtacaaagtttaattgaacgagaagtcctaactagtataaatatatatgcacctatcacaggagcacccagattcataaagcaagttcttagagacctacaaagagacctagattcccacacaataatagtgggagactttagcactccactgacagtattagacagatcatcaaggcaaaaagttaacaaagatatttaggacgtgaactcaacattggaccaaatggacctgatagacctctacagaatgctccaccccaaaacaacagaatatacattcttctcactgccacatggcgcatactctataatcaaccacacaatcagacataaaacaatcctcaacaaaggcaaaagaaccaaaatcatatcaaacacactctcaaaccacagcacaacaaagatagcaatcaggactaaaaaaaaactcacagaaaacagtgcaatagcatggaaattcaacaacctgctcctgaatggcttttgggtgaatgatgaaattgaggcagaatgaacaggctctgaaattgaggcaataataaaaaccctaccaaccaaaaaaagtccaggaccagatggcttcatagccgaattctaccagaggtacaaggaggagctggtaccattccttctgaaactattccaatcaacagaaaaagagggaatcctccctaactcattttatgaggccagcatcatcctgataccaaagcctggcagagacacaacaaaaaaagagtattttagaccaatatccctgatgaacattgattcaaaaatcctcaataaaatactggcaaaccgaatccagcagcacatcaaaaagcttatccaccatgatcaagtggacttcatccctgggatgcaaagctggttcaacatatccaaatcaataaacgtaatccagcatataaacagaaccaaagacaaaaacaacatgattatctcaatagatgcagaaaaggcctttgacaaaattcaacagcctttcatgctaaaaactctcaataaattaggtattgatgggacatatctcaaaataataagagctatctatgacaaacccacagccaatatcatactgaatgggcaaaaacgggaagcattccctttgaaaacgggcacaagacagggatgccctctctcaccactcctattcaacatagtgttagaaattctggccagggcaatcaggcaggagaaggaaataaagggtattcaattaggaaaagaggaagtcaaattgtccctgtttgcagatgacatgattgtatatctacaaaaccccattgtctcagcccaaaatctccttaagctgaaagcaacttcagtaaagtctcaggatacaaaatcaatgtgcaaaaattataagcattcttatacaccaaaaacagacaaacagagagccaaatcatgagtgaactcccattcacaattggcttcaaagagaacaaaatacctaggaattcaacttacaagggatgtgaaggacctctttaaggagaactacaaaccactgctcaacaaaataaaagaagacacaaacaaatggaaaaacattccatgctcatggataggaagaatcaatattgtgaaaatggccatactgcccaaggtaatttatagattcaatgccatcaccatcaagctaccaatgactttcttcacagaattggaaacaactactttaaagttcatatggagccaaaaaagggcccgcagtgccaagacaatcctaagccaaaagaacaaagctggaggcatcacactacctgacttcaaactatactacaaggctatagtaaccaaaacagcatggtactggtaccaaaacagagatatagaccaatggaacagaacagaggcctcagaaataataccacacatctacaaccatctgatctttgacaaacctgagaaaaacaagcaatggggaaaggattccctatttaataaatggtgctggaataactggctagccatatgtagaaagctgaaactggatcccttccttacaacttacacaaaaattaattcaagatggattaaagacttaaatattagacctaaaaccataaaaaccctagaagaaaacctaggcaataccattcaggacataggcatgggcaaggactttatgtctaaaacaccaaaagcaatggcaacaaaagccaaaattgatagatggtatctaattaaactaaagagcttctgcacagcaaaagaaactaccatcagaatgaacaggcaacctacagaatgggagaaaatttttgcaacctactcatctgacaaagggctaatatccagaatctacaaagaactgaaacaaatttacaagaaaaaaaaacaaacaaccccatcaaaaagtgggtgaaggatatgaacagacacttctccaaagaagacatttatgcagccaacagacacatgaaaaaatgctcatcatcactggccagcagagaaatgcaaatcaaaaccacaatgagataccatctcacaccagttagaatggcaatcattaaaaagtcaggaaacaacaggtgctggagaggatgtggagaaataggaatgcttttacaccgttggtgggactgtaaactagttcaaccattgtggaagacagtgtggcgattcctcagggatctagaactagaaataccatttgacccagcgatcccataactgggtatatacccacaggattataaatcatgctgctataaagacacacgcacacatatgtttattgtggcactattcacaatagcaaagacttggaaccaacccaaatgtccatcaatgatagattggattaagataatgtggcacatatacaccatggaatactatgcagccataaaaaaggatgagttcatgtcctttgtagggacatggatgtagctggaaaccattctgagcaaactatcacaaggacaaaaaaccaaacaccgcatgttctcactcataggtgggaattgaacaatgagaacacttgaacacaggaaggggaacatcacacaccagggcctgttgtggggtggggggagggggcagggatagcattaggagatatacctaatgtaaatggcgaggagttaatgggtgcagtacaccaataatgcatgtatacatatgtaacaaacctgcacgttgtgcacatgtaccctagaacttaaagtataataaaaaagaaagaaagaaagaaagaaattgaggcagaatttaagaatttccttgaaactgataagaacaaagatacaacatactagagtctctgggacgcggtgttaaaagagaaatttacagtgccaaatgcccacatcagaaagctagaaatatctcaaattagacaccacaactaaaagaactatagaagcaagagcaaaccaaccccaaagctagcagaagacaagaaataaccaaaatcagagctgaactgaaggaggtcaagacacgaaaaaccattcaaaagagaaatgtaaataggagttggttttttgaaaaaaaatattaagatagataagccactagccagactaataaataataaaggagagaagatacaaataaatacaatgagaaatgacaaagaggatgttaccactgacaccacagaaatacaaacaaccaccagagactactacaaacacctctatggacacaaactggaaaacctagaagagatggataaattcctggacacatacattctcccaagactgaaccagggaggaatttattttctgaacaaggaattagtaacaagctccaaaattgaatcagtaataaatagtctaccaactgaaaaattgcccaggaccaggtcgattcacagccaagttcttcaagatgtacaaagaagagctggtaacattcctaccaaaactattccaaaaaattgagggggagagacacctctctaactcattctatgaggccagcatcatcctgattcaaaagcctggcagagacacaacaaaaaataaaactttgggccaggcattgggggtcatgcctgtaatcccagcactttgggaggccgaggcgggcggatcacttgaggtcaggagctcacgaccagcctgaccaacatagtgaaacccatctctactaaaaatacaaaaaaaatcagctgggcgtggtaatgcctgcctgtagtcccagctacttgggaggctgaggcaagagaatcacttgaaccagggaggcggaggttgcagtgagccaagattttgccgttgcactccagcctgggcaacagagtgagactccatcttaaataaataaataaataaataaataaataaataaataaataaatcttagggccaataaccttgatgaacattgatgcatcaatcatcaacacaatacttgcaaactgaatccaggagcaatcaaaaagctaatacaccatgatcaactagacttttccctgggatgcaaggtaggttcaacatatgcaaatcaataaatgtgattcatcacataaacacaactaaagacaaaaaccccatgattatctcaatagatgcagaaaaggctttgttaaaattcagcatctcttcatgttaaaaattctcaataaactaggtattgaaggaacatacttcaaaataataagagccatctattacaaacccacagccaacatcatactgaatgggcaaaagctggaagcatttccattgaaaactggcacaagacaaggatgtcctccctcaccgttcctattcaacatattagaagttctggccagagtaatcagacaagagaaagaaataaagggcatccaaataggaagagaggaagtcaaactatccctatttgcaagtgacgtgattctgtgtctagaaaatctcatagtctcagcccaaaaattccttcagccaataaacaacttcagcaaagtctcaggatacaaaatcaatgtacaaaaatcactagcattcctatatgctaacaacatccaagctgagagccaaatcaggaacacaaacccattcataattgccacaaaaagaataaaatacctaagaatacagctaacaagggaggtcaacgatctctacactcagaattacaaaacactgctcaaagaaatcagagatgacacacacaaatggaaaaatagtccatgctcatggataggaagaatcaatatcattaaaatggccatattgcccaaagcaatttatagattcaatgatattcctatcaaattaccaaggacattcttaatagaactagaaaaaactattttaaaattcatatggaaccaaaaaaagagcccaagtagcccaggcaatcctaagcaaaaggagcaaagctggaggcaccaaggttacccaacttcaaactgtactacagggatatagtaaccaaaacaggatagtactggtacaaaaacagacacatataccaatgggacagaaaagggagtccagaagtaaggcctctcacctatagccatctaatcttcaacacagtggacaaaaacaagcaatgggtaaaggactccctattcaataaatgttgctgggataactgtctagatataggcagaagattgaaactgaacaccttctttacaccatatacaaaaatcaactgaagatgaattaaagacttaaatgtaaaacccaaaactataaaatccctggaagacaacctaggcagtgccattttggacataggaataggcaaagatttcatgacaaagatgccaaaagcaaccataacaaaagcaaaatttgacaaatgggacctagttaaactaaagagcttctgtacagcgaaagaaactatcaacagagtgaacagacaagctacagaatgggagaaaatttttacaaactatgcattcgacaaaggtctaatatccagcatctttaaggaacttcaacacatttacaagaaaaaacaaacaaccccattaaaaagtgggcaaaggacatgaacagacacttttcaaaagaagacaatcatatgaaaaaaatctcagcgtcactgatcattagagaaatgcaaattaagaccacaatgagatgacatttcatgccagtcagaatggctattattaagaagtcaaaaaataacagatgttggcgaagttgtagagaaaaataaatgcttatacactgttggtgggagggtaaattaatttgaccaatgtgaaaagtaggtggcaattcctcaaagagctaaaaacagacctaccattcaagtcaataatcccattactgggtatatatgcaaaggaatataaatcattctgttataaagacacatgcatacatatgttcattgcagcactattcacaatagcaaagacatgggatcagcctaaatgctcatcagtagcagataggataaagaaaatgtggtacatatacaccatggaataccataaaaaaagaacgaggtcatgtccttcgcagggacatggacagagctggaggccattattcttagcaatctagtgcaggaacagaataccaaataccacttgttctcacatagaagtgggagctaaatgatgcaaatacatggatgcaaataggggaacaacagacactggggcttacttgagggtggagggagggaggagggagaggatcagaaaaagtaacgattaagtactaatctttgtccctgggtgacaaaataaactgtacaacaaacccccatgttatgacctatataacaaatttacatatgtatccctgaacctaaaataaaagtttttttttaaatcagttttgagtcctcttgttctagactttttatctaaatgagttccaatttgtctatatcacttatcaaagtttattagaacatatattcattctgttcctgccatcttaatgacatcatgtttcccctgcttaatccttctttgtgtctctgtagattattaattttttatgttagatcattttaaaagatgattttaattaaaataatacctacaaccccttcttcccacccactctcctcttccccaagagacagacattctaatttggcatgacattatctggcctaacagtgtctggcatatgaagtgcctaaaaggtcatcttccattgttttagccttctggagtagttgaattaagttcaaactcagaatgtttttcaaatgttaagtctctctggggatgtttttcataacatcttcgaactggctaacacgactaaatgaaacatgctgcactggattaaaaggttatttccctagtgtgtcaagctaacagagaacatgaaacttcccatcaggcactgggcatctctggttgtcagtctagcaacattgtctccattaagttcctaacccccaccgctcagagaacactttagtcaagaaactacccttcacactgaatcttgagtggcagaaaggcaaagaaaagaagatgtaggaagagtcagaaacaagcaaaagaaataagggactctgtgagctaataacctgagtctaggtaatcaagaccaaagaccgatggaaacccattatttgaaattaaggaagaaacctcatacaggatcagagccaagcaaaaaatggacaatggtctaaaatgggcaaagagtaattctggtaagttagaatattgaaggacaggacaagagtctctattccatggagataagatacccgcaatttaccacattagaatggttacctaagaaagactgtggaaataaatcagaataactgaataatggcaaaagggaagcctttcttggatcactgatgaattgaagaatatgatgacatcaacctctgcacctgagaccaataaaataaataaaaccctaggccatcccatgcaaatagacaagttagttaggaaacaagaataacagtgctgtctagtagaactttctgtgataatgaaaatgttcggtatctgctctgtccaatattgtaaccactagccacaggtgattactgagcacttgaaatttttctagtattactgaagaactgaagttttaattaatttacatttaaatttaagtagctgcatatgactagaggctattatattggaggggacagattggatgttgcaagtgagcccaaatcctggcacagaaaaggtaagtgtacactgtagttgcaggaaacagcgttcatccttgccctctccaggacctgtttcgcccatcagtaggtgaacttgcagaaggctagcccctagaagttctcccctactgtggatttggctgctagatttgggaggagtcctgcagagctgactattgttcaagaaatgtgggcttcggaattgcatgtgcaatgggtgtttcctatgcagactttaatgagcacagcacccccagaatgccacgtgtatggctttgggcatcagccaggattggcttgagttgggtgctacctagtgaactatttcaaactatggtgctctgaggacttctttgctgccttgggtatgggtaacagtaatgagttgtgaggggtcagaatagagagttaatagtataaatgattgctaggctattacagaattctaactagaatggcaacatacttattcttaggcccaacccctcttcttttctgatattccactcttcttagccctgtatcctttcccttgctcctggatagcccattccttgtctcatgtggcaaataaaaggaatatgagaaaatgcttctaatgggggtggggggacatggccttattaacacgtgtgtttgggttcctgggtgcttttgtggaattattgaaattttcctttcctctgttgaataaaaattaaacagcagttgtaaaagtattgtacagatggtcaaagtcatcttaaagtactttccccatatataagtagccaataactatcatgtacccacaaaaattaaaaatttaggccaggtgcggtggctcacgcctgtaatcccagcactacgggaggccgaggcgggcggatcacgagatcaggagttggagaccagcctgaccaacatggtgaaaccccgtctctacaaaaatacaaaaattagtcgggtatggtggatcacgagatcaggagttggagaccagcctgaccaacatggtgaaaccccgtctctacaaaaatacaaaaattagtcgggtatggtggcacgtgcctgtaatcccagctactcaggaggctgaggcaggagaatcactggaacccaggaggcagaggttgcagtgagcgtgactgcactccagcctggatgacagagtgagactccatctcaaaaaaaaaatttttaatttaaaatttaccccagtggagttcacttactgatggaggatgcctgagtcctttgacctttggcagtgacaggtcttctggctgtgaaaaggtctaagcatttatcagcctatcagtttgagcatgactgctgggctccactacaagcatatctgcaaaaggagtgtgatgagggtgggatctgaaacagtagttttaccacttggcatggattgcctagcagttgtgtacttagtgaaagcaagtccagagttaagtgggaagtgcacttatcttcatggagtgatcagagatggatttatttatttatttatttttcctgtagggcccaagcctgtgaaccaaagggattttttttttcttggtgaaagaaattcacgttgaaccaatatctagaagacctatctggggatcaacaaggctaggagaatattttgaaagtaaaatcaaaatacagaaataaatatttgagccaatctaagacttgtcccactgagagatacctgctttgccaagtacatgcctacctctctaagattgtaagtgctttgaggctacagcttgtgtttctcacttctgttttcctcatggcatagtctaacatataaaacaggtatttaataaatgtgaaaaaacttaacatacatccacacccatgtgacagtcccagccttccagcaagctgtttgtattttgtttccacatagccaagagaggtaaggaagtggagtgctcaagtaagccccagattcacagaccttcttcagtgttgaactatgctgttcttcactgcttagaatatagaaagggtatcactgtttcaagtacacatgttaggatggcctgggaactaccctgatattaagaaggaaggccagagattttatggatggtaaaactgaggctcccagttacctgtaacagctacctcagtatctcatgggaaaactacagtgggaccaagattgtttcctgggccaggacagtagtatcactttttttaatgggatgttttgtatttgagtatgcattgtcttcaatttacttggaaccatttatgcattattcttgtgtacttacctaaaaatatctgatctgtagggaaatgaatagatagttctataattcttaggggttctgaaatatagtaattaatttgatgtttatctctttatggtcttgttttctgctttggaagttagaatgaagtcagaaatgagtaaaagaaaactatgatcacttggaattttatatatgtatatatatgaagaaaaagaaggctgggtgcggtgactcacgcctgtaatcctagcactttgggaggccgaggtgggtggatcacaaggtcaggagttcaagaccagcctggccaagatggtgaaactccatctctactaaaaatacaaaaattagccaggcgtggtgtcaggcgcctgtaatctcagttactcaggaggctgaggcaggagaatcacttgaacccaggtggcagaggttgcagtgagccgagatcgcaccactacactccagcctgggtgatagagtgagactccgtctcacaaaaaaaaaaaataaaaaaataaaaataaaaaaagagaaagaaaagaaaaagaaagaaagttgggccaggcacagtggctcacgcctgtaatcccagcactttgggaagctgaggtgggcagatcatctgaggtcagaagttcaagaccagcctggccaacatggtgaaaccccatctctactaaaaatacaaaaatgagccgggtgtggtggtgcatgcctgtagtcccagctactcgggaggctgaggcaggagaatcacctgaaccctggaggccgaggttgcagtgagctgagatcacaccactgcactccagcctgggcgacagagcgagactccatctcaaaaaataaaaaataaagaaacttttgtacttgtcatggtatccctagtccctctattctccccccaaaatttcaaatggtatcttaactggtcattattaaatagctgaatttattttagcacttccaaagaattcccagcttttttcatcttccaacttccagtcctttatattgcatcctgcttccatgatggaagaagaaagtcaccataatttttttgagtgtacatgaatgtcctgtgtgtgtgtgtgtgtgtgtgtgcgtgtgtgtgtgtaaggaggaaatgtgttgcttgggtgggtatgccttggggtgacaatacagagctctagaaccagaggctggaagagcagtgcctacttctcagatggattttggctttatctctacttttcacttctcctcttgggataagtaagaacagctttcttatttctgacagcatttcctccaataaagacaaacaaaaagttagtagccctctgattagtggttatttttattgataacttacattccacttggtaagtaacttggtgctatggggatatttctggactagaaggcaacatacatcccacatccaagaatgtgtatgtgttaccaaatcactatgtaacactggcaagtagtttcccctttctgggacttggttaccccacttgtaaaatggggagtttgggatgagactatcttccaagatccttccagccctgtggtttagtgattacatttctgaaaagaatgtaataacattttttaaaatgcagttaacaggataaattagtaataagaaaatagattagaaaccatatggagaaagtcaaaagataatttagcctaaagttattgcgctcaagcattaaatgtaactcagtgctgcctggcaacaaaagcactctttgattaggatatagtccttatataaatgcattctcagaaagggccaggctatagtggtgtggttcttcagaggactcgccatcttccacacacaaatgggtcttccaggttgatctctctgttcctaatataccattatactgcccatttggatctagagtcaaggagaaagtgactgtctttagaaagaaataccccacctgagaaacagtgattatactcttctgtcactctttcctcagatttgagaaagaaagcaggcagaagtcctgaaaataaaattctttcacaaaggcaaagggactcagatgtgtcagtgaagttgagctacctatagttataaggtttaaaagttaagactagtgaggaggctggctattcttgacttgaacctaatagtgcctctgcttgttctttctacccctaattccagtcttaatgaatattgtttcctggcatttgtatagtgctttaatatatacagtgcatttgtacatgctttctcattgattcatcgtcttatgcacctactcttcttgaaaatttctttagagtgatgtcacaaaaaatggtacagataaaaccggtacagagagaaagaaaagggaagggagacccaaatgttgaggcactgagctaggacacaaatgcagccactatcacttctgcctaggaacatgatggcaaagagggtccctcttagattggtggctgccaaaaatgaaggcaggtgatacatacggagccctgtcgccgccagcagcaccctacttgctacccctgacaggattggggtatgtgtgtataaaaatcagaggcatacaggaaaggacatgagatggaagggattaaagagttccctcaggctcatctcagtatcacacaaaacttaaatcagaatttattcttgcatgtcaattttttgtagtacatgtaattagtttcaatttttaaagacgaaaaaataggctgggcatagtggctcatgcctgtaatcctagcactttgggaggccgagacagccggatcacctgaggtcacaagttccagaccagactggccaacatggcgaaaccccgcctctactaaaaatacaaaaattagcttaggaggataaggcaggagaaccgcttgtacctgggaggcagaggttgcagtgaagcaagatcgcgctgttgcactccagccttggggatagagcgagactctggaaaggaaggaaggaaggagggaaggaagggaaggaagggaaggaagggaggagggagggagggaaggaaagaagagggagggagggaaggaaagaagaggaagggaaggaaggaaggaagaaaagagggagggagggaaggaaggaaggaaaggaaggaaggaaggaagaaaagagggagggagggagggaaggaaggaaggaaaggaaggaaggaaggaaggaaggaaggaaggaagggcgtgatggtagcctgtaatcacagctactcgagaggctgagtggcaggcggaggttgcagtgagccgagatcatgccactgcactccagcctgggtgacaaagccagactctgtttcaaaaaaaaaaaaagagagagagacagagagaagaaagaagcaagaaagaaagagacaaaaattaaatgaattctagattgttaggaactaaaagaacccttagatataatctagtttttctcccttattgtatagctagtaaaactaagtaccagagaagggagggagcttgtctgaggacacctagctaatgatcgtactctgtccattatacagtatcccctcttctatatgagttttttgtgcatatcttttgaattttggaattttttttttgagacagagtctcactttgtcctccaggcttaagtgcagtggcacgatcttggctcactgtggcttcaacctcccgggttcaagcaatcctcctgcctcagcccaccaagtggctgggactacaggcacgtgccaccatgcccggctaatgtttttgtattttttgtagagacggggtttccccatgttgcccaggctggtctcaaacttctgagctcaagcaattcgcccacctcagcctcccaaagtgctaggattacaggtgtgaaccaccacgcccagccagaattttggaatctttatcatgagagaggaaatatttaatagagtcataccatacttttgagatatatagaattctttacagtgtagctgtagtaatctcttcttgatgtctttctcacccttaatattgttaaaacttgtatcgttgctcatttaagcatgtttcctgtacttaacatcatcatacctccgtatttctagcttagggtcttaaaatcctgatagatatctgaaaatagaattagccaagcagagttatggattagaatgtgctccctgtactgttgctgattctgccatccattattctgactaaagctagactgggaagaatcagactagacagagctagctgggctagcttggaaaactgtctgtgggcctatttgctatagcagtaccatctccttgcttcattacagtccctaacccaacctgaagattccccatctgtaacagcttgcttgtcagttgctttctttccagtgtgacagctaaggtcctggtcagcttcattagacatgttgtacctgataatgggtcttcatactggccttgctttattcccaagaagatcctggcaccgatatttctgagactaccctggtctggaatccaaccacccatgattcttctttcacagtcatctattaactctttgatctgtcttttctctctatattctgactactgctcccttacctgtcacatctaaatcatctttcaggtctatacagcacacctatgtagttctacttacatctaacatctcctttccattcctatttcctcctcctgaattctaatctttttgacatctcacacctgaacattttttcctatcttccccccctctgtctctcccactttcactggtcctaatattcttcactactcaaaacccttcagcatcttcctgaattacaatttagttggcctccacagtatatttcagtttatctttccactatattttcttgtttgtacctatttcagccaaacattattccctaaattctctcccatcttttcctaccattcaacatcattgtttaaccagtttttataaagtacataccatgttataagcactatgtgagctaggccctgtggagttgggggtgttggtgcttagtcttttgggggtatcagatataaagtagtaaagcttgtataagatgataaacacagaggagataaaaattctttgagaatacagagaatgacagagactaattttgtttggagtggggaatcaaggaatgtgtcaaggaaaaactgagaagggaagagtacagagaggtgaaagggaggttgggaaaggggaagggaaggaatgggaaaaggggacagagattccaaacagagagaatatcaagtgcaagacacagggaagcaaaaacaaatggtttaatattaagggagtggagagggttagaatatttaggaacatagggggaagtgaacagaatgaaaagaggatacaactggagaaggtgaggattgattgaggagagtgttttgcaaagcaaaacaaagttttaaggtaccttgtcaacttgctatgattctatagcagttgtttagaagatagactggagtgggagggagacttgtagcatttcatgaaggtccttctgcctggaatacttttctctccgctgaacttccccatcctcacctccagaaaggtcatccttcaaggttcaccttaatgttgctgcttttagtgaagccttcccaaatctcccgcctctctagaattctagaattggagtaatttccctccatttgggattcccatagcaactttctgcccctctttcagtgtattatacttacaatttgtttgtagcttgctttccccctctagactctgagcatcttgagaacagagatctagcctcatttatctgtcttttctatgctgtacttgatagaatactgtgatcacaggtagtactaataattttgatgaattgatttaaactggtatcccagagattggcactactcaaactccaaaggctatattgccccagacccatagacaaaaacaggacttactttcttgccttgatttttttcaccagttgggaaaagccaaggacatcctcaacacaaatgttggtgtgggtcacctagactctgagaccttagacttcaaggccgctggggaagaggatagcagcctacaggatctatgagcctttctcaagcccagctgaggggaagggcagataggagggattgcttttccagtctaatggagcatttccttgcttcaaaataccatctccatgctaatgttattttaatgccattacactgtgtaatttactgtgatcagcaaagcaatttgttgtacattcttccaaaagtgttaatcaattttagctcaaaatagattttaaaaccccacctaatttactgtcctaaaatgctgatcagtgggggaaagctaaagcaagcccagagttgtttgtattgtaactgtaagaaattataattcctccccaaaattatttttataagcagccaaggtataagtaaataggtatgtagaaaaatatatacctttagttgtcctgtttatagctgagatttgaaaaatcataggaaaggactaaaggattgtctgctcaaggtctagcctactaattctggagaacaaaggcccaaattattgataatcactaagttaatatctgtgatactcagttttcccttttcaaaaaaagttatagactctaatagaaccaaacttatgaggtaattaattatacatccaacctcccatgtccccactctacctcttctttatcttttgccaaagtgtatctcctctctgttctcaaccttataagattccctttacttcagagtcataaatcttgggtgcttggccagatttttccattagaggcaatttatgttcttagggaaataacatcccagagtaaagttacagcagcactaatatgtcccctgacatagtgttcttgtcctgcctgaaaagactggataattggctagacacagttgctcatgcctgtaatccagcacttcaggaggctgaggcagttggatcgcttgagatcaggagttcaagatcagcctggccaacatggcgaaatcccatctctactaaaaatacaaaaattagctgggcatggtggtgcgtgcctgttaattccagttacttgggaggctgagacacgagaatcgcttgaactctggaagggccactgccctccacctgggtgatggaatgagactctgtctcaaaaaaaaaaaaaaaagtttggataattgttgatacttaaatgtattgttcctatatatatttcatggtacattaatttttactgataacagatgcttatctgtggcagctgttctgtattttcctacctgaaagggtatagaagtatagatcagtaacatgtggaaacttgtatttgtctagccctgttttagtcaggggttggagttggtaagaatcatggagatggcattttgtgttttaagaaaaaacacctagtctcttggtcaggaaacttggggggtttttttcatagatctctcattgtgttgttttacaaccttggctgtcatagtctctctttccataccttggacttcctggtgataaaaatggacttgcttgtagttaactatagacataagggataagaagacattaaattattgaaatctaaaagtaatttgccccttatcaagttcctgccaagatggacttagtggaggggcaaaagaggggtaaatgatacctgaagttctactgaactccaaaacaaaaatgcacagagtaatccatgatggcaatatgattccatctgatttatagggtcgtctttgaagcagaggcagctatccaatctgttcattcagttctactacaaatgagccctccttgacaaagggtggggacttggacattgctatccactcctctccatcttttaaaactctccagcccttttctgtgtaaatacaagtaagcatatattttctcttttccctggcacccatggtttattgcctatgcatcaaatcagatctcatataaaatgagaagaaaatgtggcaattctaatatataagtgttaggggaaacccagagtcatctaacatttttaaaactgagagactgcctaatacagtctttgtattttatagataagggaataggcccagatgggtaaaatattttatagattgaatcacgtggaactgttactgcttcctgtttctcaatgctgaacctactttttagagtatattgcatgcattaggataaatgactatacaattgagattcttataatagctgcttgactatcaataccatatgctttttaataaagggatagatactcagttggggagaaggtctagggacagggggagggctagatgttgtagtggcatgtggcagatacccccatctcatctcctatcattttgcacataaataccactcaggtaggtgggcaggagatgaagggctacagatagatatatgtcctatgacctaaaaatatcagatgatgctggggccttttcagaaaatctaatcttctttgtagtcacattttttaaaaatttgctgtgagtttggaggaatacttgtcaaagtccaagttaaagtcctggaagtcgagaaaccaaggaattctctaccttcttcatccttagcagtcaaattttaaggcacagaaagagaaaatctgaatatgatgtatatgtgtgtatgtatatgaattgccttgtttttgaagagcatctgatcatttgaaatagaaatgaggcaaacaaaaataaagttaattgccacacacaaacacacatacaaacacaccttatctcaggttagtcttgtctttgctttgtgtccttcttaatcaggcaaccatgattaggttaaatgcattactatttggaggaagggatacgtttgtctgcttccttggatttcagttttgaataatattgtggcacagaggtgatagaaggatctaggatgtatgaatgagtgtgagtttccaaactgactttatgtggtaggtataaattgtgaaacaaaaacaatagcagtgatgaagtcaatctggaaacaggtaaatcccagtgagccttttaagacccctctagctgaaataacctataaaacacaaaataaaacaaatttaatgactgatattatatatttgaaatgtgcaggttggacagcatttggacttggaatgaaacaataagaggttatattcatggataaccaacaagataaggctattgttgcctcagccaacggagaaaacactctgattaatggggtcaaagaaaatggtaagggaatttaattatagtatattaatatctctcctggtagtcctctgttattactatggattttcagtacccacaaagttgggacaggttgagtccaggatgcctctgaaatgaatgttaattgtaaactttattccaccaaatatctaacttggctataagagtctctaagaggcattgaatctgaccactttgccctcccaaatcatatctgccagatgaagatcctcaaaattcctagtgaattagaaatatgctgtgatgtgaggcttagaacttctagagtggccgggcgcagtggctcatgcctgtaatcccagtactttgggaggccgaggtgggcagatcatttgaggtcaggagttcgagaccagactggccaacatggtgaaaccccatctctgccaaaaatataaaaaattagccgggtgtggtggcaggtgcctgtaatcccagctactcgggaggctgaggcatgagaatcacttgaacccaggagatggagattgcagggagccgagatcacgccactgcatttcagcctgggcaatagagcaagactcaaaaacaagaaagaaagagagagagggagagagggagagagagggaggagagagaagagagagagagagagagaggagagagagaagagagagagagagagagagagaaaagaaaagaaaaggaacttgtagagtcactaggagcttccagaacatggatctggaggacaggcctgagcctcgtagctcaaaagtattaatgttccatctgagcattttccccttgaaagccttgactttccaattgatcaagcagtccaattcttttctcatttctgaggagagctttgcctttttctgaggaagaaactcggcctaaataattattatttttcatttgcatgaatgttcaatataaaatcagcgttgttctttaacgttgtagtttttatttgtaaagatagagatgtgaaggcttagcttatataataagatcaagtaccagaaactgatcaagggaaagagagttaatgagtctggtctaagactcttaattttattcctgtcatttctttcccttttttctagactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgaggtaatactgcaccagtatggctgagatgatgcacccttagctctcctactacctactaagcccgcagtccctcattttttccctcttgaaagcaaaaatttgcatgaaagaaactgtcccattcccttctttttcaaagtaaaaagaaaattttaaagtgcatgaaaatccctatacctttaagccacccaaaagattgggcaattttgttgtggcttggctagggataagctctaacaaagctatttcttcttctgctattcatcactagttactacatattaagaaaatagaattaaaatatgctcttgaatgatttttggaagtgaaaggctttgcagtaagacagattttgaaaaatagaatttaaaagtcatgtagacaaaaagccaagatcatttaaacaaaagagcattagctggaaaacaaaatctgaacatgtggcaaataggagggctttctagtgccccatgctatttgtatctttttctacatcatacggcatctagtatgatgttaacaaatttagcttgtatgatccctttgtgggacatacactaaaactaactcagatggcataaattgtttgatttttctgcagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaaccatttctaattaaatctatgtcccaaataaaacgttctttatcatctagagcagtgtttctcaaactatctgtggtgagggaccaatagtttttgcaatccatcacagaccaatactattataaaacacaacaaaaatgaatttctaagaaagttaaatggaaaaaagatatgcaaaataaaagcccaaatgtattagatttaacatgtaaaattacatttcgagataaacataacataaggggaaagaaacgaattgcaaaaagttggtaccctgtttgagacaagtccactcatcaatgtcaaattgccatagaaggttctaatcatactttgaataatactttgactagaccagcagcattgccatcatctgggaacttgttaggaatgcgaaattccaagccctacaccaattctgctgaatgagaatctgaattttaacaagatccctaggtgttttgtgtgcatgttaaagtttgagaagcactgggctagagttttgtgtaggggattcttttgcccctcaaattgaggaatcatcttctagtgtgtccagtcttcaaagaccttaaaacaaattgtgtctttgttttgtgatccagatggaatctgcagagatgcagtcctctcaaagtgttaaagctgtttattgaaagtaataaatgctgatttgcctggtacccaaa

SEQ ID NO: 4746 - DNA, 139698 bp, human
ttgttgctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtggcatcttatctttgacacttttcttcgttgtagacgttgagattatcttaagcacaaacacttatcgtttcacaattcagcgtttgtccaggatctgatctttattttaatcacagactctttatctacaatagtatggctttgtattgagaatatgtgcagaacattgaattagatgatactgaggttattaatttttttttttttttgccgggtgcgggggggtggtggggagggggtgatgcacaagaaataagacagagttcctggcctcaaaagagtttacttacagtaggctgggcgcagtgtctgacacacctgtaataccaacactttgggaggccgaggagggtggatcacctgaggtcaggagatcgagaccagcctggccatcatggcgaaaccctgtctttactaaaaatacaaaaattagctgggcgtggtggcgggcgcctgtaatcccagctagtcgggagactgaggcaagaggatcgcttgaacctgggaggcggatgttgcagtgagccgagatcgtgccactgcactccagcctgggctacaagagcgaaactgtctccaaaaaagaagaaagaaaaataaacagtttacatacaattgagtccgaattgagtcagttgaattcagctatgaagacaacggtttctagcagccccactgactgaattactaggttgcttatcacatccttttcaatggttatttttgaactggcattttattatatttaacattttctggtgtctaaggtcatgacatgagagagttttttttgtacttgaggatctcaatgtagtaggaaagaaagatacacgattacctaaacatttaaaaaatctcactaacgttatatattagaaacaggaggtgttatgagagtgcagggaagggagcatgtgaactgggctttgaaaaatagataggatttagctttgcaggaatggaggaagaggaagacatctatctggactgatagatagaagaaataatgtgagcaaagccatgggggtctggaaagttgcccgacatccagtaacacactgtaagtcaatattcctatttctaacagccacatcttccaagatgtcactgattaaaattagaaaaaatatagaatacaaaactagtcagctcacaaacatatccaactgccctccagccaataagaaagcttatatagagaaaaaaatacatggaaatgacaaaagcaatgttaatgtatgaggcttaattctgatgtaaactcaaatctaaaagagaaaaaatgtaaaactcgctatactttaattctgattgagtgttgtgccttaaatataatttggaatcatttttaaaattgttgggaatgaataacattttctgaagtgagcaactgttccaggttttccccaaggaatctctgcttttccttttttcctctaaattgatttctctctattgatcttcttaacttgataggaactattctattccgatcacagccttagaaagatcttgatgcctgccctcaagataaggttaaacactaatccctccaaaggataggttaacatctctgttctctaaagcagaaggttgattttctttgaaaaatgcttgcagaagcagtaaaatttgcttacaaaacaagagagagagagaaaagagtgcaaaaataaccccagctaacacaccacaaccttcacttctgtgagggcgctaaaggaaatacattttaaaaaaataaattccttgttataactccttttatctatatatttaaaagctcttggcaaactttattaatcaagactttggacatcctgatgagtgaaaataatcttcatttgccagttgggaaagtaaattgcaaggagagatttttgtctgaactcatagaagcactagcatagatgagaatagtatttgggagttttgtctcaaaattccttctattcatctttgttaaagggcagttcaggttttagcgttttgtttttagacaacgatatttcttaggatatagctcaacatggggccggggcaagggggaggctgggggacagatgagtgataggcaatggttaggcagagtattttagttcactctaccatcccagcaatcatgtttttccctcttaaatctcagtcttcaggttgatttaatgtgatattacttgcttacttaacttgctgagatagtttggcaggaaaaatatcaaaattcctttagaatgtgtttcattaaagtaaaagggtcctgtgtttctgattttataaaatgttcttactttttccagcactgtttgcaaattgaagtgatttcctaatctttttgtgcccaaatgtatgagatattggtagactacatcagttttcacagatacctctttccttgaaggaaatgagggtaaaataccccattttgagtcagttatgtgtactttgtaccatattttctgttcacatttaaaattatacagctatgtctcaaggatgaaaaaagagttttacttatttttactattaatctctagtgtagaagtccagtttttcagacctataatcaggagtgcatttttaacaatttaccagttgaaataaatgggttatttcacattgtagggatattgttttagactggccattaaccttattttattttatttttattttaaaagatgttattgttattatttatctatgtatttatttctagaggcagggcctcgctctgtggcccaggctagggtgccatggcacaatcatagctcactgcagccttaatctcctgggctcaaatgatcctctggcctctcaagtagctggaaccacaggcgcatgccaccatgcctagctacttatttattaattaattattattttttaaataatattatttttaagagatggggtcttgctctgtcacccaggctggagtgcagtggcgccatcataactcactgcagtctcgatctcccaggctcaagcgatcctcctacctcagcctcctgagtagctgggactataggtgtgtgccaccactcccagctaatttttaaactttttgtagagacagcatcgtgctgtgcagtggtgctatctcggctcactgcaacctccgcctcctgggttctagtgattctcttgcttcagtctcccaagtagcggggattacaggtgcgcgccaccacacttggttagtttttgtatttttggtagagaaggggttttgccatgttggtcaggctggtatcgaactcctgactgacctcaagtgatccaccctcctcagcctcccaaagtgctgggattacaggcatgagccactgtgccaggccttaaaacacctagtgttaaaaatggtgtcttaattgtattctcagattctcctagaaagaaaagatatactaaatgtatatttagatatactaaaacacctaatgtttatttttgtttatttatttttgagatggagtctggctctgtcacctaggctggagtgaaatggtctatgtttgttttttcatcttgacagtaatatctttgaacattttctggagtattagatattattctcttgatgcttcaaggtatcttaacttcaccattgtattgcgatatattgttttggagagacagtataatataggattaagagtggaggctaggtggggcacagttgctcacgcctgtaatcccagcactttgggaggccgtggcaggcggattgcttgagcccaggcgttcgagaccagcctgggcaacatagggaaaccctgtctctacaaaaaatacaaaaattagctgagtgtgttggcacgtgcctgtagtcccagctactcaggaggctgaggtggaaggatcgcttgagcctggaaggttgaggctgcagtgagctgagatcacaccactgcactccaccctggatgagagagtgacagagtgagaccctgtcttgtccggaaaaaaaaaaaaagcctgtcttgtctggctcagtccaggtgctagactgtctaggtgggatcccagcccctctgcttactacttgtatgaccctgcgcagatttcatactcctctgtgcctcagttccttcaaatttctaaaatggggacaataacagtacctgtctcacaggattgttaatgatctaatacatgtacggtgtctggcagatagtaaacatacaataaaatgtagttacctttaatattttaatatattatttactgtaaaagtaattttaacatcctatataataaaattataaattacagttttgctgtactataaatttagtagactacaggatcaatatactaatcaatcaatacttgcaagcaatatttaaattctttaaaaaaattttttttggagacagggtcttgctccgtagcccaggctggagttgcaatggcacgatctcggctcactgcaacctctgcctccagggttcaagcgattctcatgcctcagccccccgagtagatggggttacaggcgtgtgccaccacacccggctaatttatttatttttagtagagatggggtttcgccatgttggccagcctggtctcaaactcctggcctcaggtgatctgtccgcttcagcctcccaaagtgctgggattacaggtttgagctaccgctcccggccctgccaccacgcccggcacaatacttaatttctaacttacaccatagaaaattggccggtgcggtggctcacgcctgtaatctcagcactttgggaggctgaggtgggtagattgcttgaattcaggagttccagaccagcctgggcaacaaggtgaaaccccatctctacaaaaattacaaaaaatagccaggtgtggtggcatgcgcctatagtcccagctactggggaggctaaagtgggggaattgcttgagcctgggaggttgaggctgcaatgagctgagatcatgccactgcagtccagcctgggtgacagagtgagaccctgtctcaaaaaaaaaaaaaaaaagaaaaaaaaagagaaagaaaatggaaaactcagattgagagggtcccccagtagcctatagtacacctacatatgctaacatggcatcttaaagctcattattacagctggcaaatcaaatcactgtgatgtgctcatcctatttccctatcaagaaaactcataacaatctgcttctgtaattagtgagccacagactctaggccatcgagattttccacattccctaattgtcaaatgctgaaccatacttgtactgaataagttgtgatacagtgtaagcaagggaaaaggccttatgtatgtctaacctactctgcaaatagctgcattcttacaaagttgtgtgtaaattgaatttttacaaagcatgtcagcactttgattagtacatttttattgtgtgcttattgcatattcagtgtttcctgtgagctatacaaagaagcataaggcatatgttccaatgtctagcaagagaaagaagtttaataccaagcagagagaaattaggtactactaaactatgaaactgattccagggtattcggaatttaaaaagaaagtggctaggagtatttgacatgatttttcatgaaggaggtgggacttcagttcatttacttactcaacagtgatttattgagtagccaccatgttcactggtggtatgatagtgaacagagcagatatggtcctgtttctgtggagtttacagactagtgaagtaatagaacttaaatatgtgcaagaaaacattctaggtgaggggaccagttctaaacaaagtcatagaaataaatgataagagcatggactatatggcaatcagtgaagggacttgcttgattgtagtagagattttatgttggggaggagcactgcaagtgatagatgcagaccatcttttgaatgctttgaagaactatttaagtctgtctaaaagtcctttggatacactgttctggagagggtttggggctttggggtcatactgccttggtttgatctcatctctactctaatttgtttaagtttagaattttatagtaagttttctcagtgacacaactctataggcaacaaactgatatttacagagtggttggggtcagtaacccttgtatcagttaagcaatgtacacatgaagtgccagtaggaagtccaaggaaaggttgggagaaataaaaggaggttagtaaaggaaagagaaataaatacattctgtgatagttggtagaatgtcatcagaaatgtcttcaagcaaaacaatacatttgcctgtcttttgtttctagttgcgtttaatggtagtgtgttttccttgtctaaatatgagaaagagaaactaaactgcagctacttgacgtgggcatctgagagctaccaatggttggcttaggttatgttctacatttgaagcatctggtcagttttagattgtcttctatatttgaagcatctggctagaccacttgtgtcccagttttctattttacctaaactcaacttggtcagaagcttatgtagtaagtattgtttgtaacctgtgttagtactctcttaacatggcttaaagcatgaatggattgtcaaatgaatacctgttatgacctgtattttttcttgttacctttggatttaatgtaagtataataatgctctaagaacatttgacagtattgttcaggcacttttttttttttttttttgagacagggtctggctttattgcctaggctggagtgcagtggcacgatcacagctcactgcagcctcaacctcctgggctcaagcaatcctcctacttcagcattccaagtagataggaccacaggcatgtgccaccatgcctggctaatttttaaaattttttttttgtagagacgggatcttactttgttgcccaggctggtcttgaactcctgggttcaagtgattctcctgcctcagcctccccaaagtgctaggagtacacaggcatgagccatcatgcatagctgcttattcaggtgcttttaagaaattttttccaccagaaaagtagaaatgatcataccagactacctttgtctcctcccaatcttttattatggtgatgtccaaccttgttataaggaggagcttcttttaatctcagagtcatgagatcagggcagatactgacagtatagttcctgagaagtagttgctggctgtgctgttcttcctttcccaatgggaatcttagctgagacatgtagcagagagaagacattatggggagccagcatggagctttataggaggtgaggtgtctagatctaccagtagatcccgatttgcaggtttgagactcctaccttatttcatccatggctgttgcattgtacaaatctagtgggcagcagccacagtctgtaaaaattatgacatggaattacacaatgtggcagccctggaaactacccaaaccacttctatttctagtcctgtattcccttcaatacctactacatccagcagccgtgatagtcccaacacgtttatcatttgactctctttgcctcccacttgaaggctcccctttaatccaacagataaaaattacatctttgtctaaggatttcaaggtgttgcataaattttcttattctatttaagtatactcatcaagaaaatgataataactgcctcgtctaattcataggtttttatcagtatcaagtggaataatgtatgcaaaaacttcataaattaaagaatactacacaaatataatattcttttcagatatattatgttgtggaaagaatactgaattccaatcagatgtctggcatctcagttctttctgctattaacaaactgtgactttggacaaattactttgtgctctggggactttgtttccttacctataagaggaaacttataatgccactcctatctacccagacacctaagagctactttttcctcacctccacattcagtcaccaaatttgttgtctagttcttaaaatttcttaagttggtcctgccctctctatctccattcagttcctaatcacttcccttttgggcagcagcctgttaaaaaaaattgtggtaaaatatgcataatataatattgactattttaacctttttttttgagacgaagtctcactctgtcacccaggatgcagtgcaatggtgtgatctctgctcactgcagcctccgcctcccaggctcaagcaattctcctgcctcagccccctgagtagctaagattacaggcacacgccacccctggctaatttttgtatttttagtggagacggggtttcaccatgttggccaggctggtgtcaagctcctgacctcaaatgatccacccgccttggcctcccaaagtgctgggattacaggcgtgagccactgtgtccggccccattttaaccatttttaaaggtacaagtcagtggcattgagtgcattctcagtgttgtacaatcatcactgttatgcatttccagatttttttcatcatcccaaactgaaactctgtacccattaaataatagcttctcattctgccttctctcaccccctggtaacctcattctactttctgtctctatgaatttacctattctaggtactttttgaaaaataatttcaacatttatttttgattcagagggtacatttgcaggtttgttacctggctatattgcatgatgctgaggttggggtacaattgatcctggcaatcaggtacagagcagagtgcacaatagtttttcaacccttgccccactccctccccacccagtagtccgcagtatctattgttgccatctttatgtctatgagtacccattttttttttttttgagacggaatctcgctctgtcgcccaggctggagtgcagtggtgtgatctcggctcactgcaagctctgcctctcgggttcatgccattctcctgtctcagcctcccgagtagctgggactacaggtgcccgccaccacgcctggctaattttttttgtatttttagtagagactgggtttcaacatgttagccaggatggtcttgatctcctgacctcgtgatccgcccacctcggcctcccaaagtgctgggattacaggcgtgagccaccgcgcccggctgagtacccattgtttagctaccacttataagtgagaacgtgtggtatttggttttctggtctgcgttagtttgcttaggataatggcctccagctgattccatgttgctgcaaaggacatgattttggtctttttttaatggctgcatagtattccatggtgtatatgtaccacattttctttatccaatccaccattgatgggcacctaggttgattctatgtctttattattgtgaatagtgctgcattaaacatagaagtgcatgtctctttttggtaggacaatttattttcttttggatatatactcagtaatgggattactgggtcgaattgagttctaagttctttgagaaatctctgtactgctttccaccacggctgaactaatttacattcccaccaacagtacctaagcatttctaggtacttttaataaatggaataatacaatatttgcccttttgtgtctggcttattttacctagcataatgtctcaaaatttcatccatgttgtagtatatgtgagaatttctttcctttttatggctgaataatattccattgttgggtaataacgttttaactggtcctcctaactccaggctttgccctatcaaatttgtccttcgtgatctgaccttacttacctttacaatctccttgttgttaccattcatgccatatgcctcagccataccagtggtggtccttaaatatggcatgctgtttgacaactctgtaactttattcatggctcttttgtctgaaatttatttccattcttctggagaactcctactcaatcttcaaggccgtttacctaacaatagtggatgggtgaaattatgatacgttcatatagtggacttctagtcagccttttaaaattatggcatatatattagtggttaaaagcacaggctctggaccaggcttactgggatcgaatttcaaatctgtcacttactaactatgtgaccttgggaaagttccttaccctctctgtatctcaattttttcatctatgaaacagggatagtaattgtatctatcccatcaggttgctgtgaacatttaattacttagaagtattagctaggccaggtgcagtgcctcacgcctgtaatcccagcactttgggagtcccaggcggatggatcacttgaagtcaggagtttgacaccagcctggccaacatggtgaaaccctgtctctactaaaaaatagataaaaattagccaggcttggtggtgggcacctgtaatcctaactacttgggagactgaggcaggagaatcacttgaacccaggaggcggagggtgtggtgagctgagatcacgctactgcactctagtctgggcaacagagctagattctgcctcaaaaaaataaaaataaaaataaaaatattagctattatgttttatttatttgttagtttttaaatttttcgtagagatggggtctcgctatgttgctcaggctgatcttgaactcctggcctcaagaagtcctcctgctttggcctctcaaagtgctgggattacaggcgtgagtcactgtgctcggtcaaaagtattagctattgttatatattaatatttactgtcatagaaaaatgtttattatatagtgttaaatgaaaagaaacatgctgtaaaatagaatagtatatcatttttgttaaaaatgtgtgtgttcttgggtgtggtggctcacgcctgtaatcccaacactttgggaggaccaggcaggagggttgcttgaggctgggagtttgagaccagcctgggcaatatagggagacctcatctctacaaaaaataaaaaattagctgggcatgtggtgcatgccttgagtcccagctactcaggaggctgaggtgagaggattgcttgagcctaggaagtcgaggccacagtgagctattactgtgccattgcactccagcctgggcaacagagtgagatcctgtctcaaaaaaatgtgtgtttatatgtagacacacatataataccctcctagacttacatacacacaccccaccccaccccacatacacaaccctcaacatgttagccttcattatttctcagtgatagaccaattggttgtttattttttatatttgcttatctgtatttcctgtttttctccatttgacatttatttcttacatttggggagcatgaaaaaagacacagttaaagcatctcttctgtgaagccttccctgatttcccttccttcgtcctttagggcaccagaataccttgcatccctgaactccttaaagcctgtattatattcatttacattttaatccccaactgggactagtgcagagcctaaaagatacatgaacttagccatattagtaaggtgaaaatggaattatgtgcaagcactttacacatgttatctcatatacagcactcagcagtctcatgagtaagagttatctgtgtttttcagatgaggaaactgagcatcagaagagaccaaacaatttgctgaaggtatacaacagtaagcaacagaatttggattcaaatccaagtctgtctgatgccaaaggtggtcttttcaatgtatattgaatgactgaatgatctaatgaatatatctgctgtctcagatgacataatttatgaaagacttattggtaaacaaatatgctatatgaatgtaaagatatgttgttgttattttctgctatattttcatctgcaccctagattctgactaggcaaatgagctttccttctccccatgcacaattttttccctctgttagtataaattggcaattttggctctccatttgtctttttatactgcccatgctctttccactctttaggaacctgactcataattatgatattaagcttttcagattaatctagccatgtccatcagatttactgttgtgtgtacatgttgagaaaactaattagaaagtatctggccagatacaatttgtttcagtgatgccaaagtatggtaattcctagtttaatgtgtttacctttttctttttttttctttctttctttttttttttttgagacagagtctgtttacctttttttgtgtgctgatatgtccacatttaatttcctacattcatattcataccgctttcaaaagaaggtgttgtcaatgataaaacattagacagaaatagtttttagacagaggatgttaataagttcagcctatgtcttatttaggtttatgtttttgtgtgtatgtgtgcacagccttcatcatttaagtttatgttttgtgtgtatgtgtatgcagccttcatcaaaagaaaaaaggcagatagtcaagaggtgttttaataatttatatcacagctacaacagaatatactaaaccaaaatttagaatttgattatagcttgactccctacaattttttcagaattaaaaagatgaatcccctttaaagcaaactaactgaagggaagcatctactttgtgaaaattgcctgtctaaaatggggtgggaaataactcccttttaagtaccgcacttttttttattctaccagaacctggtttctaaagatttcaacctatttttatagtctcagttttgtgagatgacaaagttcatcttagtgatttctaactaagaaagcacaaccacagaaacgaggaatggattctggaaagggaaacttcctgcaaattatgatgaatttacagaaatagtaaatatttaaattccataaatagttaatattgttgttgataattatttgtcttgatttctgttcaagaagtatacatttgaattagcacacagtttattttattcctagcaatttagtatatttttcatagccatcaatatttgggattctgcttgcttatgattacaaatcacttgaaacctgccagttgaaaattctcaagggtgtgaaatgatatgggccttcagtgaattcattcccctttatctgtataaaatacctggctaaacagttgtctttgacaattttaaattactgtttcctttcttaaaaactcctttccagaagctgatctcccgtacatttccagtacataatttttcatccttatctgtcctgacagtgattcagctttgaataagagagaatgttaccagagtttcacctttattggcctaagtctttgtttattttttgagacagagtcttgctctgtcgcctaggctggagtgcagtggcatgatctcggctcactgcaacttctgcctcccgggttcaagtgattctcctgcctcagcctcccgagtagctgggactgcaggaacgcgccaccacgcccagcttatttttgtattttgggtagagacggggtttcgccatgttggccaggctggtctcgaactcctgacctcaggtgatccacccacctcggcctcccaaagtgctggaattacaggcatgagccactacgcccagccagcctaaatctttaaaacaggacatgaaaggaattgaagggttgggtatgggtggggttgtagatctagactatatttatggaatgtttgcttccttcgtgctgaaaattgttctttggaccttgggatgaaaagagaaaatatatgaaaaataagaatgttatgaaaagtctaagtattctgaaaaatacattagtatactactttataatcataccatataaatatttcagctataaaaattaatgcaaaataaattttctcccaatatgttaactgctttaaaaaaaagtattggcaagattgattatattctttcctaagaggaaagataactttgcataatcaccaagatggtttaccaacatacaccacgtatactgagtattacagtcttcaccaacatgagtcaaatgctagcgtgtatagggttggtagtataaacctacctggtacctttttggttttgctgactaaatggtgctaatgaagccagggttatagacttcatctctgtgggagtcacttgttctttggagtcattaggtatgccactaactctgctccacagttttccgaatgcagtttgttcattaagaaagggaggctagtacagagtaaaaatagctcagcaaaaagccatcatcagtacccatgcccttagcctcctgatagggggaggagggtctttaatgtccaggctttcaaactcacatatacatttttattattaatcagtggaggctgcacttagaaatttatttctttggacttctgcaatattctgcttataaagtgtttctgtggtttcaactgtagatccctttttgcctttatctccagactcttttgtctcaaaactttatggtctcagagaactaaggaaagacttggctcactatatgcatttgcagaaagtaataaggctttttttttttttaacgccataaagtgatctcagcaaagtgacaaatctacagtttcagaactgaaactaaacaactctttcgtggtttattagactcttctatattaagtagagcagttttaggtgagcctctgggaatctcatgaaactgagcttccagtgtggctcatagtcgtttgtaatctatacaaatctatagtatctttcattgagtatcattaaagaatgaggtattttgcagaagtgaatttccaaataactgaagtataccctttacatttttgtcattcagggatctgatgcatgcatcctacaaaggcatccttgaaatacatttacttttccaaaataaaaatacttttatttctgattagaacattgataaatggtcaatgtaaaaacaaaatctagtcaatatttatttatttatttatttgagacagagtctcattctgtcgcccaggcagtgggggcaatctcagcccactgcaacctctgcctcccaggttcaaatgattctcctgcctcagcctcctgagtagctggggcaacaggcgtccaccaccacacccggctaatttttgtatttttagtagagacagggtttcgccacattggccaggctggtctcaatctcctgacctcaagtcatccacccaccttggcctcccaaagtgctgggattataggcatgagccaccacgcccagccccagtcaatatttagatatctctcctttctgagatttattttttcttacagcatttatcactacttgacttttgcaatttttttttttttgagatggagtcttgctctgtcacccaggctagaatgcagtggcgcaatctcagctcactgcaacctccacctccccagttcaagtgattctcctgcctcagccccccaagtagctgggattacaggtgcacaccaccatacccagctaatttttgtgttttcagtagagacggggtgtcaccatgttggccaggctgatcttgaactcttgacctcaagtgatcctcctgcctcagcctcccaaagttccaggattacaggcatgagccactgcgcctggctcactacttgattttatacattcctttgtttgcttattgtccatctccctcaagagaatatgagccccatgaaagaagagacagtgcccctcttcactgctgtatcaccagcacgtagattagtacctgaaacataatgggacttcaataaatatgtgctaactaaatgaagaaagtagaaatcactcttaattccaccatccagggattagccactgttaagattctggtatcatttctttctttttttttcttttttaaagagcaaccctattaactgatctggtatgatttctaacaaaagttttttctcttacatacacattctcatgtgtatatataaatttatacaacattttaatagaaataggactatcgtcaattgtttgtagcctcttttttcacttaactcatcacagacatgatgtcattaagcaaacaattatgtgtttttaatggagatatgataatatatttgaccaattctgtattgatatttaggttggttccagtttttcaatcacataaacaaccttgtgataagcatccttagccatacatcttagtacagttgtctgtacctttcctcccctttgaatatattcttagaactggaatttctgggttaaaaggtatgcattttttttattatactttaagttctagggtacatgtgcacaatgtgcaggtttgttacatacgtatacatgcgccatgttggtgtgctgcacccattaactcgtcatttacattaggtatatctcctaatgctatccctccccccatcccacaacaggccccggtgtgtgatgttccccttcgtgggtccaagtgttcttattgttcagttcccacctatgagtgagaacatgcggtgtttggtttttttgtccttgcgatagtttgctgagaatgatggtttccagcttcatccatgtccctgcaaaggacatgaactcatcaaaaggtatgtatattttaaggctttttttgagacggggtctcactctgtcacccagactggagtgcagagcttcaattatggctcactgcagcctcaagtgatcctcctacctcagcctcacgagtagctgggactacaggtatgcaccaccacacccggctaatttaaaaattttttgtagggacagggtcttactatattgcccaggctgcctattttaaggcttttgataaatattgccaacttgtcttttggaaactctgtagggattggtgttagtttatactaccatcagcagtatatcatagttcgttaactcaaaactattttgatattaatgattttgaaaaaaaagactttctaaaacacattaagtatttttagtgctttattgcttttctaagcagaatacctgtacctgatttaattataacacacatacacacacacacacactcatatatatatatgacatgacatgtgctcgacctgttattgctcactgtccttgagttgagagtagtgttcttccttctaccactgcctccatggggcagagaggtcctttccagagctgagaatgtcagtaagagatatatgttccttggcatcttgacttcctaattggaatttactatatgtttccccacacgaaacagtgttatagcactattaatatatagtccaactgtgctattgtctaaactcctaagaaatggacctttgaacctagccatcatttataaagttgttcttatgagaaaacatgtttcatcttcaaaattgagaaacaactgttcaagaaacccatttttaaattgaaggtacacattcaaaaagtatatattgagggcttattgtatgtgtgaagataaatgtgctaggccgtcaatgggtaattcttttcttgatgatgcaatgttaaggtacccctgccccctagtcatcattttggtcaggtcaggacaaccagttgcaattgtaacccagggagaaaatattactggagtgtgtttgctaggcaggggaccacgtacaagggtttctgcagaactttggaggccaggattgaaggaatagctgctcagaagaggtagaagagaaaaacatacaggaaatggtaaggaagtgggaaagttggaaagattaatgtgtttcttttagattaaggggagaagagggtactgtttgtcttctcgagatgagtgaggatggacattcaggctgacattctgccatcaaaatgccttgtgtaggaatattagtctttgcatataacttaacaaagctgacctgccattgttgtgtttttgcttgaggacagtgccacactgctgctgccatgtacccaaagaattgcttgaacccatccccttcattacttcaactctaatgactattacttttcattaatttaggctgtattcttttcagacaacgtaaggtaggggaaaagagcctactttttggaatctcagaggcctgagttagagtcagattctatcattcattaacttatttgtattaggcaaaggagctctcactatgtcttcgaacttgaatcttctctagaaggagaaaagttttatgtgattattaggattaaagtgtttaaaatgtctggagtatgataggaacgaaataaattttaatttgtttcttttctttttctttttttttttttttgagacagggtctcattatgttgcccaggctggtcttgaactcccgggctcaagcaatcctcccgctttggcctcccaaatttctgtgattacaggcatgagccactgtgctcagctaaatcttaatttcttttattctcctctcctccacctcattttccacccactaccagaatcatcttctattttaaaaatctgcgtctgaaagaataacattataaaagtagtatattgaggttaaacgtggccacctggccatatgtttagctctcgtccttcacaaaactccattaatgtgacagtgaaaagattttaaaaaggttacacctgcaaggaaaagaaaacaggagagctaaatcagcagagggatgaatttaatatatttttggaagataagaagcacatgaagagggagaaccttccagcagaggaggatattaatgagaagtgagctctttaatctcacattacccatgataggctcagaatttgaaggtaagttgtttatcctgaaaggtgaagaagagacccagggctgaaaataagggaaatgttttaaaaactgaacaggaagggattggacctcttagtttttctcaggagaccaggagtatagtctcagtactaagtgaatctgaaaggctctgagctcctggacagtggggtagagtggaggatactaaagcattgggttgagaacagggaaattcagtggaagtctgcatactgcgtggtcagccccttccccacaccttgctcccaaatatagcagcaaatataccttgctttgcagataggagattggagaattcttttcttggaaaatgaatgatcccagagaaaagaattccagatggtaacatgatagggttccgcaatgaaaaagatagctagctgccattcactcaatactgaaatgcatagtggttaaaggcatgggctctagagttaggcttcctgagtttgaactcagacttaactacttaccagctatatgaccttgggcaagttacttaacctatttgttcctcagtattcccatctttaggatggggaaaattatgtttacctcaagattgttgtaaaggttaaatgagttaacaaagcactgctgatggtaagctctggtaaatactagctgaggaaggaggaagtacccagggacttccttagctgtcaaaggcagctctcgactttagatcatgccccaatggtgaccagcagccttttctacataggtggtacatggggtctgaacaggggctttgaccccacagaagacacctttccccagttcctctctctcattcttaactctgtcttttaggaacattctttttttttttttttttttttacctttttttttattttttattttttattgatcattcttgggtgtttctcgcagagggggatttggcagggtcataggacaatagtggagggaaggtcagcagataagcaagtgaacaaaggtctctggttttcctaggcagaggaccctgtggccttcctcagtgtttgtgtccctgggtacttgagattagggagtggtgatgattgttaacgagcatgctgccttcaagcatctgtttaacaaagcacatcttgcaccgcccttaatccattcaactctgagtggacacagcacatgtttcagagagcacagggttgggggtaaggtcaccgatgagcaggatcccaaggcagaagaatttttcttagtacggaacaaaatgaaaagtctcccatgtctacttctttctacacagacacggcaaccatccgatttctcaatcttttccccacctttcctccctttctattccacaaaaccgccattgtcatcccggcccgttctcaatgagctgttgggtacacctcccagagggggtggtggccgggcagaggggctcctcacatcccagtaggggcggccgggcagaggcgcccctcacctcccggacggggcggctggccgggcggggggctgacccgcccacctccctcccggacggggtggctggccaggcagaggggctcctcacttcccagtaggggcggctgggcagaggcacccctcacctcccggacggggcggctggccgggtggggggctgaccccccccacctccctcctggacggggcggctggccgggcggggggctgaccccccccacctccctcccggacggggcggctggccgggcagaggggctcctcacttcccagtaggggcggccgggcagaggcgcccctcacctcccggaccgggcggctggctgggcggggggctgacccccccacctccctcccggacggggcggctggctgagcggggggctgacccccccacctccctcctggacggggcggctggcctggcgggggctgacccccacctccctcccggatggggtggctgccgggcggagacgctcctcacttcccagacggggtggctgctgggcggaggggctcctcacttctcagatggggcagttgccgggcggagggtctcctcacttctcagatggggcggccgggcagagacgctcctcacctcccagacggggtcgcggccgggcagaggcgctcctcacatcccagacggggcggcggggcagaggtgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagagcggctcctcacgtcccagacgatgggcggccgggcagagacactcctcacttcccagacggggtggcggccgggcagaggctgcaatctcggcactttgggaggccaaggcaggcggctgggaggtggaggttgtagcgagccgcgatcacgccactgcactccagcctgggcaccattgagcactgagtgaaccagactccgtctgcaaacccggcacctcgggaggccgaggctggcagatcactcgcggttaggagctggagaccagcccggccaacacagcgaaaccccgtctccacgaaaaaagtatgaaaaccagtcaggtgtggcagcgcgcgcctgcaatcgcaggcactcggcaggctgaggcaggagaatcaggcagggaggttgcagtgagccgagatggcagcagtacagtccagcttcggctcggcattagagggagaccgtggaaagagagggagagggggaccgtggggagagggagagggagagggagagggagagagcaggaacattcttaagactgtctccaactgcagcattgaactcttactgttcattttttcaataaatgtttattaggtgcctactctgtgcaagtactgctcaagctgctggaatgacagcagtgaaccaggtctgtcataatagctaacatttactgaatgcttactgtgtgctttacatgtattaagttgttgaattctcgaaacaaccctctgaaacagatgatgttatgatctctgttttacagataaggaaactgaggcacagagattaaatagcttgccaaggccacacagctagcaagcagcagagataggaatcaaatccagacagtcttgctcttgagtctgtttaaaaaaaactgtagagacaggggtcttgctgtgttacccaggctggactggaacttgagtctgtttttaaccattatgcctccctgttctcatggagcttatgttctggaagtgggagactgacagtaaataagtaaacaaagaaaatagagaccaagtagcaataggtggtaccaattgagtatcccttatcagaaatgcttaggaccggaagtgtttcggatttcggaatttttggattttggaatattagcatatatgtaatgagatatcttggggatgggactcaggtttaaacatgacattcatttatgtttcatctataacttgtacacatagcctgaagttaattttattaatattttaaataattttgtgcatgaaacaaagtttgtgtacaatataccattagaaagcaaaggtgtcactatctcagccacccatgtggacaatctgtgatcgacctaaccattgttcctgactctgaatttatatgctactggtaagcaatcattttcttgcacttattcacataactgtaaattttaatcaattaaaaaacatgacataccattaatacagtgaaaaaacaaggtgttcagggtagcaagcagtacagtagcatcaccagagttccttttttagctgttaaaccacagcaacaaacaacagcaagttttcagtctctacttatgatactgtgttttgattaaaagattactatatactatattttatgtttttaggtgaaaagaaacattagaagtaggtcctgtagggatgaggaggcattctgctgtatggctttttaaaatgtcttttctaggccaggcgtgatggctcatgtctgtagtcccagcactttgggaggccgaggcaggaggattgcttgagctcacgaggttgagaccagcctgggcaacatagcaagacctcgtctctcctaaacatttaaaaaaaaattagctgggcgtggtggcacacacctgtagtcccagctacttgggatgctgaggtgggaggattgattgagcccagaaatttgaggctgcagtgagctatgttaacaccactgtactctagcctgggtgatagagcaagaccctgtatcgaaaaaaaaccctgaagtttcctctacagtcttctgcctcattaacaatggttttttcttagaagtctctctttgatattttggacagatatgatgtcttgttctgttatgaatgcacgcaggtacattgcagctgaagggagctgggagggcctttttttcccccttagggatgctgaataaactgttgtgtgcctgcattttgattgcaacccatcacatgaggtcggggtggaatttctcaactcgtggcatcatgttagcactctaaaagtttcagattttggagcatttgaggttttagattttcaaattaggaatgctcaacctgtctgataacatataaaacaagggattgtgatacagagggactggcagagggtagcattagttggggtggtcaatgtttatgagcaccaagtgagataagttatagttttttttttttttttaaacagccttactctgttgcacaggctggagtgtagtggtgtgatctagtgtcagcccccagagtagctgggactgcaggtgtgcaccaccacacctggcttttttttgtgtgtgtgtcttttgtaaagatggcattttaccatgttgcccaggctggtcttgaactactgggcttgagcaatccccctgcgttggcctcccaaatgcgggattacaggcatgagccaccacgcttggctgagttctttaagaattaattacttagagtattgctgtctctgcagatttgcaaaatgccctttctatgatttgatttataatgctactcccacacgttttaatattactaataaaaagcaggaatagttcatgtgcactggtgtcttactgtgtatgagggactatactaagcaatttatatagattgtttcattttatgctcatagcaatgctataacaattcttttctttttcagtcatggaaaactaaagcttaaggagacaagtgacaggcccagggctttaaatttagcaagtggcagagccaggatttgaacagaggtagcctgattccagaaccactgctgttaaatacttaactattttattgatgaagtgatatgtgcaaggtaattctttttataaaaaatagctgacttttatagagatttaaaatattgtaagcattactgggtcttcacagtaacagtgaagcttacctatattttggaggcttcaagacaggacataaacaatacattttgagtaaagaagcttctagggttgtatgattttatcaccccaaattagcaattttgttcatatgaactaagatgcgtaagattctttagcacaaagccagagccaggatttgacaccaggccagttgacttaagatgtagagctgttacccattccactgcagagtaaatgataacatgtagcttatctttgttcaaggtactgtgggaagccaatctagtgaaattacattttaacagtccccaaggaatgtttgttaaataatttttagttttttaaaacttctaaatttctcaaaacaaaagctgagtgaagacagttttattttacagacttggagacagtatggagcagtggcccagagtgagagttcttgggtcagattgtctggtggcttacgctaattttcacttcttgatttaactgattcaagtattaatataattttgaacaggcaaccttgccctccaagtcttagttcccttaattgtgaaagaagctaatatagtatcttcctcataggataagtatgaggactaaatgagacaacctctctacaaagtgcaaggcatggtgccttttggccagccatctcttctcttggaaatggacccctcattcatcattcatgaatccaaagtgaagttttggctccattgccttggttttatcagtgcctgaagtattcttctgacaaatagtgtgcatgaacttagagtatagactttcctgacatatttttgttgctcactttcaagttttaaaaacttacagtaaaatacacataccataaaatttaccatttaaaccatgtttaactataccagttctatggcattaagtatagccatactgttgtgcaaccatcactaccatccacctccagaactttcttcatcttcccaaactgaaactctatacccattaaacaacactagtggcagtttttgcttattattcttagctttgtgaccaaggctgctagttaggagaaatgttactctgtttgtacaaagaaagactttgaaagaaatgtgattagaaatctatattatcccaaaagcataatccataaatgaaaaaatggatatactggacttaattaaaatgaaagcttttgctctgtgaaagaaagtgaaaagacaagccataaactaggagaagatattttaaatcaaatttttgtttaagagatgcagtctgtgttctccaggctggacttgaactcctggcctcaagccatcctcttaccacagcctcctgaatagctgggactacaagtatgtgccactgtgcccagctgcaaatcacatttttgacaaagacttgtatccataataaacttttaaaagcctccaaatttaacaatgaggaaacaaccaaataacaaaatgggtaaaagatgtgaataggcacttcacctagaagatatgaaaatagcaaataaaggaaatgcagattaggcagatgaaaattaaaaccaaaataacaattataacaaatgtaccactctggtatgtgatgttgctaacgagggaggttgtatgtatatggtggtaggaggtatttgtgaaatctctgtactttctgcccaattttgttgtgatcctaaacatcatctataaataaaattaaagtgagataccactgtacacttaaagcggaaataccagttgttggcaagtgtgcagagcaactggaacttttatacgtttctgatgggaatacaaaatgatactgccactttggaaaacagtttgccagcagtttcttatgaaattaaacctgtatctccaatatgactcagcaatcctacttctagatatctctccaagagaaatgaaaacctgtgtttacacaaaaacctgtatatcaatgtttatagtagcattgttcagcattagtcactaaaaattggaaacaacccagttctttcaactggtgaaaaagatgaatagattgttgtatttttataccatggaatatactccttgattcgtgcaataacagattaatcttaaaatgcattttgctaggtgaaagacaccagatacaaaaggctatgtatcatttcatttatccacttatatgaataatcattccatttatataaaaatctgaaaaagcaaaactatagggaggaaaacagtggatgccagggtttgggggtatagggaagtattggttataaaataaaggcatggcatgagggattttggaggtgatgggatggttctctctctctctctctctctcacacacacacacacacacacacatacacacacacacacaccccactacccctctctctctcgccaattgtcaccaaattgatgggcatgttgtcagtgttaatatttggtctggtgtactaattaccacccctcccaaaatctatattatcagcttggtagcatatatagtacaatttcattaaagaaaataaatgatgatttattaactaatatgtcacatgaaaagtcatagaatgtgtattttagtttaaaaatatgggtatggatatacacacacacatttatttatcgtaagcgtcttactttactggaatttgctggttataccagataaactttttccactgcttgagctttcagtagaccattgtgcaagttaatgataaatttcgtgagcataacacctacttaagtttctcagaatctgttacagaaaagcatttatcttgcggttcaggcagcctgggatggaaggtaaatgctttctttttataagtatcctgaaatttcaagtgtaatagggaacaagatattaacataaattttcaaaaggcctcattcagttctagttccttttttttctttacaaacttaaatctcttcataaccatcagatgccataccacccttgtgaaacagtctgctagaactagacatgtctcaggattcttagaggactggggtaaccaaagtgggatttgaacttgtttgaggaatatacatgggtagtgagctgaaccttttaattcctagaatttatgggtttaacactacaagggttgtcaccctgtttatttctgtaaataattaaggcatgtttattgtagaaaacttcacaatgcacagcacagattataagagtactaccaggattattactcctaagataactgtttatttagttttccaaactttgctacgtaggtatatacatgtgtgtctgtccatgtctccttttaaaaacaacaaaaaaacctcattttaatattcaatatattattgactgtctttgtatgtgagaaaatttaaatataatagttgtgtattctactgaatatatggaatattatttattttaccaattcccattttattagtcttttaacttatatccacttattttggctgggcgtggtggctcacacctgtaatcctagcactttgggaggccgaggcaagtggacaacttcagtccaggagttcgagatcagcctggccaacatggcaaaaccctgtctctactaaaaatacaaagaattagctgggtgtggtggtgtgtgcttgtaatcccagctactcaggaggctgaggcacgagaattacttgaacttgggaggcggaagttgcagtgaactgagattgcaccactgcactccagcctgggtgacagagcaagacactgtctcaaaaaaaaaaaaagtacatatatccacttatttttgctctgatgaatattcctatattagtatctttgagtatctttccattatccctccatttatttccttaggatatattcctgaaagcagtatggccgggtcagagagtggcactttttaaaaacttattttttattatcaaagtagtatatatgctcatagtaatgagaagacacaaggtgcaaaaaggtacaaggtaaacagaaaatgctctgacttaacagttcccctctcagaggaactgtaaaataaacagatatacatttacattaatttatacattctatagaaaattcatgtgtgttagatgatatatttgttttcttgaaacatccactctaattacagagtttactaaggttacagagttaatatagagaggtattagagagtttaataaggttggcagttaaatatatcaaaattatgcagttatacaattatatcacatatacaccaacaataatcatctagacaatataatgaaaaaagctcttattcgtatatatcttcttattaagtttattccttagtatttttttttgttttttgggggggaccccccaaaaacaaaaaaatactaaggaataaatttaagaaatgtgcagtaagattcaatattgtaaaaagaggttaactctatttaagttagtctataaatttaagagattttgatggagggaggatctgacacaatgatgttaaggttcatatgaaagagtaaatatttgaaaacacacagagaaattctgaaaaagaaggatgacaagggggatgtgccttattagacaaaaaaatgcattaaaatgtacaacaattttaaaaagtaacattgtacctaatatattgtacacttaaatatgtgttaagagggtaactctcatggtaagtgtttttactccaataaataaaattttaaagaatttcttcatcccccctccaaaagtactggcaccaaaatagaataacaaatcaatgcaagaaaacatccagaaagagacccccaaataaaaatttagtatactgtatatttaatagtggtagcttttcaggtagatgaggaaagagtggcttacttaacaaatggcattgggacaatcagttaatgattttgaagaaaaaaagttagtttcttatgttatatacttaaactaaaataaattctagatgagttaaggatgtaaatgtaaagtacaaaaggtactagaagagagtgtaagttgaggtaaggaaggccttccaaagcctgacaccaaaggcatggtacttaaaaattaaaaaaccccacaaacagataaaagataaacaagaaacttaaaaaagactaacaatatgtgacaggtaaatgatgaatatctttaatatgcaaagatctcttacctatctgtaacaaaaaaggtaaacacccaaaataaaaatgcacaatggaagtaaacaggcagttcacaaatgaagaatacaaatggtcaaaaaatctcacaaagttattggagataaaaaacagatgatcatttttcacataacagattgacaaagcttaaaaagaattttcatagtacctgataaaagtgtggctagacactttcctatactgctagtgtaagtgtgaaatgatatctttccagagggtaatttacagtatgtatcacaagccttaagaagtactatttatatttagaacatgtggaaaaataaaaaataaataagtactatttatatatgttgttagtgggtatataaattgatacagtttttctggagggcagtttggaactatttatcaaagtttagaatgtacatgccctttgtcctagcaataacacttccaggaattttatctaaaagatatgctcatgaagatgtatatacaaggatattcattgaagcagggtttataatagcacaaaactgaaaacaacctaaatgttaatcaaaaaggaactaattaaataaaatatagcatatccacataagggaatattacaaccattttataaaatggtacgtttatctatcttctttggggatagttcagttttgttttttattgtggaggtctatatgtccttaaaatttttttttctttttaataattagagatgaggtctcactatgttgcccaggctggtcttgaactcctggcctcaagtgatccttggcttctcaaagtgctgcgattacaggcatgagtcactgcacctggcaggaggtttatatgtcttgatacaaggtgtaaaagatatgttaaatggaaaatgcaaggtgcaaaatagtacatatagtatgatcccatgtgtgtaaagaagaaaaaatagggaagatgggcattacagaggctttaaaatgcactgggaataataaagttttcatttttatctttagagtatagttcatgagtgaattcttttccattttttttcccagttatcttaaaagctctgttgattgtggatctgagaactaacatcacatgttataaaatccaaatagaaaatatatttaaattattagacaatttaaagcttatgagaacataagaataaaattactgcattcctttgcttattaattaagtatatcacactaacagaatttatttctgtgggaacaatgttaactcataggacccagatggaaatgatatgccagggtagagattcagatctttgagccttttgagtagatttttctcagaaaaagaaagatgttctctcaggtttactatttttaggcagattgagatgaccatattgtcttagttatccaggcagtctgacctctaagacctctaacgttattttgcccaatgcagattgattggtatttgttgttgttggattgagtctaaaaaagaatattttctcaactccaaaccatcatattatcttctaatatcaaaatcttcatttaacatactaacctctgtaattgctcatccatggggttttaatgtaacttacccatgtcttgttcctaatttgataaattttctatattactagttttggagtagaagatttaattcaaatgttacaaattcctttgtcctaaatctatccccaaagtcagaacaggacatgctgttttcctcaaccagtttaggaactccttttttttttgcggggggggtaggggagcggacagcatctagctctgttacccaggctggagtgcagtggggcgagcatggcttactgcagccttgaccgggtcccaagtgatcctcctgtctcagcctcctgtgtagctgggaccacagtcacgtgccactatgactggctaattttttttattttttgtagagacgagggtctcattttgttgtccaggctggtcttgaacacctgtgctcaagcagtcctctcaccttggcctcccaaagtgttgggattacaggcatgagccaccgcatccagccctctttctctgaaagtattattttcttttcacaaatggatttttctagcttttgttttttgtttatttatttattttttgagacacagtcttgctctgtcacccaggctggagagcagtggcatgatctcggctgactgcaaacaccacctcccagtttcaagcgattcttgattctcgtgcctcagtctcctgagtagctgggattacaggcaagcaccaccacacctggcaactttttgtatttttttagtagcaacggggtttcaccatggccaggctggtctcgaactcctgacctcaggtgatccacctgtgttggggcctcccaaagtgctgggattacaggcatgagtcaatgtgccctgcctttctaagcttttaaactaattatagtgagacttgttggtgctgctttttaaaaattatccttttatgattgaagaaaactgtctgattttctttttgattctcttataaatttaagattaatcttacagatttgaaaattaaagaatcacattctgctaattattttagtgcccagcactaaaagaattccttttttggtatgttttctgtcagccctctcttactgttgttttcttcacttccttaattgcagtttcctctttgttatctttaacctttgctcatttctgcctttaaacaggaactgtatatgacctgcttaatcttgggtttgggaaaaagctatctacaaatgtccaaagctatagaagacaataaatgcatccaattcagacaaagaaaatgtttggctaatttcagcattttcttaattattttcctgaataataaagtaatacatgcaaaaaataaaaataagaaattaaaaaaataaaaaatacatgcttgttttaatgaaactaaagtaatatagaattacataaagtaaaaagatagtcactccctcaaagggtaatcactattaatagcttgtattcttctagaccctttactagtcacagatatgcttccatgtcagtatatgcagatttagcttcttgttcttaactgctgtatagtattctatagtatggatgcaccataatttatttatctattccctaattgataggcatttagagagtctccaaattttaactattttagatatgcttatacctataactttatacatctgtgtaagtatttttgtagctagattcttttaagtaaaattgctgggtcaagttaggtacacatcatatgttgataagtattgcaaatttgcctttcaaaaaaggccgtagtgatttacacttcattaacagtatgataaaatatttttctatacccttgaccatgcttaatagatacataagtcttttaaatttttgccaacattataagaaaaaaacacgatgtcattgttttagtttgtatttaaatttctcaaatttgtgtttttaactagtttagttgaacatcttgtaacaactacattatatgtcaaataaaaaagtttgtaaattagagcatatgctataaaccttcagcaagaaaaaagtgtacacagaagaaagtttgtaattgtttatccctctttttctgcatatgtttgggataaagtaacataatatatgaactgatcatcttttcaggtgcctataaagaactcccaactggtagactttagcatctgttgggatgataggccaagtgatatttttaatttaaaatttttttagagacagggtctctagctcaggctggagtgcagtgacatgatcatagctcaccgtaacctcgaactcctgggctcaggtgatccttcctcagcctctggagtagttgggactacaggtgcactaccacgctcagataattttttttaaaaagtttatttaaagacgggacctttctgtgttgcccaggctgatcttgaatgccaatcctctagtgatcctcctgtgcccggccccaagtggctcttttctaccctgctctctcacttgttgtctggctgaacaggctcaagtctgccagtgaaagtgacttagctttgtggacagttgtgtcattcctcagtatggtatgtatgtatgtatgtatgtatgtgtgtatttatttatttatttatttatttatttatttgtgatggagtcttgctcttgttgcccaggctggagtgcactggcacaatcttggctcactgcaacctctgcctcccaggttcaagcaattctcttgcctctgcctcccaagtagctgggattacaggcgcctgccaccacacccagctaatttttgtatttttaattgaaatggagtttcaccatgttggccaggctggtcttgaattcctgacctcaggtgatctgcctgcctcagcctcagcctcccaaagtgctgggactacaggcataagccaccacgcctggccgaggatgttatttaatgttttgttttgttttgttttattgagataagatctgactctgtcacccaggctggagtgcagtggtgacattttggctcactgcaaccactgcctgcctggctcaggtgatcctcccacctcagcctcctgaatagctgggaccacagtcattcactaccacacccaactaacttttttgtattttttgtagaggcggtgtttcgccatgttgccccggctggtctcaaattcccagactcaagcgatctgcccactttggcctcccaaagtgctgggtttacaggtgtgagccactatgcctggcctggcaattatctttgactttataaatctttcttatattttagataactgatatagctcactactatttaatgtttatctgccttgataactctttatgttgtgtttataggccagagtccctgtagacacatgtactaattgaccagaattacacaataaaattgcagagctacatagtagcagaatagtaatttgccaaattattttaataggtcaatactgaaaggataatattatttgctgacttttattaagacctatattaagattctatagtgttatatttctaaggttacaagtttttttcaagaataaaaatatatgtttaattatgagttttactgttcatccaaaggtgtaacataaaataaatttacaggtgggataagatggattgagttacaattttttaacctcaggatctttgatggctagttcctacccctaaggtcatcttatgtgttcatatgcggtaatgcttttttcattagattttgcatttcaatcacagacatatttgtcaaaaaagatgaggtaggctggacactgtgactcacacctgtaatcacagcactttgggagacctaagtgtgaggactgcttgagtccaggaatttgatgccagcctgggcaacatagtgagaccccatctctacaaacaaatccaaaacttagcaaggtgttggtggcacgtgtctgtaatcccagctactcaggaggctgaggcaggagaatcacttgaacccgggaggcagatcgcagtgagccgagattgcgccattgcactccagcctgggtgacagggcgagactctgtctcaaaaaaaaaaaaaaaaaattccatttccttttttatatccattctaaaaataagcatatgatgagccaagaacatccactaatgaccagttgttacatccttttatcttgatccctttgaactcattccaagttattgtactaacctattaagctgattgttcatgaaatagaaatcaaagccaattatttcacatttaaagtatatataacaaccagttcttgccagaaaatcagaagagagggcaaagtcaagaaaaattataaaaatacattacaaatgaaataaaataacaaggaaatgactgacaatgaaatgtatctttccatttattcatagttaattttgattcttcaattcttcattgaaatttctgaaatataaaaaataagtgtattaccacttcacatccactaggatggctattactaaaaaaaaaaaaaaaaaaaaacctcagaaaatatcaagtgttggcgagaaactggaactcttgtgcattgttgataaaatgtaaaatggtccagtcatggtggaaaacagtatggtggttcctaaaaatattaaatatagaattaccacatgatctagcagctccacttctggacgtatacccaaaacaatttgaagtagggatttcaacagatatttgtataccagtgttcattgcagcattattcatagtagcccaaaggtggtagcagcccaaatgtccatcaacagatgaatgaataaacacaatgtggtatgaatatgtatatatgatataatagaacattagctttaaaaaggaattaaattctgacacatgatactacatgggtgaactttgaatgtgttatgctaaatgaaataagccagccacaataggacaaatattatatgagtttacttatgtggagtacctagagtagttaaaatcatagagatataaagtagtaccgtggttaccagggtctgaaggggagggagaatagggagttattttttaataggtacaaaatttgaatttgggaagatgaaaaagttctgaagacagatggtggcgatggttgcacaacaatatgcatgtacttaattccactaaattttacatataaaaatggttaaaatggtaaattttatgttattgtgtattttaccacatttttttttttttgagacagagtcttgctcttgtagcccagactggagggcaatggcacaatcttggctcactgcaacctccgtctcccgggttcaagtgattctcctgcctcagcctcctgagtagctgggattacaggcgcccatcaccacacctggctaatttttgtatttttagtagagacgggtttcgccatgttggccaggctggtctcgaactcctgacctcgtgatctgtccgcctcggcctcccaaaatgctgggattacaggcatgagccaccatgcctggccaatttttttttttttttttttgcgacagagtttcgctcttgttgcccaagctggagtgcaatggtgcgatctcagctcactgcaacctctgtctcctgggttcaagcgattctcctgcctcagcctcctgagtagctgggattacaggtgtgtgccaccacacccagctaattttttgtatttttagtagaaacggggttttaccatgttagccaggctggtttggaactcctgacctcaggtgatcgccctcttcagcctcccagagtgctgggattacaggcgtgagccaccatgcctggccattttaccacaatttaaaaatatttatttatttatttatttatttatttatttatttatttattcattcattcattcattcattcgttcattcattcattcattcaagacggagtcttgctctgtcacccaggctggagtgcagttgcacgatctcgactcactgcaagctccacctcccaggttcatgccattcttctgcctcagcctcctgtaatggctggaactacaggcgcccatcactacgccccgctaatgtttttgtatttttagtagacggggtttcaccgtgttagccaggaaggtctcgatctcctgacctcgtgatccgcctgccttggcctcccaaagtgctgggattacaggcgtgagccaccgcgcctggctaaaaagtcttttaaaaaagtgtctgcctttctcagaaaatagtcattttgctatagcccatacatattttgagagaaaagacaaatgttgtataaaactgtgtgtgaggaaaatcatctctgacttccactgagtattctgaatggcagcaacttaaagaatagcagcaaaacctaatggacatatccatttataataggacattgcagccatggctttatagggcaaacactggggaaaatgcaatgatgggaagaacaaagtggacgtcggtagttttttcttctttgttctgtgatatggtccagactctttcctcacagacaatggaaacatggtagaaactctctaccatggtcggtcagttgaagaagggaatcgtaaaaattatgtaaatatagcctagtcatttttttaaacctaaaacatgttcatttattctccaatatttatttgtatttattttatttttatttttattctggagacggagtcttgctttgtcgcccaggctggagtacagtggtgtgatcttggctcactgcaacctccgcctcccgggttcaagcaattcttctgcctcagcctcccgagtagctgggaccacagacgcatgccgccacactcagctcattgtttgtattttaatagagacagggttcaccgtgttgcccagactggtttcgaactcctgagctcaggcagtctgccaccttggcctcccaaaatgctaggattacaggcgtgagccactgcgcccggccttattctccaatatttatatgtagggccacaaccttttctttgcatgtgggtcctttggaattcttcctttccttccctgtataaaccacacccataatgcttcattccagatttctatctcctagtttggttttattaaaatagagaacaaatttaagagatgagagttcttttaggtttttattattaccccccaatctcttaaagtcgcttcacgtacagctattttagcagtaactttgctactcaccttattgaacattcctaatgcattcaactttgttttcatagaaagaacaactctcctttttgctgttatttaatcaacgtacataatatttaattaaatcacttggccatgagaagttcagtggacataaacagcttgagggcaaacacagctgaatttctatatgccaacaattctactggtgggaacaaggagtgtgcatctaagtactaagcatgctatgggcatctgaatattttagtgatagaaaagagaccatcagttaacccattggaggttggttaagataaatttttgcagggtaaaatttgctttttcttaatgtatcctaacatttttcttgtatgaaaatagagatctacatcattgtttttaagggacacatggtatttattatacatgcattaggctgggttcttacttgaagacaacataaagcagttctgactcgcttaaccagaaacggaatttattggttaggctatttggattgtttatagagacaacagaagtcaatcagagtcaaccaggcttggaaaataggtaggaacacaatgagactaaaacaggccaaggacatgccccaggaagtctagtgaggacctcttcactggcactggctttctcaggacttttgccagggccacttctggcatcttgactgtattgctgcctgtgctgagaattatcttcatctgtccttgtgtattcatgtcactttctcatgattcaaaatcctgggcagaagtgtctgactagccaagtctagaatcatttagaagcatctcagcttcaaggggacagggaaaaggaatatctgtctcctcccttctcccttcctcccacaacacacatgctttggctttaataatgggagccagggttgtactgtttatttctaagacgcttgcggtgggggcattttcttggcatgggatgtgtgtttgaatgctgggtagccaaaaatatgacaagtgttacactgtgatgcactagagtttatttaattaatatcctattataaaaaatttagatcgtttccagttttgttctgttttaagccacatagtaatggacacatgtgagcaatctactgggggaatgaggtatcttagctgttttaattaattattttaatttttaattttagctgttttaatttagattttaaaagttattagtgaggtgcagtaacttcatgtgtattggcattttggttttcttattttgtcaattgtctggcatatatattttttgagatataatttaacataccataaattcattaataaaaaaatgtcgtccaggcgcagtggctcacgcctgtaatcccagcattttgggaggccgaggcaggcagatcacaaggtcaggagatcgagaccatcctggccaacatggtgaaaccctgtctctactaaaaatacaaaaattagcccggtgtggaggcgcatacatatagtcccagctacttgggaggctgaggcaggagaatcacttgaacccgagaggtggaggttgcagtgagccaagatcacgccactgcactccagcctggtaacagagtgagactctgtctcaaaaaagaaaaaaattaaaaaaaatttaaaaaagtcaaattcagcgatttctagtatgttcacagacttgtgcaactatcatcactatctaattacagaatatttttattaatacaaaaagaaattccatgtatatgtttttgcagtttgtttacatggtggtttttgccacacaaaattttaaaatttcatttaattacattttaatctcttttcctttacagtttctgttttggcttatgcttagaaatgctttccccacccaatgttttgttgttgttaggtaatgcttatttttatattttcctagtattttttactttttatttttacatcttgttctttaacttggaattaatttatagattgtaagatggtttctaaaaatgttcacaattattaaatggttagcgtattatcccagcactacttactgattttctcagtgatgtgaattgctgcccttgttatatactgaattcttatatacacacatatgtacgtttctggaactttctgttctgttgcaaggatctttctattctgacatcagcacaagacctttttttttttttttgagatggagtctcgctctgtcacccaggctggagtgccatggtgcaatcttggctcactgcaccctctgcctcccaggttcaagtgattctcctgcctcagccttccaagtagcttggactacaagcatgcaccaccatgcccagctaatttttgtatttttttagtagagacgggtttcgccatgttggccaggctggtctcaaactcctgacctcaggtgatccgcctgccttggcctcccgaagtgctgggattataggcgtgagtcactgtgcctggccaatactttttttaatagacaattttttagagtaattttaggtccacagcaaaattgaacagaaggtacagtatgtagccttttcagattggcttctttcacttagtaatgcacatataagtttcctccaagtttttttatgaatagctcatctttaatgtgtgtgctgaataatatttgattgccttgctgcaccacagtttatttatccattcacctactaaagggtatcttggttgcttccaagtgtcagcaattatgaataaagttgctgtaaacatctgtgtgcagttttggtgtagacataagttttcaactgttgtgggcaaataccaaggagtgcaattgctggattgtatggtaaattatatttagttttgtaagtaactgcccaactgtcttccaaagtggctgtactattttgcatttccactagcattaaatgagcattcctattgctccacatcctctttagcatttggtgttgtcagtgttctggattttggccattctactaataatagatatgtagtagtgtctcatcattgttttaatttgcatttccctgatgacgtatgatgtggggcatcttttcatatgcttatatattatctgtatatcttctttggtgaattgtcttttaaggtccttagcccataacatcaggttgttttcttagcacaagactttttaataattaaaacttttaaagactctttaatgtctggttgggtaattagcatttagcatcattattttttagtaatgacttttataaaattaatggtatacttgaaatgtttggccaaactgagttgtccttttcagcctcaccaaacttttattgttttcttgtagtttattcttaacaagttatgataaatataaaataagtgttttttctttttccttttttttttttttgatagtcttgctctgttgtccaggctggagtgcagtggcatgaacttggctcattgcaacctctgcctcctgggctcaagccgtcctcccacctaagcctcctgagtagctgggactacaggagtgtgccaccgtggtcagctaatttttgcattttttgtggagacacagtttcactatgtttcccaggctggtctcgaactcctgggctcaagcaatccgcccatctcgacctcccaaagtgctgggattacaggcgtgagccaccatgtctagcctgttttttcaacttattctacataagtggttaaatactgacagttattttcgttttcataggcatttaatgttttcgcatttgttggttttggcactattttgtcttagaagtaaatttgtcttagaagaaagcaataacattacaggcagttcttgatttagacatagattgtgtctgacaagttgaatcagatgatttaaaaataaattttcttaatatttttatattcgggggtacatgtgcttgtttgttacatgggtattacatgtgtaatcaggtgattgttttgatgagggagaggaggcattccaatcaccaaatagccttcatagactcaaagattcctgcaccaagaccatatttaacacataacattgttgaaaagtagctgactcatttgtaatttcaagtagttgaattctacttccccctaccttcctgagataatgatagctgccttgcaagaaaagttccacacacactaaaaacatgtttctaccttttgtctattattgacatggcagcaattgcttagcccctgttggaaaggcacatatatacttgaggcatatttctcacttttggggaacctgtctctacctgtgtttattgcagggtattggtatttttcaagcattctctccacaccactctcacctttggctggttttactttatgacttttgcacacattgccctgttaagttaatccttttgaggttattgttagctttggactccagcctgaattggctgtatgaacatagacaagtctcagctttagcttccttaattttaaaaggaggttatgattctatttacgtagcaggattggtgtgagacacatgcagtgctataggaatctgaagcatctgtattgttatcataggacaacttatttgtagagatgctatgactactctaggagtcacaaaaatgaccagtgaagtacattgccttttaatttgaatgttctgttcttttttgaccttattactgtgtttaagtattactacctaatcttttaggaatggtcaaataaaaaaaactgttatttattttattttttttcctgagatggagtctcactctgtcacccaggctggggtgcagtggcgtgatttcagctcactgcaacctctgcctcccgggttcaagcgattcttctgcctctgcctcactctccgagtagctggattgcaggcgtgtgccaccatgcccggctaatttttgtatttttagtagagacgggatttcaccatattggccaggctagtctcgaactcctgacctcattatctgcccaccttggcctcccaaagttctaggattacaggcgtgagcaactgtgcctggcaaacatacacctgcctacttcagttgtttcatctggaatcttagtcctctgtttatataatactggttgtttgatgaaagaaattagacacttagtattttggaaacaagttaagtaataagattaattttcattttaaaggtttatacaatttaaaagaaaaggatgaattatataaaataatagagaagctaatgctttccccttttgttttcattttagaatgtggtagcaattttaaataaaagtgaatgggtaggaaaaaaattaattgatctggaaatactatatagataccttgaaggcaactagttgattgttatttgcatagctagaaatcatctatttatttaataaaataagcacgtttttatagccttggtataataaaatgggttatttgggctttttatatatatgaatttatcattggtcttacttattgaattatttcagtttcagtaacttttctcttaatttctacgtactttgtattttttttctttttcatttcccattaaaatgagttggctttatgagatgaaataatttaggcctacaatgagtataggtagtcctatgacatacctgtgtatttactacccagcctaagaagttaaacattaaatatatagttgcatttcccctttgtgctcctctcaagtcactcctctcccctctctcccctcaatctgttgaatttggagtttatcatgtctgtgcacatttttatatttttactatcacaactatatatgtgtgcatacaaaaacaatgtataacattgttttatgtttttaaacctttgtatcctttttttggacataacatcaacattttattttattttttattcataagcattgttttcttttgtcttgcatattttaaaatgtattagatggtatcaaactatcactttgtcatttgcatttttcttagaacattgttttcttagaacaatgtttcttagaacatttttcttagaacattgttttcttagaacatgcatttatttatcaacatatattgatacataaaaatacttctagttcatttgtttttaaaattattttgtggcacattataattattcatatttatggggtacaatttgatgttttgatacatctacatgttgtacaatgatcaaatcagggtatttagcatatctatcacctcatacatttatcagtgctttgtgatgagaacattcaaaagcctctcatccagctattttgtaatgtacaataccttactgttaacaatcctcaacctactgtgcaataaaaacaccagaacttattccttctatctaaatgtgaccttgtagccatttaccagactctttccatccttccctccccagtctctggtaaccactgttctactctatgacatcaaccattttttttttttttttgaaattccacatgagcaagatcatgtggtatttgtctttctgtgtctggcttacttcacttaacatgatgtcttccaggtccatccatgttgtcacagatggcagaattttattcttttttatggctgaatagtattccatgtatatatatacaccacattttgtttatgcatttatccattgtcggacatggattgattccatattttggctattgcaaatactgctgcaataaacatggcaatgcagataatctcttcaacataccaatttcatttcctttgaataaatacccagtagtgggattgctggatcatatggtagttcaattttcaattttttgaggaatcaccatactgtttcccatagtggctatactaatttacaatcccaccaactgtgtataagggttcccttttctccatatcatcaccacccctcttttcttttgttattttgataataactggagtgagttggtatctccttgtggttttcatttgcattttcctggtgatcagtggtatggattgcatctgtgtcctggccaaatctcatgttgaaatgtaatccccagtgttggaggtggagcctagtgggaagtgtttggaacatggaggcatatccctcattaatggctttgcactatccccttggtgatgagtgagttcacatgagatctggttgtttaaaagtgtgtggcacctcccattctgtctctcttgctcccacatcaccttccaccatgaacaaaagctccttgaggcttcactggaagctgagcagatactgacaccatacttgtacagcctgcagaactgtgagtcaattaaaccttttttctttatcaattacccagtctcctttctttctttctttctttctttctttctttctttctttctttctttctttctttctttctctttctttcttttttttttttttaactgacacagggtcttgctctttcacctagtctggagtgcagtggcccagtcacagctcactacagccttgacctcctgggcttacgtgatcctcccacctcagcccccaggtagctgggaatacaggtgtgtgccactacacctggctaatttttgtattttttgtagagactgagttttgccatgttgcccaggcttgtctcaaactccagggctcaagcattctgcctgctttggcatcccaaagtggtgggattacaggtgtgagccactgtgcctggccaggtatttctttatagcaatataagagcagcctaacacaattagtgatgttgagtgttttttcatgtgcttgttgggtatttgtatgtcttcttttgagaaatgtctattaaagtcttttggtcatttttaaaaaaatttattattatcatactttaagttttagggtacatgtgcacaacgtgcaggtttgttacatatgtatacatgtgccatgttggtgtgctgcacccattaactcgtcattggaaacaattaacaaagtaaagagacaatctacagaatgggagaaaatatttacaaactatacatttatcaaggggttaatatccagaatatataaagaacttaatgaccacaaaataacctgactaaaaaatgaccaaatgacgagtcttattttgtggttgttaagttctttatatattctggatattaaccccttgataaatgtatagtttgtaaatattttctcccattctgtagattgtctctttactttgttaattgtttcctttgctgtgtaaaagcttttcagttttatgtaatctcatttgtctacttttgcttttgttgtctgtgcttttgaggtccactcaaaacttccttgctaagcccagtgctgtaaagcatttcctgcatgtttttttttagtagtttcatagtttcagattttatatttaagcatttaatccattttgagtagatttttgtatatgatgagaggtaggggtctagtctcatttttctgcatgtggctattcagttttctcagcaccacttattgaagagagcagtgtgtgtttgttatggtttggatgtttgtcctttccaaatctcatgttgaaatgtgattcccagtgttggaggtgggacttgtgggaggcgattggatcataggggaagatccttcatgacgggtttggcaccatctccttggtgataagcaagatatggtggggggttttttttgtttgtttttgtttgtttgttagtttgtttttcaccatctcttacaggaaggagaaatctggttgtttaaaagattctggtacctccccctgtctctcttgctcattctcttgccatgtgacatgctggcataccttcgctttctgccataattgtaagcttcctgaggccctcacaagaagcaaatgccagcatcatgcttctgtatagcctgtacaaccatgagcccaaataaattctcttttctttataaattgcccagtctcaggtatttccttatagtgatgcaaaaatggactaacagtgttcttagcacctttttttgaaaatcagatggctgtaggtgcatgaatttattttagggctctattctgttccattgtgtatgtgcctgtttttataccaatactatgctgctttgattactatagccttgtagtatattttcaagtcaggtagtgtgatgcctccagccttgttctttttgcttcagattgctttggctatctggggacttttgtcattccatatgaattttagggtagttttttcctatgtgaagactgtcattgatatttttatagggattgcattaagtctatagattgctttgggtagtatggccattttaacaatattaattcttccaatccatgaacatgggatagcttttcatttgtttatgtcttcttcaatttctttcatcaatgttttatagttttttttttttttttttttggagacagagtctcactctgtcacccaggctggaatgcaatggcatgatctcagctcactgcaacctctgcctccagggttcaagtgattctcctgcctcagcctcccaagtagctaggattacaggtgtgcaccatcacactcagctaattttgtatttttagtagcgatagggtttctccatgttggccaggctggtctcgaactcctgacctcgggtgatctgctcccctcagcctcccaaggtgctgggattacaggtgtgagccaacgcacccagccagtgctttatagcttttagtgtagagatctttcacctccttggttaagtttattcctaagtatcttttttttatgtagcaattgtaaatggaatttttttttcaggtggtttgctattagcatatagaaacactactgattttaataagttgattttgtatcctgtgacttactgaatttattttttagttctgttttttagtagattctttagggttttctgtatataagatcatgccacctgcaaacagggacaatctgactttcttctgaaacttttttttctaaactatgttaatgggatttatccctgttgctacttgcagctctacttcaagctttctcattctcagtgctatagacatttggggccagatcattctttgttgtgaggggctttcttgtccattacaggataattggcagtatccatggcctctatgcactagatgccagtagtactcccttgctgcactctgagttgtgacaaccaaaagtgtctccagacattttgaaatgtcctattggtggtgacatcaccccttctctcagtgagaatcacatttctagttcattcattttaacttctatattatgtttcattataaatataccacaaccaattttttcatttccttgttgatggacatctagattatttccaaagttttaactattagcaacattgttgcaatgagcatttttgttcttgtttccttgtgcacatgtgtgagactctgtctaaggtactatgcttaggagagaaaatgttgagttttaatatatgcatattttcaactctaccggctatcatgaagcagtttccataattgtactaatttatactctaaccaacggaacaagagagatcctgtttctccatatcctcaccgacacttggtattgtcagattttgagatttttatctacctgatggaggtacattatattccttgattaccacaaggatcacaaattgtgcagatagagttgtatccaaaaaaggattaaggctgggcgtggtggctcatgcctgtaatcccagcactttgggaggttgaggcgggtggaccacttgaggtcaggagttcgagatcagcctggccaacatggtgaaaccccatatctactaaaaatacaaaaattacctggggcctggtggcatgtgcttttagtcccagctactcaggaggctgaggcaggagaatcacttgaacctgggaggtggaggttgcagtgagctgagactgctccactgcactcccgcctgagcgacagagcaagattctgtctcaagaaacaaaaacaaaagcaacagcaaaacaaaacaaaacaaaaccccaaaaaagaattaaatcttactgcatgattattgagaatacaggagcctttcccaaattataagtgctgattattttaggggaattttagaatgatgtttgagcttctgtgaccagctttaagaagtggttttgaacaatcagacttcatatgtgccatgttttctactcaatttctgtagtttctatttccaaaccagagatgatcatctagtcataatattgttcttcatcttagaaaatgatattactgatggtgattaccatctctacttagggaatggctcaaaatatattaataacttgaagttatttccctcagtgttgttggatgcttttgttctcagagtcactcatcactaacagctggatgccaaatttgtctctttgatactgtcgtttcccagaagcctacatgttttttccatactatatgaaactgtttatgatcttactctgttttctgagtcattttgctaaatgcagtaggatgttacaaaagatattcctggttttgtacctacctttaagatttaaaatgaaaacgatggacataacatatataacaaagtcaattagagttgtgtgtatatgtaataaagtagtgagagtgagatggaattcctccaaggtttcatgtgtaaagtccaatttaagtagagttttgaaaaaaaaacaatgcaggtgaattacgaaagcgaaagaaatatgtattcagaattgatatgacttaaattaagatgtagtgggaaaagtggcttaattagtataatttttgtttgtgctcacacattgtggactcctcaatacttacttcctgggtgaattatccagtgcctttctgcctgactgatctctctcagttcctcagtaagcctgagagttagtccagtgctttggtctgggacataccccatgataaaactgtatttcagtcttacattcctaaacaggtaaactagccttcacctaccaaaggtattgtattctaaaagtttgttgccaattctgtttgttgaatttgatgttttcccataaaacgatttagtcaactttggtaatcttgcaagatcagccctcaaaagccccatttgacccataagatacaggagcaagtctgagttctgtgttctggaggtagacagccaaagctataagaagaataaggaagagtttccttttttaggctcaggactatccttagataaaattttgataggatctgtttgttttagacattcttctacttccatttttatacccttgtactgcttcccactgactcctcctgggctcctaataccttcatgcttgccttaagtactccatcctggactcgccacctgaactcatcctatttgtcctttgctcccaaacttgcctttcctgtcctatctgggcttttgttctcttgtagtaactgaccttatgtaggtattaagagatataattccaactatcacccccctgattatcaaaaaagagtttatattttaaaaagaagatacactggatgttaagacaactgaccttcaaaaagtcacttcatgggggaaaagagatatggaaggagctattctagattaaatgagacaaaagagacataaaaccaaatgcaatgtgtgaaccttgtgagggtcctgaatagtaaaattggacttcttcagacttgaaaacttgtacacaaaaggacactatcaagagaatggaggatttgggtacaagcggttgaaagatggtttggctgctctggtcggattctgccgtcccagtgaggctggaaaatagggtctagaggcaggaacataaggctgattcacacttcagctatgacaggaaatatcctctcatagagcataggccaagtaaatgattttgtaactttacttcatcctctccttttacatagggtgtactccaagtagagggtatttaaactcaaaaaaactctgtaagagggccttttgagcccctgtgctcaggcctgctcccatactgtggagtgtactttcattttcaacaaatccctccattccttccttgctttgtttgtgcgttttgtccaattctttgtttaagacgccaagaacctggacaccctccactgttaacaccagcccttccctgtggctgaccctgaggtgttatgagtttcttcacagccctacttcctctctcttctccctcattttcagacccttcttcagcatcttccctgggcattgctgtgagtttaggccggcccgttttgagcaggagcagcagcggaacagtagacctgctggaggaagtggggctgcagatcagagacacagcattttcgtcaaccaaacttcttgaagccatatctacagtatcagctcaagtggaagagcttgccgtcaaatgtacggaaaatgcacgtttccttaaaacatgacgggacctcttgaaagaatgctgtgattcttggaaacctgacaattgatttggcatacttagctctttgatagtgactgtgtaataattcatacttcctcatatatgatcatttcacatgtgccacatatataggataatatctagcagttctctatatcttcagaatgaagtttttcttggttttcttgacctttgtaaaagcagaatactgattctatttttgatgttgatcagtacttgtttattcttacactttctgcccttcaaactttcataaaatcctttacaaaatttaattttatcagtagatagttaatattaattgtgccacagtgctaccagtagcaaactaagtggaccattatttgttttgcagtaagatgccaagcatggcagaattagaagttgagcttcatcttatggaccaagggagataactttaaggttccagctccattaggctgagttctctaggcaaatgattgtcttacttacttcgatatccccagcacctaaaacagtgtcacatagcattcactaaatgtttattgaaaagaagagttgattaacataatacaaagctattttttcttcctgtatttagcaggaagactataattgtttctctaaaaatgtatgaatcaggactttgttgacttgaaggaaaatgttatctttttcacagagattttaactttgatgatagcttttaaaaacatgataaatacttttgtcctcaaatgattattttaaaaagtcttttttttttgagacagagtctcattctgtctcccaggctggagtgcagtggtgcgatcttggctcactgcaatctctgcctcctgggttcaagtgattctcctgcctcagcctccctagtagctgggattacaggcgtgtgccaccatacccggctaattttttgtatttttagtagagacaaggtttcaccatattgaccaggctggtctcgaactcctgacctcaagtgatccacccgcctcggcctcccaaagtgctgggattacaggcgtgagccactgcacccagctaagaagtctttatttcagaaaatgaaagactgtctagaaagaacgaattttttttcctatttatttctatggttactgcttttacacttaatattttttgttttcggtatttttatatgtttgattgctgtctttaaagtgccttatcagatttatggctctgtactatgaattttggagctttacaagttatttacataactctaagttactttgcttccaatacatcaaatttaaataacatgattgtttttatattatttgaccttagtgacaatgtcctattttatttgttctgtatcttatgtcgctttttggtagtttgtattatgtgtgaatgattaagccaactaattctgtaccatatataacttctggatatctttgatatgacatcttaattctttgtagatatggtgatgtgtacagaatgatattctgaagctccacaatggtgcattgaaaggctgcagatggatggccaaagaatagttttgtttagcatattaggtctagttctggacttttttttttatactttaagttctggggtacatgtgcagaacatgcagttttgttacataggtatacacgtgccatggtggtttgctgcacccatcaacccatcacctacattaggtatttctcctaatgttatccctcgcctaatccccaccccccgacaggccccagtgtgtgatgcttccctccttatgtctgtgtgttctcattgttcaaatcccacttacgagtgagaacatgcagtgtttggttttctgttcatgtgatagtttgctgagaattattgtttccagcttcatccatgtccctgcaaaggacatgaactcatccttttttatggctgcggagtattccatggtgtatatgtgccacattttctttatccagtctgttattgatggacatttaggttggttccaagtctttgctattgtgaatagtgcctcaataaacatacatgtgcatgtgtctttatagtagaatgatttataatccttcgggtatatatcctgtaatgggattactgggtcaaatggtatttctagttctagatccttgaggaatcatcacactgtcttccacaatggttgaactaatttacactcccgccaacaatgtaaaagcactggacttttttttttttaagttaaaagatcacacacagggtgtgatttctataccaaagatatgcttatttcagtatgaggaaaaatatttttcttacatgtcctgaaaattgcaattttaaaaatgtacaaaataaatttttattaaaagcaaattttatttcaaaaaaaaagagtgaaagacaaccaactggataggagaaagtatttgaaagtcatatatctgataagggattaatatccaagaatataaagaactcttacaactcaacaacaacaacaaaataaccttattaaaaattgggtagagtgcttgaatagacatttcttcgaagatatacaaatacccaataagcacatgaaaagatgcttgacatcatcagtaatcagagaaatgtgaatcaaaaccacaatgagataccacttcacacctgctaggatgggtagaataaaaaagataataggtatcggaggtggaacaattggggcccttatatactgctcatgggagtataaatggtacagtcactttggaaaacagtctggcagatcctcaaacaattaaacatagagttattatatgacccagcaagtctactcttaggtattaccaaagagaaatgaaaacacaaaagtttgtacatgaatgtttatagcagcattattcataatagccaaaagatggaaacaacccaaatgttcatcaactgacaaatagataaattatggtgtatctatgcagtggaatattattcagccataaaagggaatgatgtactgatatgtgctgtaacatggatgaacactgaaaacatgctacatgaaagaagtcagtcacaaaagaccacatattacatgatttcattcatctgaaatgtccagaagaggaaaatctatacaagcaaagtagattagtggttgcccaggacagaaggcttaggaggtgatgactgataggtaaggggtatgttttgttgttgttgttgttgtttttaggtgatgaaaatgttctgaaattgcctgtggtgatggttgcacatgtctgtgaatatgctaacaactattgaattctacactttaaatgtgcgaattatataatacgtgaactacatctcaagaatgttttaaaactggtgttgggaaaacaggacatccacatgtaaaacaatgtatgtcagatccttaccatacaccatgtacaacaattaactcaaaatggattaaagacctaaatataagagccaaaactacaaaaactcttagaagaaaacatagcagtaaatattcgtaagtttgaatgtggcaatggtttcttagatatgacacaaaaaacacaaaagaaaaaagataaattggacttcacaaattaaaagcttttgtgattcaatggacaccatcaagaaagtgaaaagaatggaataccgatacattttacacatcaatgtaccttgaaaacattatgctaagtgaaagaatccagacacacaaggacacatattgaatgaatcaatttatatgaaatggccgtataggcaaatccgtagagataggaaataaaattagtgtttgccaggggctgtgagtagagaggaaatggggagtgttgctaatggacatgggatttctttttggagtaatgaaaatgttttgcaactacatagtcattatggttgcacatccttgtgaatgtactaaaaagtactgaactggataccttaaaaggctgaatttttttcatttcttctaaaaaaaaccaggatagatgtgcagaacgtgcaggtttgttacgtaggtacatgtgtgctatggtggtttgctgcatctattgacccatcctttaagtttcctcccctcacccctcaccccccagcaggctccggtgtgtgatgttcccctccctgtgtccatgtgttctcattgttcaactcccatttatgaacaagaacatgcagcatttggttctctgttcctgtgttagtctgctgaggatgatggtttccagcttcattcatatccctgcaaaggacatgatctcattcctttgtatggctgcatagtattccatggtgtatatgtaccacattttctttctccagtctatcattgatgggcatttgggttggttccaagtctttgctattgtaaatagtgctgcagtaaacatacgtgtgcatgtgtctttatagtagaatgatttatattcctctgggtatgtacccagtaatggggttgctgggtcaaatggtatttctggttctagatcctcgaggaatcgccatactgtcttccacaatagttgaactaattcacattcccaccaacagtgtaaaagcgttcctatttccccacagcctcaccagcatctattgtttcctgagtttttaataattgctattctgactggtgtgagatggtatctcattgtggttttgatttgcatttctctgatgatctgtgatgttgagctttttttcatatgtttgttggccgcataaatgtcttcttttgagaaatgtctattcatatcctttgcccactttttgatggggttgtttttttcttgtaaattgtttaagttccttgtagattctggatattagacctttgtcagatgggtagattgcaaaatgttttctcccattctgtaggttaaaaggctgaattttatagcatgtgaattatatcccaatttaaaaaagaatgcatatgtcttagttcaggcttccataacataataccatagactgggtggtctaattgttcaaagctccacagaaattagttggagaagttacaagagtccattaatcatcttgctttgttagtagcagcgggcatggttcagcattttctgcttaagtttctctgagctcaccaaaactaaaatgatgttgtaatactttttttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcactctcttctgcactgaggtgaggcagatgtcaaactcatagccagcatctcgtagcgcctgcccgccgcgcttcgcctcctcgtggcccgccgggctcagatcggcgtcgtaccagcagctgaagcggttctccaggttccatgtgctctcgccgtgccggatcagcaccagtttgtaggcggccatggcggtgggctgcaatactttttataccatttgaagtaaaaggtacaaaaggttatacgctgaaaattctttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctattggcgggaggccttaggtctttgctggtttttgacatgaggcctcagttcctcaccatatgaacctctccataaggctgcttgtatgtcttcatacttggtaggtggcttcccccagattgcgtgattcaggagagaggacaacaaggaaaacacaatgcttttttctcctcttgcaatgttttttatgacctagtcttggaagtcacaccttgtcgcttctaccgtagtctattcattagaaacaagtcattaggccaggtgtggtggctcatgcctgtaatcccagcactttgggagggcgaggcgggtggatcacttgaggtcaggtgttcgagaccagcctagtcaacatggtgaaaccttgtctctacttaaaatacaaaaaattagccgggtgtggtggcatgcgcccgtaatctcaggtactggggaggctgatgcaggagaatcacttcaacccgggaggcggaagttgcagtgaactgagatcgtgccacagcactccagcctgcgagacagaattgagtctcaaaaacaaaaacaaaaacaaaaaccaaaacaacaacaacaacaaaaaacaagaaacaagtcattaagttcaggccacaccgaaggggaaaggattaaattccacctcttgaaggaaggagtagcaaagaatttgtgggcgtattttaaaaccaccacaggaaggcagacaataagcaataaacagaataaatcagcaagttatggagtatgttagaaggtggtacgttctatgaaaacaaaagaaaaagcagaggtaaggggaatcagagtatgtttgtgtggaagggatgtaggttgcagttttaaatagggtggtcagcatagtcctcattaaggttagatttgaacaaagacttggagacaaagaagttagccaagcagttatctggaagaagaaagtcccaaagcaagagaatagctaaaataaggccttgaagtaggagtcatccttgcatgcgtaacagccaggaggccagtatgactggcacagagaagggtttggtgagtggtagaagaggaggccaggtaaacttgagggggacaggcatgggaaatcatgtgggaccttgttggctgttgtaaggatttgaggcatttttgattagttcttaattcgtacttacaaatgttaaatgagattatgtatgggaaacattagtaatcaggaaagcactctatgaaagctagttacttgtattaaagtattgaaatttttatttttagttagcatatccatagaaacaactttcctttacttcatctaaggtgataagaattttttttctaagcaggaagaatgcttaccatattttattactagcacattttaattttttaaacatgacacttgagcatatataaaatgtagcatatttttaattggggaggtgggggaaaagttgaggaaagattatttgcatggctgaaattaatgaatttattgtttctaacaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaagttactctttggaaactgaagtcaaatgccattgaagagaattctactagaaattacttctaacaatgagatagaagcagacacactgacacatttggcaataaaaactattgtacttcttatcttgaagctaaataagttttctttgacccattaattcctctcataaagaaaaaagatatattttcaatttaaaaacatctgaacatggaatcttgatattgtggttgtatatttatagatttatattttataagtatatgagtatttatatactgtttattactctgaatctcatactgaactaaaatgtatgttttcaggggatgggttagggttttctttttcttttataacatggtgattattttgcaattaaaacttgaagggaaaatgtctagagaattactagtatactttggtttttatttttagtttttttttcagacagggtcttgctctgtcacccaggctgcattgcagtggcaaaatcacagctcactgcagcctagatttcccaggctcaagcaatcctcccatctcggcctcccaagtacctaggaccacaggcgtgcaccaccatgctagctaattttttttttttaagatggagttttgctcttgctgcccaggctggagtgcagtggcacgatctcagctcaccacaacctccacctcccggttcaagcaattctcctgcctcagccttccgagtagctgggattacaggcatgcgccatcactcccagctaattttgtatttttagtagagacagggtttctccatgttggtcaggctggtcttgaactcctgacctcaggtgatctgcccacctcagccttccaaactgttgggattacaggcatgagccactgtgcccggctgcatgccagctaattttttaatttattttttgtagcgatgggggtctcactatgttgtccaggctgatctcaaactcctggactcaagtgatcctcccacctgggcctcccagagtgcggggattacaggtgtgagccaccatgcccagccaaaattactagtacaccttgtatgatatgcctaaggaagactctattattggttttttgtttgtttgtttttcagactctagggctttaagttgaagactctattgttgtttaacattacttgagcatcaacagcattctagatatactgtggttaaagatgtagttcaggttataaaaaagccttctgaatactgcatgaagtacctgtggttatcataagaaacttcatgcatatatggcagggattggaaaatggtgatctgcaggccaaacccagtttgccaactgctttcatatggctcataagctaagaatgccttttacatttttacaccattgaaaaaaattaaaaaaatatttaggaacttatgaaaagcacatgaaattcaaatttttgtgtctgtaagtaaagttttagtaatatacagttttattagaacacagccacactcattcatttacgtattgtgtacagcccttttttcactacaagagagttgaatagttgtgacagagcccatacgtggtgtcctcattggtaagtgatacactgccaaatgatttaccacagtggaaataccattttatcttcccaccagcagtgtttgtgttccactttgaaagtgttccattttctccacattccctccaacaatttgtattgtcagtcttttaaattatagacattctaatgggtgtgtaatattacatcactaattctcatttccttaatggctaatgatattgagcatcttttcatgtgtttattaggcatttgtataccttctttggtgaaatgtgtgttaaaccctttggccaaatttttagttgggttttttgttttgttgttattgaatttcttctttttcaaaattgttttggttagtctaggcccttttactttccatataaattttagaatcagtttataagtttctacaaaaatatctgctgggattttcgttgagattgtgttgattctacagatccatttggacagaagtaacatcttaccaatattgagttttccaatccatgcacatagtatatgtctatttatgttggtattctttgatttcttttatcaggaatcaatagttttcagcatgcagtttctgtacatattttgttagatttatatttaagtactttatgtttttgaatgctgttataaatggtactgtttttaaattttaaatttaagtttaatttcaggtgttcattatgaggtttttatatgttgactttgtatcctggaacgtagccaaactgacttatcaaacctattagcttttttgtacatttcttgggattttctatgtaattatgtcatcaaggtatatagtttttttttttttttaagatagtctcactctgtgacccaggctggagtacagtggcacaatgttggctcactgcaacgtccacctcctgggttcaagcaattctcatgcctcagtcacccaagtagctgggattacaggcacatgccaccacacctggctaatttttgtatttttagtagagttggggtttcgccgtgttggccagggtggtcttgaactccagaccttgagtgatccgtccacctcggcctcttaaagtgctgggattgcaggtgtgagccactgcacctggccacatagttttatttattcctttgtagtctgtatatcttttttttttcccttgtattatcaaaccttcattacaattttgattgggagtggtgagagtgaacgatggttgggggaaacattcagtcatttacagttagcattgtgttagttgtagagttttgtaaatactatttatcagattaattaagttatttctattactagtttgctgagggtttttttaaacatcatgaatggatgttgaattttgtcaagtgctttttctgcatatagagatgatcatatggtttttctcctttagtctgttaagatggtgaattacactgattgattttcaaatgttgagccagccatgcattcccagggtaagcctcacttggtccaagaagacttactttccattaaaaatttcaaacatacacaaaggtggagaaactatttttttttattatactttaagttttagggtacatgtgcacattgtgcaggttagttacatatgtatacatgtgccgtgctggtgcgctgcaccactaactcgtcatctagcaactattaatagtacaagaatctaccctatacccatcacctagaaaaatccttgctatttatttgcatgccattctcatcagttgaattttataatgtgttttgctgatgattctaagagttggtccaggccttcctgcctattgtattctgttaaggtagatgtctctgactagtggattggaacttcctagtatatctccataccagttgccatttctaagccttttggccaccccctgccaccacccctgcccgcccctttcccttgtcactcttcgcaattctcagcactaattgtagtgtatataatttcagtactctttcccatgctttatttagtttgtttttgaacatatttttttctcatttctctccaacttgtatctcaggatccaaagaattaacaatatctcatgccaaaagcttgaggattcctactgtattgacaataacatacagaagctttgcttaaatattatgcttactttttttttttttttttttttttttttagatggaatctcactctgtcgcccaggctggagtgcagtggtgccatctcagctcactgcaacctctggctcctgggttcaagcaattatcatgactcagcctcccaagtagctgggactacaggtgcacgtcaccattcctgggtaattttttgtacttttagtagaaacggggtttcaccatgttggccaggctggcctggaactcctgacctcaggtgatccgcccgcctcggcctcccacagtattgggattacaggcatgagccaccacgcccagcctgaattgcttacccttaaacatgtttatttttactgccaggccttaatgagtcagtaatggatatgtcattttagctgagttgtattctcatttgtgtaatatacttatcattttaatgttatcttatcattaaaacaaccttatattggtggtaattctatttgctggaggttctctgtaattttgcttttatgcaatgttcattacagtaatggcgggaagttaatgccactttggaatttgatcagcttgcatcactaccagaatggttttcctatgactagttgagatccacatgcaatacattttttgacatactaccaggagcagatgttaatatcataatgaaagctttgtccaactggacatcagatttagcacaaaattcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatctgaggtggggctggtgttgagggccagaacagaagctgaaccttactaattatatagtagtgtctgtgctaattgcagtaaagctgttttaaccatttggaaactagttcatgtaattttttgccaaatgacttaggtacttattgtccactgacagctaaagtattttccaaaaccctcaactctctgtctagcaaactattgtaggtgaatatttgtctctgccaacatatccatgtataactataaaactagattctgctttgatgtttgcaaatacattcttgcttcccaaaacagcctgtttgcatcacactcatatgtaagatggctatttccgctgcatcttcccaaagttcaccactgcttaataaggtctgtttaaggtcaaacaaatgcaattgaattttgattacactgaaaatgaagaatagcagcaatataatgtgaaagcactttgtgttgtcaacagtgatttatacaaattccagtgacagatactcaagactactttccagggcacattcataatttgattgctaaaaataaaagaaaacacacttgttctgcctttttcagctctgcttctcctctttcagtcaaaagcccttatgttagtaacctttattcttttttaaaaaaatattttactaagtgtgaagtgttctggggccagagagagattttctgtgaagttaatgaagcttaagtttcagagctcctcatttgcagtgaccttcttctaagactctggaaggagtatcagcaatgtgtttatatggtcatgtgtttttgtacaatttgaaaaattaaaaaaaaatttaaccacaacccttcaaggccattgtccatttctacttcaatgactcttctgttagacctcccctttgtgttagtgtgatattggaatggccatgagctttttggggatgtgactaaggggaggttgagttggggatatgtttagtttggggttagtaggctatttggctataggtggttctttgtcacttctgtgtatagtggagtttttgctaggaattctgatatagggatggcttcttggaacacccctactactcatggggccaactcactaagcatcatgacatgaagatgcagggctcagtgtaaaactggtaaatgaatgttaccagttcaaagaatatgtaagattagtcacttcacaagtaaatttgaaatgccctgaaatcttacagctcatatatgaaagaaactcaacagttttctcaaatttgacagtagctttaaaaatgtatcaatgcctagttgttatgttgaaaggaacttttctaaactatcattaattttaaaaatttttatctagagaaaagactgaactatttttattttctttatatacaagtgattttataaagtcgtcaaatgaagcactaaagaatatacagccaaaaacataggaaaagaaactatcagagaggtatatcaggcattattaataaaaatgttattgttatggatttttatgatatttgttagctttaaaaatttataacttgtgatttaaatttttttaaattttattttgagacggaatcttgctctgtcatctgtactggaatgcgatggtgcgatctcggctcactgcaaccttcgcctcctgggttcaagtgattctcctgtctcagcctcccgagtagctggcattacaggcacgtggcatcatgcccggctaatttttgtatttttagtagagacagggtttcaccatgttggccaggctagtttcaaactcctgacctcagatgatccgccccccttcaccttccaaagtgctgggattacaggtgtgagccactgcacccggccatataacttatgatttttgttatgcgctcagaatattttcttttgtacaaaattttgtgtttatggttttttattcctttttttaaagaaggcccttcaaattgtttaagtttcagacaccacaaagtgtgaattcacctctttctagacatcatatagaaagctgtctttgcccaaacataatttatagtcagaatgtagttcaacatgatcatacataaatattgattactttttaaagaatgttaaagcttaaaatttctgcaaataattaatgggaactaggcttaatacctgggtgacagaataatctgtacaacaaacccctatgacacaagtttacctatatcacaaacctgcacatatacccctgaacttaaaagaaaagttaaaaaagaaatgtacacaaaaaagaatatttctgaatcataacttctaggattataattaagcctcaggtgcagttaatttagaaatcagatttggggagaagagtgtttcaactaagtcaaggagctcttggtagtgtttggaatgaagtaatataattgtgatattaaattgagtaaagttgttttattggaaaatgcaacagcagaacagattaattaacagaattcaaaaagagtgaatagtcaggaaatctctaattttggaataaatagaatatgactatttgcctttgcaactttagaatttaaatgcattttgggaattgtgtcctaagttatacagtaaataaatgtaattttcttgtttgtactgccagtgttaagactgtagactttaaagggattaacctgaagtttaatttaatcaccctggtggtctgttcaaaggaaaagtaaaataggcagataatgtgaagatctttctccggggttgtttggcctttttgaaagtggaagtataaaaacaaatttaattagatataagtactgaatgattccaaaggttaatgccttattaacaaattagtttgtccctgaaacttacaacactaactttttgagtgcttttcctttttaattagataaaggctatagtccattctcttaatagagactatcctttagaaaaatgaccacctcacggatcacgaggtcaggagttcgagaccagcctgaccaacatggtgaaaccctgtctgtacttgaaatacaaaaattagttgggcgtggtgtcgcgcacctgtaatcccagctactcaagaggccaaggcagaattgcttgaaccctggaggtggaggttgcagtgagccgagttcatgccactgcactccagcctgggcaacagagcgagactccaactcaaaaagtaaataaataaaataaaataaaaatgaccacatcaatgctagcagttactaaattcctcctttggatcaataaatacattccttactccccttacaattaattggtgtttttattattgaaaaagtaacacatacacagagtaaaattcctctcccaaggaaaaccagttgtcctatgtatatgtatccttccagaaagactattaatataaaacttttttttaaattattttttgagatggagtctcgctcttgtcacccaggctggagtgcagtggtgcgatctcggctcactgcaacctccgccacccgggttcaactgattctcctgcctcagcctcctgagtagctgggattacaggtgcctgtcaccatgcctggctaatttttgtacttttagtagagacgagttttgccatgttggccaggctggtctcgaactcctgaactcaggtgatccgcctgcctcggccttccaaagtgctgggcttacaggcatgagccaccgtgcccagccaaagctatttacatgtacataagtatatatacttgatgtgtgtgtgtccactttttctaaaaatggaagcatactatgcacatcattctgcaccttgcttttttttaaattagcaaatatatcttagatattgttccacatcaatatacagagccccatctaatatttttctttctatatgggactctttttttggcttcttagctttttctggcaaatgacagtgcattgaatattctgtttttcaaactggtgctctgtcaccaatactatattagagtaacataggcatttttattattataaattagtaggtaataatcatttatccatgaagatgtcgagtcagcttcaaagaggattaggtttctgatttagctgaactctattctgaggaccaaaggaaggtcaaatccaagataaaaaatttagcagtgaaggaatggtgtaaagagggactttcactatttcttttgtatatttttgtgtttaaatttttatagcgaacaatcatacatttgtcatataatgtttgaagcaaagtgaaaatacattagaaatggccaggcatagtggttcatgctgtaatcccagtactttgggaggccaaggtgggaggattgcttgagaccaggagtttgagaacagcttgggcaacatagcaagaccttgtcttttaaaaagaaagagagaaagagagagagagaatgagaatatattagaaatgagaattctgacaaagtactcagtttaaagatggtttagttcatgaaaaacaatgctacaatgtaataaaaactaacagaatgtctgcatctttttcatcttaaaacatttgatttttgaatttttagattgattttggactattatttagtgtctaaggattgtctttttctagtttataatctgatataatagttttaaagtgataacctttatttaggttactcaaataggataaatgttcatggagcttgatggcttcctcttacaatattttaattttcaatattctatattgaagcatcaaatagagtgttaccctattaatgtaaatacattatatttttcagcaaaccataatggaatttgtattgagactgtatgtattataagtgatgatctttttgtatattataaataatttttagttgattcaaaaatatattatgggtggtgaatcaaacatattagaaattcaggataattgattaatcatgtcacttttctgacttcagtctccacatctgtaaaataacagaatcctttcaagctgtgaaaaatctcttataacctttatgttgagttgttatatgaaaatgtaagaaagtaagctttaaactgtctgaagattcccacactgagcagcatgctaacctgaatttattatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaacaaacaattaaaatttggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctcaaaggccccctgccaatattattaccttgggaattagcatttcagcacatgaatttttgagggacctttccctatcaaataagaaagaatacagaagagaaaacatgtactgatgacaacctaagaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccacaaaaattaaaagaatcgatctttacaatctctgtgacagtcagcactctacaccaccattaatactatgaaggccacagagtacgtttggtatattttccttttttctctcccactactgccttcatcaaaatacagtgaatagtcctccatcttcagtctttcctatgagctatatttataatttgtaggctgttacatttattttcagaggaacttttttttttttccgagacggagtttcactctcttgtccaggctggagtgcagtggcacgacctccgcctcccgggttcaagcgattcttgtgcctcagcctcttgagtagctgggattacaggcgcccgccaccatgcccagataatttttacatttttagtagagacggggtttcaccatgttggccaggctggtctcgaactcctggccttaagtgatacacccacctcggcctcccaaagtgctgggattacaggcatgagccaccactccggcccagaggaacgattgatataatggaaaaatagttcctctgaaaataaaaataacaacattggttcctaataaaagattaagagaaaaagacaagctgtcgaaatattggagcaatgtggggaatgaggaaggtggggtagggcagagaagggaagttatttttggagcaggggttggggttagaggacatatgaaaggagagcagcacagacccggaatcagactgccgccagcactttccagctctatggagtctgcctggttttgctcatcactgtatctctagcagctagcatagtgccgggcacataatggacattcaataaatatttgttgaatacataagtacctttttttttttttgaggcgaagtcttgttttgccgcccagcctggagtgcagtggtgcaatgtcggctcactgcaacctccacctcccgaggttcttcaagtgattcttcaagtggttcttcaagtggttcttcaagtgattctcctgcctcagcctcccgagtagctgggattacaggcacccaccaccacggccagctaatttttgtatttttggtagagacgggttttcctgcattggctaggctggcctcaaactgtgacctcaagtgatccgcacacctcagcctcccaaagtgctgggattacaggtgtgagccaccacgcccagccaataagtaccattttgacttcctgcccaaagatttagcacccagagctgtactgtgaatttgtttcctttgagaccttaggtttgaaaagtctctttgctatctaacattcagaggcaaagttgagtgctgttaccccaaagagggatacttttgtttgtgctgagtgtggttggtcagcttttaaaacagaaatagaatttactaaaggaagtgttttctcatctgcagcatgcaaatagcgtagggtactttgacttctcttttgtgtagtattttatgcatagttttcttatgccttttataaataaaagataggctaaagcagttagaaagtatagcaaaccatccagtgacaaagtgatttttttttttgagacagtgtcactctgtcacccaggctggagtgcagtggcacgactttggctcactgcagccttgaccttcaggctcaggcaatcctcccacctcagccccttgagcagctgggactacaggagtgtgtcaccatgcctgggtaatttttgtattttttgtggagacagggttccaccatgttgcccagactggtctggaattcctgagctcaagctatctgcccaaccacctcagcatcccaaagtgctaggattacaggcgtgtgccacctggcctgaggaagtgatttttgcttttaaaatgagaacaatttctgattggctatgttggtaaattgacatttttggggggggtgggtgcgggggaaccaggtcttgtttaagatgtaccggatacaacgtatttaaagggcaagaatcctttacgttggtactttatcagaaaaagtatagtagtacctagagcaataccacccaagaatggtctgtgatgatggaaatactgtgtatccgccctgtctggtaggactaaccacattggccaatgaacacttgaaatgtggctagtgcaaccgaggaactgaatttttaatcttatttaatagttttttttgttttaaaaaataatcatctagtaaaatagactttttttgggtatatagttctatgaaatttttttttagttttgtgaatgttaacacatgtatagatttgtttaacaccaacacaaccaggacatagcgcagccctgttacccctaaaaaactccctcttgctaccattttccctacctctaacccctggaaaccactgttctgttctccatcttcccctttagttggaaagtttaaattatttacagtcattttcttaaccctaaaatcacctcaggggagggaaattaaagtttaaaagaggccttctttaaaaacacaaggacacaaaagccttcatttgatggtggctactcttatattgcatgtctttcaatactatatgtctcaactatacgtggtttgactattctgcatttttttttcatggaaaatgttatatagtattatccaaaaccaaatataatttatttccccacttctgttttggatcatttatgctagtgatttcctccatccctaagaaccagctagccaactagaattatcagagtcttagaaactttccatgccatgggtacatttcacattttcacccaaatacacagtcatcaattatcaagctaaaggaagaaataaaaatatgttcattaaaataagtgaaagatttaactattgtagacaatttaaagagagattttctatgctgaattacttttaattataattttgagtttttattttatagagcaaagcttttcactagaaattaataacacctatatttaactgcttttttgaatattaatatcctatggccatctcaaaaatcaataggtccagcactgaatttatcatctctcctttccctccactttaacctcttaatttcctcctgatttcctcctctctttctgatatcagttaatgacgccaccatctatctatccactggcccaagccagatacctttaagtcatcctagtcgtctcctttatcctatacatcttgttaggaggccctaccctcctgaatgtatcttggagctgcctcttttatctttgcccccagtattcatgtcttaattcagaccctctattgcactacttttgcaattgcagtagcctcctagctgatagtcctccctcctgtatcactccaccctactacactatcatcttccacactgcctccagaatgatccttctctaaaatgaaaatctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaaattaagaaaatatgatgacaagaatgagagagaaacaattatttgtggttattgatttagaaaacagaatgttttctgaagtagcccaggaataactgaattaattatatttctttttattaactagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcaggtaattatcattttttctttgattaccctaatgttcttttacttccattttgctgcttcttttggcatttatcaatgagaaatgattcataggcactgtaattccacttttgcaaatatgtcctatggaggtagccagcagtatatacaaagatgcataaggatgtttgtataattgcttatgatatttaaaaactggaaacaataactcgtggtgcaacaataaataactcatgatgaaatgctatgaagtcataaaacattatggtattaaagataattaatgccacaggaaggtgtctgaggtattttgttaaatgaaaaaaagctgaaaagctatatatacaatgtgatcaaaattttataaagaaatgtatctgaatttacgccatgtatatattgtttatgtatatgaataagattcctggtaggatatgaaccaaaattttaacagtgattatctttgggtggtaggataaatgtgatttttgtttccattgtgtttcctggttttataagttgtttttacaataagaatgtatgtatgtagctatgtatttatataatgggggaagccagtgctcttttaaaaacaaaagtagttgaaataaataataggattttaactataattttatatttaggcattcaaattaaactgactccagagctgtcccaaagttttcgtatttcctgacagctcttacctttgaactgaaacaaaaaatgtatattcaatggaatttaattatgtgaaattgttcttttgaaccagaattgaacctggccttgaattaaactggaaaatgcccaaatgaaattttttgcttgaaataacaattgaaacgttttacaaccaatttctggacaatataattaatctttgctatcctgattagaatgaaagatatcaaatagtagtattccctttttaggctcactaaatctgagtaaaaaattttactaaacacatgtctaaattgttatggtagattaatgtcagtgagagaggacttagagacataccattattaatttttagttcttaatttttctgttggtgacaaatggtagaaattatagaattctcactttttaaaattgacacatagttcacataccataaaatttgcccatttaaggtacacaacccagtggttgttagtatacttacagagttttccagccatcatcactatataattttagaactttttatcactcccaaaagaaatcacatatccattagcagtcattgcccatttctccttcccctccccaagctcctgataacaactgttctactttctgtctctgaatttgactattctagggacatcatttaagtggaatcatacaacatttgtccttttgtgcctgaattattttatttagcataatgttttcaaggtccatccatgttgtagtatgtattagaacatcattcctttttattgctgaatattattccattgtatggatatatcacatttttgttttttcattcaacagttgatgggaatttggattgtctccactctcttgcctattatgtataacactgctatgaacaatttgagttcaaatttttgtatgaacatatgtttttatttctcctgggtatatatctaggagtggaattgctgggtcacatggcagctaaactttttgagggactgccagactgtttttcaaagtagctgttccattttacattaccatctcaaattctcactctaatgtagaaaatctcaattttttgagatttttaaattagaatctggcctggtacggtagctcacaactgtaatcctagcacttttggaggctgaggcaggcagaccacttgaccccagaagttcgagaccagccttggtaacatgatgaaaccccgtccctacaaaaaatacaaaacatcagctgggcatggtgacacacacctgtagtcccagctactcagcgggctaaggtgggaggattgcttaagcccggaagtcaaggctgcagtgagccgtgatcgtgtcactgtactccagcctgggtaacagaacaagaccctgtctttaaaaaaatagattttagattagaatctaatctaaaaaattagattcttttttttttttttgagacggaatcttgttctgtcacccaggctagagtgcagtggcatgatctcagctcactgcaaccttggcctcccaggttcagacaattctcctgcctcagcctcctgagtagctgggattacaggcgcctgacaccatgcctggctaatttttgtatttttagtagagatggggtttcaccattttggtcaggctggtcttgaactcctgacctcgtgatccaccggcctttgcttcccaaagtgttgggattacaggcgtgagccaccatgcctggcctttagattcttttgctctaaaaaagagatacatagttctctattagaaaattcatacagaacactaaaatgttaaagggactctagtaccaaaagtctgaacgaagtgtaggaaatccataattgctgaaggaaataattatgaaaccagaagaaaaatttaagttggaaataagtgcagttatatcagggagccataaaaatgactaaaattggtttcagcaaaatttcattttacctatcaccacttaattttttttttctttttgagatggagtcttgctctttcacccaggctgaagtgcaatggcatgatctcggctcactgcaacctctgtgccccgggttcaagcaattctcctgcctcagcctcctgagtagctgggattacaggtgcacgccaccatgcccagctaatttttttgtatttttagtagagacagggtttcaccatgttggtcacgctggtcttgaactcctgacctcaggtgatctgcccgcctcggcctcccagaatgctgggattacaggcgtgagccactgtacctggcccacttacatttttttaaatttttgaaaatgacagtgtttgaaattatattgattcacatttcactacttcataatgttggattatttctcagagcttctattaaattaaaatactttgatatgcataatggattatgttgtcaataatgagcaccacataaattagttatatcagtatcaccaaaacaagttacttacattataatattcctatgcctcttacatataggaacacaattataatcatcttacatcacatatggtataaaactgaaatatttttcatgttcaaatgtggtatctgtcattacagtaagcaagggcatcataaactttcagattggattcaaaaacagaatttttttctattcacttgggtttatatttttgcaactcacatttttgcaagtgtggttcacagaccagcagcacctaggaccttgttagaaatcagactctggcccactgcagacccagtaaatcaaattctacattttaattttaatgagctctccaggtaatccatttgcacattaaagtttgagaacactgatctacataatgtgattcattgacctttaaattctaaattaaatctacattaactttgtttacataaacaagtccagaaatttgattgaaggcaataatatcagtcataacaacatttcgatcaacaatggaccacatagacgatggtggtcccgtaagattataatggagcatatatagaaacctcatataaggcatttgatattggcatagcagatcaagtaggagaaatgattgatattcattaatggtgctaggacatttggtgttccatctgaaaaaatatatataaatacaaatataaagagcatctagttttgtgtaagtacactctatgatgttcacacaatgatgaaattgcctaaagcatttttcagaacatatttccatcgtttaagtgactcatgactgtataatattaaatattataatttaaaatagctagcatttttttaggagaaaagccatataaatttatttgatcatagttttacatgacatgggagccttcagaatgaagacccaaagatacaggagaaactgcccatttttgtgcttagatttagcacaatatggatagctaaaatagctagcattttattattattattattattggagacagagttgcactctgttgcccaggctggagtgcaatggcgcaatctcggctcactgtaacctctgcctcccgggttcaagcaattctcctgcatcagcctcctgagttgctaggattacaggcgcatgccaccatgcccggctaatttttgtatttttagtagagacagggtttcgccttgttggccaggctggtcttgaactcctgacctcaggtgatctgcctgcctcagccttccaaaatgctaggattacaggtgtgagccacagtgcccagccaaaaaagctagcattttatgaaggtttatataacaaatgtgagcagagtaaaagcaacttttcaattaccttagctgatcaaactagtaaatggaattcaagagtacttgatcagtctctggcaccatgtatagcatctacctagtccttaggaactatgactgcagcaagttcagtaacttttttttttttgagacacaatctcgctctgttgcccaggccggagtgcagtggcacgatcacagctcactgcagccttaatttccggggcttaagcgatcttcccacctcagcctcctgagtggctgggactataggcgtgtaccaccacacccggctaatttttttctattttttgtagagatggagtctcagtttgttgcctaggctggtctcaaactcctgggctcaagcagtccacccaccttggcctcccaaagtgctgggattacatgtttgagccaccatgcctggcctcagtaacttttaacaatgtcttttacctcaacctactattgttaagggccccgggaatcaattattcaacaaatgattatcaggagccagttatatgccctgcatctgttagggcttataacatacatactaatggccatgatgggtaggtaaaaaaccttggcatagtgaatgtcaccataaaagaattgatagagcttaactacagtgacccatattatcgggacatgaagtgactgcattctgtgattctgctagagattagagtttaagatttcaccagaattgtaactacccattttttaagtgtaagtgtcagtgctgatccaggttctcacagcctacttctgccacccattctcagacagaaggattgacacattttgcctttgtatcatactagtcctaggtgagctataaatcttaaaagaggtagtgagaagccagacgcagtggcttacgcctgtaatcccacgactttgggaggccgaggcaggtggatcacctgaggtcaggagttcgagaccagcctggccaacatggtgaaaccctgtctctattaaatatacaaaaaaaattagccgggcgtggtggtgggcgcctgtaatcccagctactcggaaggctgaggcaggagaaacgcttgaacgtgggaggcgaaggttgcagtgagccgagattgcgccactgcactgcagctgggtgacaagagcgagactccatctcaaaaaaaaaaaaaaaaaaaaagaggtagtgagaaaaatgggagatgccttttatcctgactatctgtattatcgtttccttaaagtaaaaaggcatgatatatgaagtaatcactaaccaattaaagcaatctaaatacttgattaaattccttccattttgtgactttttatttttgtttgtttgtttgttttgcgaaggagtcttgctctgtcgcccaggctggagtgcagtggcacaatcttggctcactgcaacctccgcctcccgggttcaagcgattctcctgtctcagcctcccaagtagctgggataacaggctcacgccaccatgcccggctaatttttgtattttttttagtagagacggggtttcaccatgttggccaggctggtctccatctcctgatcttgtgatccacccgcctcggcctccccaagtgctgggattacaggcgtgagccaccgtgcccagccgtgactttttatttttaactaatttcaagcttacaaaaaaactgcaagaaatagtagagaattcctgtttaccaatttcatgcaggttccacagttaatattttacatcgtttatcattctctcttaatagatagatatacatttatatatatatatacacacacacatacatacatttttttctgaactatttgagagtaagctgcagacatgatgtttatgattattttaaagccatttttagattatttatgtattcttcacactacaccagaggctgaacttcacatcggttttgagtatcagactggaaattctttcttgaaatatttggaatcatttgtagttgttgcctcaagtgcaggaaaatcaattttcctttgaatttatttaaaagtttaagtagtgttgttacagcctgtagaaaaattaaaattaaaattaaaaaattaaaattcattgtgaccttttcacacccttactgtctctgtggaggatgaagaaggctttgctcttttgcttgccacactcacagagctaaaggatacaattttatggatctttatttagaggtcatgctaaggtagctaaaagggactacctcttatgacttattttaatataatactgtatttccagagtgtgaaaattacagatggtattccaggttacctctggtacctaaaataacgaaattgctctggaacaacaggtaaagtgatgaacagaaaaaactttttttttcattgtccaagttcataattaagtctcaatagtaattatgagagaatgaaggaaccttctggttggattaaaatggtggttttattcaaaaccaaagtgattttttttttggctactcagcctcctttttgtttttctttggtttttaaaaaagcataacagcagtactatttggtaaatttcacagtctgtgttctaaataaagttctcacaatctgaatcagtatctttctgaagtgattcaattaagaccagagacaggctaattaaggaacactttactattcaaagtgtcctttgctggaatcatccaaaatccaaacctcagtgtcatgtggtgttcccatgtgacagacttgtacacgtacctcctgaatctaaaataaaagttgaaattatttttttaaagtgtcctttgctatactcagacctaggctggcagcactgccatcaactcagagcttggtggaaatgcagaatctcagaccctaccttagatgtattgagtcagaacctgcattttaacaagctcccccaggtgattgtgtatgcattcagatttaagaggcattaatatacttatttgagaagtctacattattctgtagggaagtggtcaggcttttgttaaagtttcttccaaacttgctcatcttcaacatcctgaaaaccagctcttctgtgcaggggttcctttgtctgctagctaaatagacatgagctggtattttgtccaaggacaagaatgaacaaattagatagactagtggaaatttgctcttttcttccttttctctacaggggaggagaaaatctttggcttttttttttttcaggtgcagggatgtgttagaataatttctcctttcttgggaggtaactaatactgcagtggataaactaaaacaaaatagcagaatttcagagacttcaggggagcttctgggatgatatgagcttccacagtccataaagattctctgaatactccattgtgcaaaatagactttttgctgacttattccttgcctcttcttccactgtccacagacatattaaaatttaaaaatattatatatgtatgttaaaaattcaaacaatatagaagtatagatagaggaaatttattcatctgtctgtcattctattcctgccttaaccctattccccagaagtagccactgttaatagtttggtatgtaacccccccgcccagctttcttatgcatgttctcatctatgcatacactaaaattaaaaaaaaaaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctgcctcagcctcccaagtagatgggactacaggcatgcaccaccacgcccagctaatttttgtatttttagtagagatggggtttcaccatgttggccaggctgatctcaaactcctggcatcaggtgatccacccaccttggcctcccaaagtgccaggattacaggcgtgagccaccacacacggcccataaattttcttctaaagctatgcctaaaactgacaaatagaatatttaagaatttcattattactatacccagaccaagcaccagaccaaaaacaagtttgtttagaattatatttttctctttgcttgtggtaaaaatgttcacaagttacttaatattgtatacaagtgttaattttaggttacacaatcttagaaaatgtataccacagttttttaaattcagtcacactcagatgttttagcttattaatttgcactcatatttatagacttcccagtatagcacagtagatttgttaaccataaagatatgtgatgatggccaggcacggtgactcacacctgtaatcccagcactttgggaggccgaggtgggcggatcgcctgaggtcaggagttcaagaccagccgggccaacatggtgaaaccccatctctactaaaaatacaaaaattagctgggtgtagtggcgcatgcctggagtcccagctacttgggaggctgaggcaggagaatctcttgaacctgagaggcggaggttgcagtgagctgagatcgtgccagccactgcactccagcctgtgcaacagggcaagactccatctccaaaaaaaaaaaaaaaaagatatgtgatgaggtttcatgagatcaaagtcataaatttggtactttggctgccctacccctaggtgtcttaatgatacatatggttagtcacagagctaaataaagaagtatggactagtataagcttatccccaccattgagaaaattactcaaaatgtatgtagtaatcacctcacctcatatattaagggcagaacattattataataaaatgtatggtatacggagtcatcttcagttcaatattaccttgtctgcattctatgatttctgcttcagtttagcctccattatttctaactggaatgcactcaaggctaaagcttctattattctttttttagattaattaaaaaagaaaaggagggaggttgccaagcaaatgaaaatgaaaagaagcattcaaggtttctatttaatttaagaaccaactattttggggcaattcagaaatagctttcttcatgagacaagcaatgcctatgccagttacaattttttttaagtctgttaagctgatttttccaattacttccatattatcccctttacaacctcttagcccagttagaaataactttagcctagctggagtcactacattcattttgtttttaactaagtagcattggtcttctctcaatttagtctgcaacatacatatatatttatatatattttataatatatgttatatataaatatataaatgtatattaatataatatataaatatatatgtaatttatattttgagacaaatcgcactctgttgcccaggctggagtgcagtaggaccatctcagctcactgcagcgtctacctcctgggttcaagcgattttcctgccttagcctccctagtagctgggactacaggtgtatgccaccatgcctggctaatttttgtatttttagtagagacagagtttcaccatgttggccaggctggtcttgaactcctgacctcaagtgatccacccatctgagcctcccaaagtgctaggattacaggcatgggccaccacacctggccctgcgttatatttttaaaaaatgaacagaaagagttcttattatagtttgaagagtttttttaaattatctgcaatttacataagtattgaacttatgtttttgacatttgaaaaatcaaattttcccttctatttctgtttgcccatagattacattcagctgaagcaaaaagattttttcctactttctctatacctttcctatattactgacactttcccattaactgatcacctgaattgtttgataccaacaaagcccaaaatgtaagcactttatatagaaaaattagattatattaggtattttttctttttttcactgtgtatacgtttatctacttttttaatttttaatttttgtgagtatataataggtatatatatttataggttacatgagatgttttgatacaaacatgcaatgcataataatcacatcatggaaaatggggtatccatctcttcaagcatttatccttgtgttataaacaattcaattatattctgttacttttaaatgtacaattaaattatgattgactatagtcacactgttgtgccatcaaatactaggtcctattcattctttttatttgtacccattaaccatccccacttccccttacaacccccactatcctgtttacttatttaaagctattaaattaatatttaatcattttttctttttttatcaaacctcagacttgacctatggactgttgatccccattccctgtcaggtagccatcaaatgccacagaatcctagaaagaacttctatttttgctatgtagaattaattttcttcctggcaatgacagcaatagctggcctagaaaagtggaatggttgttaaaaaaaaaaaggtttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccaggatgtattatttacttaagcaaaacaagttgcagtgtaatacttatggcataatctcatttagtaaaaaatgcaaaactacatgtatgtgtacttacatatgtatataaacacctagagaaaggactagtatatacacatgattaacactgtttatctcaggaagagagcgggattgagggagaagatcaaagagaaacttgcatcttttcaacattgaaatttttacagctagaatgtatttaaatttatttgtataacttaaaaaattaaaacaaaaaatcttgtaccaaaataagttccagtttaagcaaaaattcaaatgtaggctgggtgtggtggctcacgcctgtaatctcagcattttgggaggccgaggtgggaggatcacttgagcccaggagttcacgaccagcccaggcaacaggtgaaaccccgcctctacaaaaagtaaaaatttaggccagtcatggtggctcacgcctgtaatcccagcactttgggaggccgaggtgggtagatcacttgaggtcaggagttcaagaccagcctgaccaacatggtgaaaccccgtgtctactaaaaatacaaaaattagctgggtgtggtggcatgcgcctgtaatcccagctactcgggaggctgaggcatgagaattgtttgaacctgggaggcagaggttgcactgagccaagactgcgccactgcactccagcctgggcgacacagtgagattccatctcaaaaaataaaaaaataaaaataaaaataaaaaatttaaaaagtaaatatttagccaggtgtggtggtgtgcatctgtagtcccagctacttgggaggctgaggtgggaggattgcttgagcctgggaggttgaggctgcagtgagctgtgttcatgccactgcattccagcctaggtgacagagtgagacattgcctgcctcccaaaattgaatgtaaacaatgaaaccatgaaattactagaagaaatatttggagcattttttttcaatattatgaaactttcggacatacagaaaagtcagaagaattgtacagtagatatcctatatacaccagctagattctacaattaatactttactatatttgctttatcatacatcaatccatcaatacatcactgaaataattttagactcacaagtaagtaaaaaaaagtacagaaaatttccatgtagccttcatctagcttttcccaatgataacatctaattcatttataaaacaatattggaggctgggtgcggtggctcatgcctgtaatcccagcactttgggaggctgaggtgggtggatcacctgaagtcaggagttcaagaccaccctcgccaacatggtgaaaccccgtctctactaaaaatacaaaaaattagccgggcgtggtggcacgcgcctgtaatcccagatactcgggaagctgaggcaggagaatcacttgaacccgggaggtggaggttgtagtgagccaagatcacgccattgcactccaacctgggcaacaacagtgaaactccatctcaaaaaaaaaaaaaaaaaaaaaaagaaaaaaaaagaagaaaaaaacaatattggatttggaagcgtttttctaaaatatgatacaaaaccaataaaagaaaagattaatagattgatgaattcagatacctaaacatttcttcttgggatgaagacaccaaatggaaagtcaaaaggcaattaaaataattataattcatatcatagatgaaggttaattttttcatatacgaagaacttttatacatcaataagacaagcgtcagcaccccaaaatttcttttctatgataaaggatatgaactgacagttcacagaaaagcaaaaacaatacctcttaaacatgaaaagatgttcaacttcattcgtaatgagtaaagcaaattaaaatggcactgaaataccattttcacttattggattggtaaagttaacaattttgttaacactatgtttctgatctctcatgtattgctggtggtgtgtacattgatacaagatgccaacagaggaatttggcaatatctgtcaaaggtgaaattgcacatagcctttgcctcagaagttccacttgtaggaatttatccaacagacatttttgcatatgtatgaaatgacatgtatgcaaagatgttcattatagtattgtttacaatagcaaaatatgaggaaaaactaaatttcagtcattagggactaaaattatgatacaatcatatcatgggatactgagtagctattaaaaacaatgaaaaagaatgagtaggtttttatatgtttttaaggattaaaaaataatagcttttttgaaataccataaaactcacctttttaaagtgtacaacccagtggtttttagtatattcacagacttgtgcaactatcactactatctgatttcaaaacattttcatccccattaaaataaaactcattagtagtcattctttagtcctaatctcttacctgtactggttctactctctctaccctaggcaaccactaatctactttgtatttgtatagatttgcctattctggacatttcatataaatggaataatataatatgtggtcctttgtaaccggcttcttttatttaccatagtgtattcatggttgatccatgttgtagcatgtatcattactgcattcctttttattgccaaataatattccaatgtatgaatatactacattttgttgatttagtcatcagttgatggacaattgggttgtttccactttatgaatattgctgctattataaataatgctgctatgaacattcatatacaagtttttgtgtgaacttatgtttttaattcccttggggatatacctagaagtggaattactaagtcatctagtaactctatatttaaccttttaagggactgccagactgttttctaaagcagctgtaccatttcatatccccaccaacattgtattgacgttccaattgttccatatgcatgtcaacacttgctattacctttttattatagctatcccagtggaagtgaactggtatctcattttggtttgatttgcatttccctgatgactaataatgttgagtatcttttcttgtgcttattggcctttcataaatgttctttggagaaacaattcgaatttttaccttttttttttttgagacggagtctcgctctgtcgcccaggctggagtgcagtggcgcgatcttggctcactgcaagccccgcctcccaggttcacaccattctcctgcctcagcctaccgagtagctgggactacaggcgtctgccaccatgcccggctaattttttgtatttgtagtagagatggggttttactgtgttagccaggatggtctcgatctcctgacctcgtgatccgcccacctcggcctcccaaagtgctgggattacaggcgtgagccaccgcgcccgaccatttttgcccatttttaattggattgtttgtctttttattactgagttgtaagaattctttatatattctagatacaagtcccttatctgatatatgattttaaaatattttctcccattctggtattgcctcttcgttggcggtgttgtttagagcacagaagttttctgggtacagcataggtgcatgtgcctgtatttatgaggtatatgagacgttttgatacaggcatgcaatgagtaacaaacacatcatataacatggggtatccatcccctcaagcatttatactttgtgttacagataatccatttatactcttttagttatttttaaatgtatgattaagttattattgactatagtcatcctgttctgctatgaaatactatgtcttattcattctattttttgtactccatgttgttttcttgaataaatgcttcctagattgctgcaagcttttgtttgatttccagatttctggaaaaagatggttcttacaatttctgccagttttctcattgcttttacagaggagagaattttagaggtcttactgcaccatttgcactgatataccttcagcagatattcttgaataaatccttcttaatttgtggtatgccctttggtcaatttccagagtatttcaatggctgttttttgatacttttgtcagttttatcattgctttttgaggaaaggatttgctgagctcctcacgcagtcattctagaagtcatgcccatccattttataatttaacgcccagctaaactataaccccactcaagatatagggaaagatacatttttagacatacaaagtcaaaacacttttgccatccattaatttcactgaaagctatactagtgattatatacttcagcaggatgaaaaaaaaatccagcgggaagcaagactggatacaagaaacaataataaatgtcaaatcctctatcactgagtagtagtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctcttaaaaaaaaaaaaaaaaaaaaggaagaaatatctgattttccttgtattatggaatatccattggatcatagatgatagccccacaggcttgtgcagcaatttgaatacctccctctgcatgtacatctattgaaatacaaacacgattgttttggcttaatctccctttagtgtttatggattagctaaaagccaaagaaagtgactattgatactttaagttattgagatatatatgtgaatttcagcattttttaaaattcaatgattatcattcctatattgcagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaaggtaaagtaagaaagggtgacatttgttaaaatgttgggtggataaatgaccttagtattttttaggccaatcattggaaatacatgcttttatgtagttaaccatttactgaaagacgtattttcattttggcaatattttaagttaaatatcagtttagaagatttaccaaatatggaattaatactgtagatagtacagtatgtctgtttattttaagagagacaaatgagaaatacttatcacttatttacttacattattaattgaaaaattgacatgaccacatggtttaaaataatgatagaaaaaattcacccatattcccttgctataatgtaaatcattttctaattccattctacatacctttctacttaacagagttgcaaatgtagtattcatactactttgtacccttaacactataaagtttttcaccatttttgcagtctagattattatctaatatttctgactaagtctgtcacatcagtttgctttaatttaataaaccattcaggtgtttttcaccattagattgtttctaattttttatttttagataatcctgcattgaacatactcatgtctaatagtcatttccattgagctaatatcttagaagacattacaaaggatgtgtttactgggttaaagggcataaatatttctctggttcatggtacaagttgtaacagtttttgccagcaggggtatgtcagtgaagtatttttactacaacttcaccagcattgcatcccccccacaaattctttctaagttaatagacattaaatggtattacagggtaactttagtttgtgtttcttccattaatggtggggataaacattttttcatcatcggatgtttatatttccttttgaatgatttgcttatatatgtcctttgcctgtgtgtttattgggttcatgtttttcttattaatttatataatttcttcataaattatacctaataatacttttaaaatattttgtgtacttttaggctgggcgcggtggctcatgcctgtaatcccagcgctttgggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatattgttttacggctaaatattctgtgttatctctaaaaaaggatatattctgatataactatactaccgtactgtacctaacaaaatgaacattaattccttaatgtcacctaagacccaattcatattcacatttctcctgttgtctccaaaatgttttaagtctctttgcctgaaatagaattcaaacaagatccatgcatcatagcatttgactatcatatggcttatgttcttttaatctaaaacagcgcctctcttctttctcctcattgtccttccttccctcctccccacaaaacaattgacttgaagaaatagccatcagttgttctgtagaatatcccacaatgtgaatttatcctttgtttccttttggtttcatttaacttgttctataactcctatgttacttgtaaattggaagataaagctaaagacttgattatatttcattcttttgtatttctcatttttatactaataaaattgtttaggcaaagttacataataaagaaatttttagttaaatgaaacccattacattattttttaaaactttcatttttaatttaatgactgttcaaaaaaatagagtgcctactttgtgctagctactgtgctgttcactaacagtaagcaagactgacatactagttcctagtttaaatgttggttctagcttccattggcagtaattatggagccacaagcttgacgtgaactaaagagcttacatggagaggtcagggtaggaagcatattatcatggtgctttttatgttaacttatatccagtgaagaacaagtggatgtggaacttgtacaacgtggagatatcattaaagtagttccaggaggcaaatttccagtggatggtcgtgttattgaaggacattctatggtagatgagtccctcatcacaggtatgttctttcaaaggatcatgaccaaaatgttaagaaaaatagacatgaaagatgaagcactttttgtagaagctatgaataactaaattatgaacagagagaataagttcttttaagactgtattaaatcaatttcctcagatttactttgtggctttagttatgctattagtccattttcacattgctataaagaaatacctgaaactgggtaatttataaagccaagagatttaattgactcacagttctgcatgtctggggaggcctcaggaaacttgtaatcatggtggaggagaaggggaagcaaggaccttcttcacaaggcagcaggagagagaagtgctagcaggggaaataccagatgcttataaaaccataaggtctcatgagaactcactcactatcatgacaacagcataggggaaaccgcccccatgattcaatcacctcccctcctcgacatgtggggattacaatttgagatgagatttgggtggggacacagagccaaaccatatcatcccacccttgacccctcccaaatgtcatgtcttttcacatttcaacaccaatcatgccttcccaacagtcccccaaagtcttatttcagcattaactcaaaagtccacaatctaaagtctcatctgagacaagacaagtcccttccacctatgaggctgtaaaatcaaaaacgagttccttccaagatacagtgggggtgcaggcattggataaatgctcccattccaaatgggagaaattggccaaaacaaagggactacaggccccatgcaagtccaaaatccgttggggcagtcattaaatcttaaagctccaaaatgatttcctttgacttcatgtctcacatccaggtcatgctgatgcaagaagtgggctcccaaggtcttgggcagatccacccctgtggctttgcagggtacagcccctgccactggctgctttcactggctggtgttgagtgtctgtggcttttctaggtatacagtacaagctgttggtggatctctaccattctgtggtctggaggatagtggccctcttctcacagctccactaggcagtgccccattggggactctgtgtgggggctctaaacttatatttcccttctgcactgccctagcagaggttttccatgatggcttctcccctgcagcagacttctgcctgggcatccaggcatttccatacatcctctgaaatctaggcagaggttcccaaacctccgttcttgacttctgtgcacctgcaggcccaacaccacgtggaagctgccaaggcttggggcttgcaccctctgaagcaatggcctgagttgtaccttgaccccttttagccatgactggagctgaagctgctgggatgcaggatacgatgccactgaggctgcaaagagcatcagaggccctggttcccagcccacaaaatcattttttctcctaggcctcagggcctttgatgggaggggctgctgccaagatctctgacatgtcctggagatgttttccccattgtcttggcgattaacatttggctcctcgttacttatgcaaatttctgcagcccgcttgaatttctccccagaaaatgggtttttcttttctattgcattgtcaggctgtgaattttccaagcctttatgctctgcttcctttttaaacataagttccaatttcaaaccatctctttgtgaacacataaaactgaatgctttcagaataatgtaggtcatgtcttgaatgctttgctgcttaaaaaatttcttctgccaggtatcataaatcatctctctcaagctcactattccacagatctctagggtgggggaaaaatgccatccgtctcttttcttgtttctttttttttttttttttttttttttttttgagacggagtctcgctctgtcgcccaggctggagtgcagtggcacaatctcggctcactgcaagctctgcctcccggttcaccccattctcctgcctcagccgctggagtagctgggactacaggcacccgccaccacgcctggctaattttttgtattttttattagagacggggtttcaccatgttagccaggatggtctcaatctcctgacctcgtgatcagccggcctcggcctcccaaagtgctgggattacaggcgtgagccaccgcgcccggccaccacccatctcttttctaaagcatagcatgagggacctttactccagttccccataagttcctcatctccatctgagaccacctcagcttggacttcattgttcacatcactgtcagcattttgatcaaaaccattcaacaagtttggctgggcgcagtggctcatgcctgtaatcccagcactttgggaggctgaggctggtggatcgcttaaggtctggagtttgagaccagcctgaccaacatggtgaaaccccgtctctactaaaaatataaaattagccaggtgtggtggagcatgcctgtaatcctagctacttgggaggctgaggcagaagaatcacttgaactcaagaagcagaggttgcagtgagccgagattgcaccattgcactccagcctgggcaagaagtgcgaaactctgttacaaaaacaaaaaacaaaaaaacctaacaccattcaacagatttctatgaagttccaaactttcccacattttcctgtctttttctgagccctccaaactgttccagcctctgcccattacccagttccaaagtcgcttccgcattttcaagtatctttatagcagtgtcctactccctgtggtaacaacttactcaatttactacattagtcagttttcacactgctctaaagacatacccaacgctgggtaatttatgaaggaaggagatttaattgattcacagttctgcatgactgggaaggcctcaggaaacttaaaatcttggcagaaggtgaagggggcaaggaccttcttcataaggcaacagtagagagaagtgccagcaggggaaatgccagacacttataaaaccatcagatctcgtgaaaactcactcatcacaagaacagcataggggaaatgcccccacatgactcaatcacctccctcccttggcatgtggggattataggtccctccctcaacatgtggggattacaattagagatgaaacttgggtggggacacagagccaaaccgtatcaactattgaagacttttatcactggagattattagctgctagaatgcataaccaaaggaagttgtctcagtttcctgtagacttgatggactttggcaaattttcctgggcaaatacctattctgcccttcctgctgtaaagactggtctaatctgagctatgacacgagtccaggttttccacatcagggtctactctaagggaataggcctggcatagttttagaaattttaggtaactaaggccaatctgaggcagaatcaaaatgatacctttccaatctcaactctctgatagtcctagaagaagctcagtttatgaaccatgtggaaataatttaggactgtgtgtttctttctttctttcttttttgtttttttgttgttgttgttgttgagacaaggtcttaccctgtcacccaagctggagtgcaatggcacaatcttgactcatggcaacctctgcctcccaggctcaaacaatcctcccacctcagcctcccacgtacctgggactacaggcgcatgccaccatgcctggctaacttttgtatttttttgtagagatcgagttttgccatgttgcccagtctcgaactcctgagctcaagccatctgtctgcctcagcctcccaaagtgctaggattacaggcatgagccgctgtgcccaacaagactgtgtgtttctcaataggggtgctattgccagtttggatggggcaattcttagttctcggggactctcttacatactgtagtacaattcagtgcccctgaccctggcactggcacactaaatcgaagtagtagcacccccttccccatcccgtgcagtcattattacaaacgaaaactccctcccacatttctaaatgttccttgagaacaggttaagaaccaatgttctaggactagggtgaaactctaaaagtatctgccaacaagagctaccatacaggtttttccagttcaaggtttatattcctggcattggcctagaactgatataaggaaaaagggaaagcaactttcacctaggcatttgttcagattctattttatatctagatatttttgacaagtaacaaataatgatatgtttcatgatagtgatcatttatgctccttaaatctatctttactctccatacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggtaacttaactccctaggagaaacacaaactattttctttaaagccttctcagtataaatcttcacctagtttttacgttttccaataaaaattttagttgcattaatatggagttcgtttgtttttgttttgagatagggtctcactctgttgcacaggctggagtgcagtggcaccatcatggctcactgcacccttgacctcctaagttcaagcgatccttctgcctcagcctcccgagtagctgggactgtgtgtgggcacatgccaccacacccagctaattaaaaaaatttttttttatagaaacagggtctccctaagttgcccaggatggtctcgaactcctggactcaagctatcatcctgccttagtctctcaaagtgttgggattacaggtgtgagccaccacacctggccattaacatgaagtttgttaaaatatttctatttgtgctaactactaaatatactctgcattcagtatcagaaaagactttgatatgcttcttcttcttattattgttgttatttttaattctaggctcctatccagcagtttgcagacaaactcagtggctattttgttccttttattgtttttgtttccattgccaccctcttggtatggattgtaattggatttctgaattttgaaattgtggaaacctactttcctgtaagtgacttgtaataactcgttactatatgcagaacaatttgtgagtcttttgcattagtaattcattggaaataactttaataattaccaggatctttaaaggtttggagtgggagagtgataagaataatatttgcatttttataaatataaaaaatttccttttggaaaaaaaattttattatgactggtgattttccaaaagcaaataccaaacttttacatgttatgcttagtctcatttctgacatggttttgctttcacagaggactatagatatattgaggaaaacctcaggatttcagctctgtcatttactgtcaatatgatcttagactacttaattgctctctgagcttcagtttcctcaactataaagtgaggttttaataatacccattttgtgtaacttaaggttgttgtgaaggttaaataatatattagaaataatttgtaacttattaaatgctttacaaatataagatattattagtgtctactcatctagttctctgatgctgtctatggtgttgtaaagtggtaaagcagaactggactgtgcctcaaattagatatataaactttaagtcatgtaagttttactatcctcagttctcttatctgtaaaatagggaaaatagtacctaagatacaggattggaattagtataggtgaaagcatctaacatattgacagatgcaggtgacagccaagggtccccctgcgaaacccctgaaggttgaaaactttcaagcctaaaacatcctgaaggttgaaaaaccggactgctggtcccagatgaagcctgccctactcccctacccccgactgattctttctaaataatgtccacctacgcactgggaggatggggtggggcccctggaagttcaccccgtttgtatagggaaggagtctggactgacctgttcctgggtggtacctggggttcagtcggtgaggtggagagcctgttaacaggactcaatctcattttgttgagttgtttttcctttttcctttttggccaataaattcctttcccctcgcccttcaaagtgtctgcagacctaatcttttcctggtcgtgtgacaagaatctgttctttttctataacaacatgtatacatatgtgaagtttatggaagcataagcctagaaatctatgaaagccccttccagctgtgtttctatatagatctataattcttggatgaatatttaagtatttgagaacttaacctaacactgtaaaactgttactgataagagctgcagtgagccatgatggcactaatgtactccagcctgggcaacagagcgagactcctactcaaagtaaataaagtcttactttgttgtatttatttattttattttttattcaggaggtacatgtgcatgtttgtttgtttgtttgtttatttatttatttatttatttatttattgcgacagagtcttgctctgttgcccaggctggagtgcagtggcacgatctcggctcactgcaacttccacctcccaggttcaagtgattctcatgcctcagcctcctgagtagcggggattacaggcttatgtcaccatgcccggctaatttttgtatttttagtagagatggggtttcgccatgttggtcaggctggtctcaaattcctgacctcaggtgatccacctgcctcggcctcccaaagtgctgggataacaggcatgagccactgtgcccggcccgtggatatattgtttattacatgggtatattgggtgatgctggggtttaggcttatagtgaccccatctcccaaacagtgaacatagtactcaataagtagtttttcatcccttgcccccctcccttcttctcaccttttggaggccccactgctcattgatttcatctttatgtccatgtgtagccattgtttagctcctgcttataagtgagaacatgtagtatttgattttctgtccctacgttaactcacttaggataatggcctccagcttcacctatgctactcaaaggacatgatttctttttttatggctgcatagtattccatggtgtatatgtactacatttcctttatccagtccaccattgatgggcacctgggtgactccatgtctttgctattgtgaagagtgctgtgataaacacacacatgcagttgtcttttgataaaacaatttaaaataaatataagaaaatcctttgggtagatatccagtagtgggattgctgggttaaatggtagttatattttaagttcttggagaaatctccagactgttttccgtagaggttgaactgatttacattcccaccaacagtatataagtgttcccttttctctgcatcgttgccaacatctgttattttttgatttttttaattatagccattctgactggtgtgaaggggtatttcattgtggttttaagttgcatttccctgatgattagtgatgttgagtattttttcatgtgtttttttttatcacttgtatgtcttcttttgagaggtgtctatttatgccctttgcccacttttaaatagggttgttttatccttgttgatttaagtttcatatagagtctagatattagtcctttgttggatgcatactttgcaaatattttctcccattctgtaggttctgtgtttattctgttgattgtttcttttgttgtgcagaagctctttcgtttaattaaatctcctttattaatttttggttttgttgcaattgtttttgaggtcttagtcataaattctttccctaggataatgtctagaagagtttttcccaggttttcttggggtttttatagtttgaggttttacatctaagtcttcaatctatcctgagttaatttttttatatggtgagagatatgagtccagtttcattcttctgcatatggctagctagttttcccagcaccatatattgaatagggtgtcctttccccattgtttgtttttgtcaactttgttgaagaccagttggttgtaggtgtgggctttatttctgggttctctattttgttcagttgatctacgtgtctatttttgtatcaataccacgctgttttgattactatagtcttttagtataatttgaagtcgggtaatgtgatgcctctagttttattctttttgcttaggattgcttcggctatttaggttctttttccatatgaaatttaggattgctttttaaattctgtgacagagaacattagtagttttataggaattgtgttgaatctatagattgctttggacagtatggtagataggattagggttagacatggagagaagatcatctcctgccacacccttcccccacacctacagtgctgcggatgcagcagtgctatttcccaccaggggccagctagcgcacacttggacaaagcatatttcatgcttttcatggtggctccacccctactgcaagtgagtcacgtgccgcttgggttttttccaagggcgaggctcaactccctctcccgacagagtggcactgtcccagcaaggagggacagacaaatcactgagttgcctgctttggtctgggggaaaagactaacccaaacccattttagtggtagctatcagaggggcatactcatgggaaccaaaggacaaagtccttatgaaatgaaggtcaggagccctataacaagggcacaaaagagaagctgatcatgttcttgctggcacaggatcaggagtgcgagtgcaccctaatataatctcttcccaccacccctgcatcagggcaggtgcttctacctggcaccaacctacctgctgtctcttactcttgagtgccatctactggtgtgtatcctgaactgcatcataaaatttaaaatctgctaacagaagggcttagttctagcccttaagataagtccacagggacctctgcaccctaaaccctataggagattgttagctctaatggctaatacctcactacaaaaagcagcatctgagaaagctatggcatagaagctatccacaaccaagtaatctgtacagcaccttggacccctgaaagcaccaaaaacaaagctaaatgatcacacacaacatgcaccacagtaaagcacccaagggaaaaaaaagaaggaaagaaaacgtcccttggaaatgatagcaaattcaaaaacaggaagcaaaagttcccttggatgggaaagaatcagtgcaagaactctagcagtacaaaaagtgttttcacaccgccaaacgattgtaatagctctctagcaacggatcctaagcagacagataagtaatttaaaatatggattgcaaggaaacctcaatgagatccaaatgaaagttggaatccaatgtaaagaaaccagaaaaacgattcaggatatgcaagacgaggtagccatattaagaaaaaaaacaaatggaactgctggaactgaaaaattcagtaaagaaatttcaaatccagagaactcctgcaagacactatacaagatgaccatcctcagggcacacaggcattagaatatccaaagtcaatgcaaaagaaaaatatcttaaaggcagctacagaaaagggccaaattacctacagagcaaaacccatcaggctaacagcagacttctcagtggaaatgttacaagctggaagtgattgagagcctatttttagtttccctaaagaaaaaaaaaactggcaaccaggaatttcatatcctgccaaattaagcttcatacatgaagtagaaacaaagtcttcctcagacaagcaaacagtaaggaaattcatcaccaccagaccagagctataagaaatgttcagagaagttctgaacatggaaacaaaagaatgatacttgctaccacaaaaacatatataaatacaaagctcacagaccctataaagcaattacacaattgagactacaaagaaactagcaaacactaccataaggaacaaaaactcatatatcaatattaaacttgaatgtaaatggcctaaatactccacttaaaagacatagagtggcaaattggaataaaaaaacaagatccatccttttgctgtcatcaagagacccatctcaaaggtaataactcataggttgaaggtgaagggatggagaaagatctatcatgcaaatggaaaacaaagagcaggggttgctattcttgtattacataaaacagagtttaaatcaacaatagttttaaaaaaaggcaaagaagggcactacaaaatgataaagatctcaattcaacaagaagatttaactatcttaaatacatatgcacccaacattggagcatccagatttataaaacaaatactgctagacctacaaaaagaggtagactgccatacaataatagtggaggacttcagtaccccactgacagcactagagagatcatcaaggacaaaaattagcaaagaaactctgcacttaaattggattctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaaccctatctctactaaaaaatacaaaaattagccaggcatggtggcacgcacctgtaatcccagctacttgcgagactgagggaagagaattgctcgaacccaggaggtgtaggtttcactgagcctagatcacgccattgaactgccgcctgggcaacaagaacaaaactccgtctcaaaaaaaaaaaaaaaatctctgttcctgatgacatgattctatacctagaaaaccataaagatttctccaaaagactcccagaccagataaactacttcagtaaagtttcagggtataaaatcaacatgcaaaaattattagcatttctatacaccagcaacgtccaactcgagaactaaatcaagaactcaatcccatttacaataatcacacacaaaacatacctaggaatacatttaaccaaggaggtgaaagatctctacagagagaagcataaaacactgatgaaagaaactgaagaagacacaaacaaatggaaaaacattccatgcccatggattggaagcattaatattaaaactaccatactgtccaaagcaatctatagattcaacacaattcctataaaactaatgtcctctgtcacagaattaaaaaagcaatcctaaaattcatatggaaaaagaacctaaatagccaaagccatcctaagcaaaaagaataaaactagaggcatcacattacctgacttcaaattatactgcaaggctatagtaatcaaaagcatggtattgatacaaaaatagacatgtagatcaattgaacaaaatagagaacccagaaataaaaccacacacctacaaccaactgatcttcaacaaagttgaccaaaacaagcaatggggaaaggacaccctattcaatatatgatattattatatgggattacagacatgagccactgtgtccagcccactactgtaatattaaaaagtttctttaagtgattcatgtctgtttagtacacactgaacaaaaggattgttgggaagtttttttggtatttatttatttatttatttatttatttatttatttatttatttttgagacagggtctcgctctgttgcccaggcaggaatgcagtggtgcaatcatggctcactgcagcctcaaacttctgggcttaagcgattctcttaccttagcctcccgagtagctgcaactgcaggcatgcaccaccatccctggctaattttttttttttttttgagaccgagtttcgctcttgtcacccaggctggagtgcaatggcatgatctcggctcactgcaacctctgccttccaggttcaagcaattcttgtgcctcagcctcccaagtagctgggattacaggcatgtgccaccatgcccagctaatttttgcatttttaatagagacggggtttcaccatgttggccaggcaggtctcggactcctgacctcaggtgatccacctgccttggcctcccaaagtgctgggattacaggcgtgagccactgtgcccggccatacctggctaatttttcacaaattttttttgtagagatgaggtcttaccatgttgcccagggtggtctcaaactcctggcctcaaatgatcctcctgccttagcctccaaaagtactgggattacagatgtgagcccgtgcacagaccagcaagtagcttggaatgtgtttccttcaggaatttttctcatgagttcaggatgtcttagatttcttctaaaactaccaattatatttttcccacatgagcaaacactgaacgtcactaagagcttaattagcagatatacttggttcacattgttatgtccaaaaggattttgttgaaatatgactaaggtccctttgcatgccatgtgattctttttcattgtctttcaagaatagtgtgaaaggcagaattatggttttactctacagagattgagaattctgtttattcagtatcaaattttttgaaaattatgtctcacatttgcagctatttctgaaaatttctaataaaaacattcattctcaatatggagcacttatattcagtccatagtttgtaattctggaatctcagtatgtcccaatttcttatattcataaaagaaagaaagtgttttcttacctgtaactaaaaaatatatgtaggtagctaggtaggatatgtcactttttaaattgtggttttatttaaatagtgttaagttttgtgtcttttgttttgtacagctctaaatcaataaccaaaatttatgcctttcttctaaagggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaagacagtccccagaactaaaacctgtaccaccaaactatcaatagcacccctcacatgtgagaaacacatactcctaaattatttctctgtggtccatgagctgagctgcttctaggactatccagagatttgaggtaggaaaggtgttattttggttctgcttcagattggcctttgttacctaagattcctaaaactactccaggcctatttattagagcagaccctaatgtggaaaacctggactcctatcctagctcagactagactagtctttgtggcagaaagacagaataggtgtttgcccaggaaaatttgccaaactccagcagccttctaacctatttgtgtgtgacttgttttcttcactgggaccttcaattgcagtgccgtttctttgcctttgctgccaccagccgacagtttgcagctatgactttaggaatataatcctatctctgatctcatattaggatttccataatcatctcaaagctacttgacttcaactaaaaccatgtttctactagtatgttcttattatgaggatgtaagctatgtacagaggtatatagtaaacatagaacatatcttagaacaaatctggaaactcacctcgccagagaatacaggctagtaatttttatagacattttaaactttgatataatttcaaacttaaaagtcgcaagactagcctggcacagtggctcacgcctgtaatcccagcactttgggaggctgaggcaggcggaccacgaggtcaggagtttgagaccagcctgaccaacatggtgaaaccccgtctctactaaaaatacaaaaattagctgggcgagttggcacacctgtaatcccaactactcaggagactgaggcaggagaatcgcttgagcccggagggcaggggttgcagtgagctgggatcgcgccactgcactccagcttgggcgactgagcaagactccatctcaaaaaaaaaaaaaaatgttgcaagactagtacaaagaactcctatatgccctttactgcagtcgttgggctcttttcctaagaataaggacattctcttatgtaaactgtagtacaactatcaaaatcaataaattaatattgatatgttgttatctgatctgtagtccatgttccagtttcctcagttgtctcaataatgtgctttatagctatttttcccctgtccagaatcatactttgttggtttatttttcttttctttctttctttctttttttttttttttgagatgaagtctcgctctatggcccaggctggagtgcagtggtgcgatctcggctcactgcaacctccacccaccaagttccagcgattctcctgcctcagcctcccgagtagctgggattacaggcatgcaccaccatgcccagctaactttttattattagtagagacggggtttcaccatgttggccaggctggtctcgatctcctgacctcaggtgatccatacacctcagtctctgaaagtgctgggattataggcttgagccaccgcacctggccatttacctttattcttataatcatttccctactgcttagatttcctcatcagatctataattcattatattgaaagcctttcttttttaccttgaggcactagaggcgtctcttaattacctattaacagtcaacccttaaaaattagctctagttgtttaacatatattcacagttatttagcatgaacaaacagttcagcattggcagaggagagctgttgtgtataactaagagtatttcttcttttattttcccgaagaccatcagttttttaagtcaaattaagtcaaaggtcagtttactaagaaactaaatagtcatctctttgtcaaaacagaccttttttcttatttctggaaaggtgatgtggaggatcatcaagtcattgtatcttaatttttttacaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggtacatttttttcctcttgtttattagtgtagtcatctcctgtaggaattccccggatcaaatctagtctggtgtttgactgtgatttgcatatatagttggtatgaggctaaaaagacttgtattttctcatttaattgtatgtaacttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgtgcatctgttaaccgtttttaatgcatatagccacatatacgtatttatcatcttttaaactttatacagaaaggtcatacaatgatcaatctttgttaccttgcttttttattttattaagtgaattttcctgtcaggaaatgcagatctgcctcattgtttttaatggctgtattatactctatagtgtgagtgtttgtttttttttgacttttgcagtatatactcaacatccttatcagtttttgcaagtctgtctctacattaaatgcctatcaatgcaattgctaagtcaaaggatgcatgcagttaaattttgatgaatgctaccaatacccatatgatgaatattaccaatatacatgaggggttataccaatttatacctgcaccaaaagttatgagtgctcatttccccacattcttaccaacgctttatttttattttctcaatttaataggtgaaaaaatatttacttgatggtttgctttgcatttccttaattatgaataaggttgagcatctttttatatatgtattgaccatttgaatttcttttcctctaacctgtttgtatctatgacctatttttccacagagttgtttgtctttttcttattcatttgcatgagttctttatgaattgtctcacattaattttacacttaaaacgtggcagtttctaccattggtgttgccatttatttatttgttctttctcttttacctattacctattactgacctggcttccttacacccaaatcaaacagcagagaggatgaagctataaaaagctaggaaacaatgagggcccccagaacttttcggcttgctaaagatgtagactatagagcagatggagagcctccggtaactaaaggccctatactttgttactctttgccctgtactgagtagaaaacctgacttgactatggagttaaaaatttaatttgtaattatctactggaaagagcagagaatactgataagctttccatgttttctataaattttagagagtgggattaaaacaaagatttttttttattattgtttttgagacagagtctcactctgtcacccaggctggagtgcaatagcgcaatctcaactcactgcaacttccgtctcctgagttcaagtgattctcctacctcagcctccctagtagctgagattacaggtgtgcaccaccacacctggctaaatttttttgcacttttagtagagacagggtttcaccattttggccagcctggtccctctgcccacctcggcttcccagccggcttcttcagctgggattacaggcatgagccactgtgcctggtcaaaacaaagactttgaggctcttctgtaactttgaatgttatgtttgatgctctattcctttgtccttatcaaaatccactgtcaagtaggcaatatgtgacaattttattataaacatttagaattaactaggggtttttatcttgctaatgaatgaccttgcattatcagaacagtagaggaaatccttttgtttctgtttgttaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaagtaagctaattttctttgtagtaccaattatggggcagttatgaacagatggctaactttataaccctgaactgttatagaagaaacaaaaattggcatcataatttcatttcctcaagtcaataccctatgccttctgatcatttaaattagtcaagaatatttcccaactgtggtcattgacaccaccatagggtgatgaggtctagccttagctgatcatccatgatcattcttttgtcactacaactactccaaaccttttctatctttcacaagatcctgtgactctctcctttgtccctctgcaaattatcttattttttatatagaaaattatggttcttgggcatgtgttcttacatatttttgcccagaatcattccttttttcagggaaagcagtatccttcatcttgcctaatgaatcccttcatctagatcccaccctctcttgattcatcagggacctccctctttctgttaggtccccttgctgctttatttttcatctctttctgttttagcttcttttcttaaacatataaacatttcttccatcaaaatcactatattcccatctagattttgtcctttcccatctatattcccatatagattctgtctttttcttttatatccaagttctagaaatggtaatctaggtttgttgaattcacttactccacagtcatgcctcagttcattgcagtctggcttctcccccatccatactactgaatccgttctttctaagttaactgatgaccattgacctcactgctctctccagtggtcacttttcagtcctcatcctgcaagacctcattaagatatttgacaatgttgaccatcccttccttcctaaaggatgattccatgaccctgctttgtctagattctcctctcacctccctggctgttcctttttttttttttttgagaaggagtcttgctctgtcacccaggctggagtgcagtggtgcaatctcagctcactgcaacctctgcctcctgggttcaagcaattctcctgcctcagcccccaggaagctgggattacaggtgtgcgcagccatgcctggctaattttttgtatttttagtagagatggggtttcaccatgttagccaggatggtctcaaactcctgacctcaagtgatccacccacctcagcctctcaaagtgctgggattacaggtgtgagccactgcacccctggctgttccttttaattgtcctttggttcctcatttctcttgctttcaaatgtcgtatgtcgtcagggttttgttctttgtctttttctcattttataatacatactctctctgtacaatcttattcatgctcatcacttagtctaccacccacagacttccactaccgctctaaaatccatatctttagctaagtcctgtttccttggctccatgccgatctatctatctgcccccaaaacatgatctacccacctaagtgttccaacacctccctcccgatttgtgcctgagtgattttgctaacatggaaatctagtcgtgtcactctctaaccagtaccttttattacagtgttttataagctgtttttgagccatagacctttggaggaatatgatgaaagctatgggcccacccctcagaaaatttttgtttcaagagatgcacatgtatcctgaaacccatccacgggtctctgttaaggatcccagctttaatgggtctctctctcctatgggacaaagtccagtctctctggactttgttttagatctgttccccatgatatgtctcctgcctccctgcatcactcatcttctttttccactaccgcatatgtactccatgttccatccctacctaactacttacagttcttccttacggtgtgtcatttccttattagatcatttcatttaccattttctctatgtaatgttcttgttcacaaatggcatctatctcgtgaacttacgcttatctttcaagacccagcttatatctctctcttcagtgacaccctcattgactgacatatattgacagaggtatttgctcttcttcctgaatcataactgtacttaatctctgttactgtactaggacagtgtatgataattatatatttacctgcctgtttctactagtctgtgacttctttattatttgtctatgaacttctagtatcaagcacagtgacaaataggaaattcatttgacagcttttattgagcacctactgtgtgtcatgcactgttcaaggcactaaagaatcggcagtaaacaagataaactaagttcttatttcatggagcttacattcttggtggaagaacacaagagagtgagcaaataagaaaatacaataattccaatggagatagtgctgtggaggaaaattaagtggggcaaggggcataggggtgctgggagtagtgggttctgtttcatatagggtgatcagggtaggcctcactgagaaggtagtgtttgaacgaagatctgaggggatgagagaaaaagctatgtggatttctgtggcaaacacgttctaggcaggagaaatagtaagtaccaaagcctttagtcaggagtgtgcttgacttgtttgaggaatggcaaggagaacagtgtggcaagcgcagagtaaatggatgggcaaggggtataagacaaggtcagagaggtggtttgggactagatatgtaaggacaaaaccaatatgacagttttgagtagaggagggacaaaatctgacttaacattttaaaagtaaaccgggcgcggtgactcacgcctgtaatcccagcactttgggaggctgaggcgggtggatcacttcaggtcaggagttcgagaccagcctggccaacatggtgaaaccctgtgtctactaaaaatacagaaattagtcgggcgtggtagcaggcacctgtaatcccagctactcgggaggctgaggcaggagagaatcttgcggggattcggggcaagggcagaagcagggagatgagttggtggacattgtcataatcgaggtgaaacataatggtagcttggaccagtatagcagaggttgtaagaaatgatagaattctagatgtgtcttaaaaggagagtcacagatttttctcatgggttggatatatatggcgtatgagacaaacaggagtcaagaattatgccaaggtttgtggcctaagcagttagaaggatggagttatcatttaaataagatgggggatcccacaggagggacggtattgggaaaaagatcaggagttcagttttgtacatgttaagtttgagtacctattagagatatcccaagtggtgatatcatataaatggaaatatgaagtaagcagttggctacataagtttggaattccaggaaacagactgaatcagagagatggatttgggagtcctctgcttatagatctgtggtgtctaggaaaatagccactaattatatgtgactctttaaattagttaatttacatttaatttaatttaaaattcatctttcagtcatactagccacatttcagtgctcaatagccacatctgtgtgttagtggctattgtattaaacatagcagatatagaacatttctaatatcacagaaagttctcttggactgcagtggtatagatggtatttaaagccatgagactggataagaaccccaaggagtgagagtagataaagggaaagagagagttaagtactgaatcctgcagcactataaattaagaagttagggagatgaggagggatgggcaaagaaggccaagaagtggccaattaggaggtaacccctaagaatgtggtatcctagaagccaaatgaagaacgtatttccaggagggagtgaacagctgtgttaaattctgctaataggacaagtaagatgaggaatgagaattaactattaggattattaaagtaaaggtcactggctgtaataattcactggagtattagagtcaaaagcataaagcttttgactaccccaataaatggggtaggttcacaagaacatgggaagatatgaattggagacagccaatagagatacttttggaaagttttgctatgtacagaagcagataaatgtggtagctagagaggtgggtgagatcaagaaaggttttttttttttttttttttttttttaagataggacaatgtacagcagagaaaagttgtgcaggagtgggcggggagaattgttgggttggagagatgttctagaataggcaaaggagcgggggtgtctagtgcacaagtagaaaggttggccttaaattaggagcagaatcagtttataataacagaagggaagctagatacacagacacaggaggcacaggtagttgagtggatgcggcaatgagagctgtggaagttcttttctgattgcttctattttctttctgaagtaggaagcagagtcatcatatggtattaggatggggcaggagaagttggagatttgaagggagatgagaaggtatgaaatagccacctagaagaaatggagaatgaatggactagggaaatatagttaagttgccagatagcactaagagcccacttaaagaaaatgagatgtcagcatgattgtacatgttcatctagccacattcagctactgatgcacagtaagtatttttaaatttgattgaatttttatggaaggtcaaagggaaagcctcaccaagaaagtaatatttgaactggctcttgaagaatgtgattgagtttgctgtctggagaggagggataaggacatttcagatgaaggcagcaatgtgtgcaaaggcccagaggcatggaagaacagagtatgttcttagaaaatttgaacatcactgttggaggctatgttctaggagcaatacaatgtagtgactgtgcaaggttagacaggaagaacttgcttcatggggttttataaagattaattgaacttactaaatgttatttctgtgcctactttcagatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatggtaaggttttccataagtatgctataactcaatgttttgttattgttttattaatttatttatttttgagagacctctgaactatgagggttattcaaaagcatcttgaatgcaaaatgaaaatgtcaacaacacatgattattactgattaatttaaaattctctcgcatttgcctgcctttgttactttcttccctagcctatgttttaaatgaaggctaatcaaggattttttaaaacctaaaaatagcaacagtaaaataatagcaaagtaaaataatattcgtaatcccatcatcctaacacaatgtcaggttttttttgtttgtttctttgttttgtttttgttcttgtttttgttttttttgagacggagtttctctcttgttgcccaaactggagtgcaatgatgtgattcggctcactgcaacctccgcctcctgggttcaagcgattctcctgcctcagcctcccaagtagctgggattacaggcgcgcaccaccatgcccggctaattgtttgtatttttagtggaaatggggtttcaccatcttggccaggctggtcttgaactcctgacctcaggtgatccacccacttcggcctcccaaagtgctgggattacaggcgtgagccaccatgcccagcccacaacgtcagttttaattttgtatattccattcctagttttcttgaaatgtgtgtgtgtttgcagaattacagtattagtacatataccattttttactgggtacattttatcgtaagtaaattttacctcaataaagttaaaatcacttgtacacatactattttattatgctttattttacttaatgctttctaatgttgctatataattttactataatactgcataatttatcaatcttacacactataatcattcccctcttgttggaaatttaggctattcctaatatttcactattgtaaatgacactacaataaatatctttgaggttgtatgtgctttattttgttatttcttagggtaaatttctagttgtgagattaattccactctacatttataatgtctgctaagtatgaaggcagtcttttactatggcctttttaggtctgggaagaagcagagaataccattttacttttgttttgtaaatagaataaaataataagatttatggtaatatttttcccactataaagtgcccattttgtctctctctgcccccccccccttaccttaaaaagaaaaaaagtattaatcttcagtttcatttgcctataaattagataaagtgtttgaggctgttggcaaatacctttctgaggaacaaaaagggtcttctaatatccagtaaggtctctctttttattttcctgtgattactttattagtaacccctacctcactctgaaattttcataaccaaatatggaggcttgttacagagtttgtagtataaagtctgtgtgggcttagagatattttaagttaagccatgccctgaacaactttacttgagaaaattcatttcattctgaaatttcaagtcaaaatgttattctcctttcagtatattccaagttcttttattttgtgctgcccctatattagatgagctgtgtggcttgatagccattgcagacacagtgaagcctgaagcagaactggctatccatattctgaaatctatgggcttagaagtagttctgatgactggagacaacagtaaaacagctagatctattgcttctcaggtaattgataggggtatgtgataacttctaattattgatatacattttatatcttgccttcaaatgctaagaaatttacattacctactattttcattatcactgagtagtcctatctggttccttcaagaaaatttaccatgctttgctggaaagactttgggctttgtgtgttgctgttatacgtaaaaaggtatttgcttagttcatgggatgcttgcgtgacactgtacaccaatttctgttgatgtgccctttgaaatgttgctcatattctttaccagtgctgccaacctaagctgggctctcctgatctcatgcctgaaacacagcaatagctccacacacatccctctctagtccatcctaaataccaccaccaatggaactattttcctaatgcaccactttgacataccatttttctgctcctgactcccacatctgccttatctctaaaatttttcaatctttttaactttggaatgccttctcccctcttctaataaataatgcaagtaatcttttaatacattcttttgtttcttttttttttcttgggacggagtttcgctcttgttgcccaggctgaagtgcagtggcgcgatctcggctcatcgcaacctccacctcctgggttcaagcgattctcttgcctcagcctcccgagtagctaggattacatgcatacaccaccacgcccggctaattttgtatttttagtagagacagggtttctccatgttggtcaagctggtcgtgaacttcggacctcaggtgatccgcccgcctcggcctcccaaagtgctgggattacacgtgtgagccaccgcacccggcctattaacaccttcttatgtaaaaaatacagaaggatataaagtaaaaatgtcctcttttccccatgctccccattcagtcctactgcccctcacactgccactttttcatatgcatatatgtgcatatacagagtacatatacagtataattctggtcttttcaacatcagatcattttgaacagattgttcagtagtttgctttttttacgtaacagtatactttggagcttcatccatatctgaacataaagttattttggccgggtttgttggctcacgcctgtaatcccagcactttgggaggctgaagtgggcagatcacatgaggtcgggagtttgagaccagcctggccagcatggtgaaaccttgtctctactaaaaatacaaaaattagccgggtgtggtggcgcatgcctgtaatcccagctactcaggaggctgaggcaggagaatcgcttgaaccaggaggcggaggttgcagtgagccgagatggtaccattgcactccagcctgggtgacagagcaagactctgtctcaaaaaaaaaaaaaaaaaaaagttacaaagttactttattctttctatactgaattccatggtatggatgtatcataatttatttaaccatttccctaatgatggacatttgggtggttttgaaaattttctttttgcaaacaaggcaataataaacatctttggacatgtatctttctgtacatgtgcaagcctgtccaagatagagctagacatggaattgctagaccaaatgatgctcacattttgatagatgctgccagatgccctccaaaaagagttacaatttacacaccagccactggtgtataagagagctcatttctccacatccttgctatcactagatattatcagtcttttaaaatgtggacatcttgtgggtgaaaactgatggcttgttattgctcagttatgtttcacgtactcattattttttaaatgaattgagtttattttcatcacataggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataagggtaagtgccatggcttgacctttgaggagtatgagactgccctatgtggtcaatgataatgtcataaagtatattgagcataacaattctgtcttaagttccatgctatcagccattaagagtttaagaatatggagtgggattatgggaagtcatgctaatttaccccctgactttctcaacccagctcataagcaagtgagaattataagtttctgaagtgaagaagaagatttaagaatggattcggaataaaatgatcttcaacaaatagttgctgagattattttaagtagatttaatcatagtaccagcatacacccctaaaagtgttttcagaaccctgaggaaaatttttgaaaaacaccttcggaagctgagtctaagttttagcattatctgagatttgtaattaattcacatattaccctaaggtagacgtaatcttcaacatacacagtatcaaatgtaaaagttactggttaagttagagtctcttactaatatcacaaatatttctgttcttagaatgatcttctggatgtagtggcaagtattgacttatcaagagagacagtcaagaggattcggataaattttgtctttgctctaatttataatctggttggaattcccatagctgctggtatgtgactcttaactagtactgctttttccactaaagttattagagacctaacatattggaagcctgtcttcttactattagttttgagcttagtttttgtttgtagcctactggtatggtgagaggtaatgttaaaatcaatcattttaattttcagtaatgtttgttatagcttaagaatatataagcattctgacagatttatttttttccctccaacttttttttttttttttttgagacagagtctcactctgttgcccaggctggagtgcagtcatacaatctcggctcactgcagcctccatctcctgggttcaagcagttctcctgcctcagcctcctgagtaactgggactataggtgcccgccacaacgcccaactaatttttgtatttttagtatagacggggttctccatgttggccaggctggtctcgaactcctgacttcaggtaatccacccacctcggcctcccaaagtgttgggattacagctgtgagccaccactcccagccttcaactttgtattttgaaaaatttcaaacttgacacctgtaatcccagcactttgggaggctgaggtgggcggatcacctgaggttgggagttcaagaccagcctgaccaacatggagaaaccccgtctctactaaaaatacaaaattagccgggcgtggtggcacatgcatgtaatcccagctactcgggagacggaggcagtagactcgcttgaacccaagaggtggaggttgtggtgagccaagatcgcgccatcgcacttcagcctgggcaacaagagcgaaactccgtctccaaaaaaaaaaaaaaaaaaaattcatacctccaaaaacattgaaaaaaatggtacaataaaaatctgtatgcctttcacctaaactcaccaactgatggtattttgccacattgcttcatctctttctgcatatatttgcacagagatatgtatttgtttgcttattaatttttttctaaatagatttacctttaatctgactacccaaacccaacactgtttgcaagattaattcatggagcaaatgatttttaaagaattatacaagtattttcctctagtcttttttttactctacatcagtttttgtcttgttacatagttgtgattgtagcttatggagaattttctgctcttcacttaatattctattatagtcagctggtattttttttaggttgagagaccagatgacagagagagtgaacaaagcaatataactgagaaaaaagaatttagagttatttaataagcatctgagaatctcctaaacttagggacctggtaggagttagtaatgatgacataaaagaaataagtattgttttcttcttgttctctctggtttgagggccaaggaaagacaagaaatgacatgagaacaattacaaaactgtttatcagcaaggacacacaaatactgagagaacaaagaacaaaagaacaatctaagtccagtaagattaattcatggagcaagtgatttttaaataattatacaagtaatatatgatcaccatagaaaaagtagaaaaatataaagaagcacataaaaagttaaaagtatgagtctatttcatcctcatcatgtgagcaaacattcttatgtctgtgaaaaccaagtgtggatgagtttgtagaacatgaactcccatacgctattggttggattttgaatcactacagccactttggagaacagctgaggaatatccacgtaaagttgaagatgtgcccatgttatgacccagtagtttcacccctaggtatataccccacagaaactctcaaacatggacacggggagacatgtacaagaatgttaacagcaacactctgttagtgaaaaaaatggcaacaacaaaaatctctaccaccaagaggataaatgctgaagaagtatcaaacaaagaaatgatttgtatgtatgttagaaacacattaataatctgtttagtattatctactctaactaatccatacttgtttcttaggagtttttatgcccattggtttggttttgcagccctggatgggatctgcagcaatggctgcttcatctgtttctgtagtactttcttctctcttccttaaactgtaagtatgatagcttgctcacatttgtattttgtattcctgttatcatctagtcattcttggtaggttttattcttgtattgatcaatgataagcccaaaccattcttaatgagaattattattagcggccgggcgtggtggctcacacctgtaatcccagcactttgggaggccgaggtgggcagatcacctgaggtcagtaatttgagaccagtctggccaatatggtgaaaccctatgtctactagaaatacaaaaattagctgggcatggtggtagacacctgtaatctcagctactcgggaggctgaggcaggagaatcacttgaacctgggaggtggaggttgcagtgagctgagatcgtgccactgcactccagcctaggcaacagagtgagattccatctcaaaaaaagaaaagaattattattagctaacagtaataattagctatgtaattgttacttcgtgtactttatgcatagcaaccacaagcactgagtgggataaaatatagtgcactaattctgagaagtagggtttctgatgatataactccacacaattcgtttcaagctattttcctaccagtgatcacctttatacatttcataccaaaactaagtgtggatgagcaaatcttctttcttttctgcatgtagcgagcatctcatttacttttggttatttgaaactagcatacttttgcatatgtccagttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaata

SEQ ID NO: 4747 - DNA, 139693 bp, human
gctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtggcatcttatctttgacacttttcttcgttgtagacgttgagattatcttaagcacaaacacttatcgtttcacaattcagcgtttgtccaggatctgatctttattttaatcacagactctttatctacaatagtatggctttgtattgagaatatgtgcagaacattgaattagatgatactgaggttattaatttttttttttttttgccgggtgcgggggggtggtggggagggggtgatgcacaagaaataagacagagttcctggcctcaaaagagtttacttacagtaggctgggcgcagtgtctgacacacctgtaataccaacactttgggaggccgaggagggtggatcacctgaggtcaggagatcgagaccagcctggccatcatggcgaaaccctgtctttactaaaaatacaaaaattagctgggcgtggtggcgggcgcctgtaatcccagctagtcgggagactgaggcaagaggatcgcttgaacctgggaggcggatgttgcagtgagccgagatcgtgccactgcactccagcctgggctacaagagcgaaactgtctccaaaaaagaagaaagaaaaataaacagtttacatacaattgagtccgaattgagtcagttgaattcagctatgaagacaacggtttctagcagccccactgactgaattactaggttgcttatcacatccttttcaatggttatttttgaactggcattttattatatttaacattttctggtgtctaaggtcatgacatgagagagttttttttgtacttgaggatctcaatgtagtaggaaagaaagatacacgattacctaaacatttaaaaaatctcactaacgttatatattagaaacaggaggtgttatgagagtgcagggaagggagcatgtgaactgggctttgaaaaatagataggatttagctttgcaggaatggaggaagaggaagacatctatctggactgatagatagaagaaataatgtgagcaaagccatgggggtctggaaagttgcccgacatccagtaacacactgtaagtcaatattcctatttctaacagccacatcttccaagatgtcactgattaaaattagaaaaaatatagaatacaaaactagtcagctcacaaacatatccaactgccctccagccaataagaaagcttatatagagaaaaaaatacatggaaatgacaaaagcaatgttaatgtatgaggcttaattctgatgtaaactcaaatctaaaagagaaaaaatgtaaaactcgctatactttaattctgattgagtgttgtgccttaaatataatttggaatcatttttaaaattgttgggaatgaataacattttctgaagtgagcaactgttccaggttttccccaaggaatctctgcttttccttttttcctctaaattgatttctctctattgatcttcttaacttgataggaactattctattccgatcacagccttagaaagatcttgatgcctgccctcaagataaggttaaacactaatccctccaaaggataggttaacatctctgttctctaaagcagaaggttgattttctttgaaaaatgcttgcagaagcagtaaaatttgcttacaaaacaagagagagagagaaaagagtgcaaaaataaccccagctaacacaccacaaccttcacttctgtgagggcgctaaaggaaatacattttaaaaaaataaattccttgttataactccttttatctatatatttaaaagctcttggcaaactttattaatcaagactttggacatcctgatgagtgaaaataatcttcatttgccagttgggaaagtaaattgcaaggagagatttttgtctgaactcatagaagcactagcatagatgagaatagtatttgggagttttgtctcaaaattccttctattcatctttgttaaagggcagttcaggttttagcgttttgtttttagacaacgatatttcttaggatatagctcaacatggggccggggcaagggggaggctgggggacagatgagtgataggcaatggttaggcagagtattttagttcactctaccatcccagcaatcatgtttttccctcttaaatctcagtcttcaggttgatttaatgtgatattacttgcttacttaacttgctgagatagtttggcaggaaaaatatcaaaattcctttagaatgtgtttcattaaagtaaaagggtcctgtgtttctgattttataaaatgttcttactttttccagcactgtttgcaaattgaagtgatttcctaatctttttgtgcccaaatgtatgagatattggtagactacatcagttttcacagatacctctttccttgaaggaaatgagggtaaaataccccattttgagtcagttatgtgtactttgtaccatattttctgttcacatttaaaattatacagctatgtctcaaggatgaaaaaagagttttacttatttttactattaatctctagtgtagaagtccagtttttcagacctataatcaggagtgcatttttaacaatttaccagttgaaataaatgggttatttcacattgtagggatattgttttagactggccattaaccttattttattttatttttattttaaaagatgttattgttattatttatctatgtatttatttctagaggcagggcctcgctctgtggcccaggctagggtgccatggcacaatcatagctcactgcagccttaatctcctgggctcaaatgatcctctggcctctcaagtagctggaaccacaggcgcatgccaccatgcctagctacttatttattaattaattattattttttaaataatattatttttaagagatggggtcttgctctgtcacccaggctggagtgcagtggcgccatcataactcactgcagtctcgatctcccaggctcaagcgatcctcctacctcagcctcctgagtagctgggactataggtgtgtgccaccactcccagctaatttttaaactttttgtagagacagcatcgtgctgtgcagtggtgctatctcggctcactgcaacctccgcctcctgggttctagtgattctcttgcttcagtctcccaagtagcggggattacaggtgcgcgccaccacacttggttagtttttgtatttttggtagagaaggggttttgccatgttggtcaggctggtatcgaactcctgactgacctcaagtgatccaccctcctcagcctcccaaagtgctgggattacaggcatgagccactgtgccaggccttaaaacacctagtgttaaaaatggtgtcttaattgtattctcagattctcctagaaagaaaagatatactaaatgtatatttagatatactaaaacacctaatgtttatttttgtttatttatttttgagatggagtctggctctgtcacctaggctggagtgaaatggtctatgtttgttttttcatcttgacagtaatatctttgaacattttctggagtattagatattattctcttgatgcttcaaggtatcttaacttcaccattgtattgcgatatattgttttggagagacagtataatataggattaagagtggaggctaggtggggcacagttgctcacgcctgtaatcccagcactttgggaggccgtggcaggcggattgcttgagcccaggcgttcgagaccagcctgggcaacatagggaaaccctgtctctacaaaaaatacaaaaattagctgagtgtgttggcacgtgcctgtagtcccagctactcaggaggctgaggtggaaggatcgcttgagcctggaaggttgaggctgcagtgagctgagatcacaccactgcactccaccctggatgagagagtgacagagtgagaccctgtcttgtccggaaaaaaaaaaaaagcctgtcttgtctggctcagtccaggtgctagactgtctaggtgggatcccagcccctctgcttactacttgtatgaccctgcgcagatttcatactcctctgtgcctcagttccttcaaatttctaaaatggggacaataacagtacctgtctcacaggattgttaatgatctaatacatgtacggtgtctggcagatagtaaacatacaataaaatgtagttacctttaatattttaatatattatttactgtaaaagtaattttaacatcctatataataaaattataaattacagttttgctgtactataaatttagtagactacaggatcaatatactaatcaatcaatacttgcaagcaatatttaaattctttaaaaaaattttttttggagacagggtcttgctccgtagcccaggctggagttgcaatggcacgatctcggctcactgcaacctctgcctccagggttcaagcgattctcatgcctcagccccccgagtagatggggttacaggcgtgtgccaccacacccggctaatttatttatttttagtagagatggggtttcgccatgttggccagcctggtctcaaactcctggcctcaggtgatctgtccgcttcagcctcccaaagtgctgggattacaggtttgagctaccgctcccggccctgccaccacgcccggcacaatacttaatttctaacttacaccatagaaaattggccggtgcggtggctcacgcctgtaatctcagcactttgggaggctgaggtgggtagattgcttgaattcaggagttccagaccagcctgggcaacaaggtgaaaccccatctctacaaaaattacaaaaaatagccaggtgtggtggcatgcgcctatagtcccagctactggggaggctaaagtgggggaattgcttgagcctgggaggttgaggctgcaatgagctgagatcatgccactgcagtccagcctgggtgacagagtgagaccctgtctcaaaaaaaaaaaaaaaaagaaaaaaaaagagaaagaaaatggaaaactcagattgagagggtcccccagtagcctatagtacacctacatatgctaacatggcatcttaaagctcattattacagctggcaaatcaaatcactgtgatgtgctcatcctatttccctatcaagaaaactcataacaatctgcttctgtaattagtgagccacagactctaggccatcgagattttccacattccctaattgtcaaatgctgaaccatacttgtactgaataagttgtgatacagtgtaagcaagggaaaaggccttatgtatgtctaacctactctgcaaatagctgcattcttacaaagttgtgtgtaaattgaatttttacaaagcatgtcagcactttgattagtacatttttattgtgtgcttattgcatattcagtgtttcctgtgagctatacaaagaagcataaggcatatgttccaatgtctagcaagagaaagaagtttaataccaagcagagagaaattaggtactactaaactatgaaactgattccagggtattcggaatttaaaaagaaagtggctaggagtatttgacatgatttttcatgaaggaggtgggacttcagttcatttacttactcaacagtgatttattgagtagccaccatgttcactggtggtatgatagtgaacagagcagatatggtcctgtttctgtggagtttacagactagtgaagtaatagaacttaaatatgtgcaagaaaacattctaggtgaggggaccagttctaaacaaagtcatagaaataaatgataagagcatggactatatggcaatcagtgaagggacttgcttgattgtagtagagattttatgttggggaggagcactgcaagtgatagatgcagaccatcttttgaatgctttgaagaactatttaagtctgtctaaaagtcctttggatacactgttctggagagggtttggggctttggggtcatactgccttggtttgatctcatctctactctaatttgtttaagtttagaattttatagtaagttttctcagtgacacaactctataggcaacaaactgatatttacagagtggttggggtcagtaacccttgtatcagttaagcaatgtacacatgaagtgccagtaggaagtccaaggaaaggttgggagaaataaaaggaggttagtaaaggaaagagaaataaatacattctgtgatagttggtagaatgtcatcagaaatgtcttcaagcaaaacaatacatttgcctgtcttttgtttctagttgcgtttaatggtagtgtgttttccttgtctaaatatgagaaagagaaactaaactgcagctacttgacgtgggcatctgagagctaccaatggttggcttaggttatgttctacatttgaagcatctggtcagttttagattgtcttctatatttgaagcatctggctagaccacttgtgtcccagttttctattttacctaaactcaacttggtcagaagcttatgtagtaagtattgtttgtaacctgtgttagtactctcttaacatggcttaaagcatgaatggattgtcaaatgaatacctgttatgacctgtattttttcttgttacctttggatttaatgtaagtataataatgctctaagaacatttgacagtattgttcaggcacttttttttttttttttttgagacagggtctggctttattgcctaggctggagtgcagtggcacgatcacagctcactgcagcctcaacctcctgggctcaagcaatcctcctacttcagcattccaagtagataggaccacaggcatgtgccaccatgcctggctaatttttaaaattttttttttgtagagacgggatcttactttgttgcccaggctggtcttgaactcctgggttcaagtgattctcctgcctcagcctccccaaagtgctaggagtacacaggcatgagccatcatgcatagctgcttattcaggtgcttttaagaaattttttccaccagaaaagtagaaatgatcataccagactacctttgtctcctcccaatcttttattatggtgatgtccaaccttgttataaggaggagcttcttttaatctcagagtcatgagatcagggcagatactgacagtatagttcctgagaagtagttgctggctgtgctgttcttcctttcccaatgggaatcttagctgagacatgtagcagagagaagacattatggggagccagcatggagctttataggaggtgaggtgtctagatctaccagtagatcccgatttgcaggtttgagactcctaccttatttcatccatggctgttgcattgtacaaatctagtgggcagcagccacagtctgtaaaaattatgacatggaattacacaatgtggcagccctggaaactacccaaaccacttctatttctagtcctgtattcccttcaatacctactacatccagcagccgtgatagtcccaacacgtttatcatttgactctctttgcctcccacttgaaggctcccctttaatccaacagataaaaattacatctttgtctaaggatttcaaggtgttgcataaattttcttattctatttaagtatactcatcaagaaaatgataataactgcctcgtctaattcataggtttttatcagtatcaagtggaataatgtatgcaaaaacttcataaattaaagaatactacacaaatataatattcttttcagatatattatgttgtggaaagaatactgaattccaatcagatgtctggcatctcagttctttctgctattaacaaactgtgactttggacaaattactttgtgctctggggactttgtttccttacctataagaggaaacttataatgccactcctatctacccagacacctaagagctactttttcctcacctccacattcagtcaccaaatttgttgtctagttcttaaaatttcttaagttggtcctgccctctctatctccattcagttcctaatcacttcccttttgggcagcagcctgttaaaaaaaattgtggtaaaatatgcataatataatattgactattttaacctttttttttgagacgaagtctcactctgtcacccaggatgcagtgcaatggtgtgatctctgctcactgcagcctccgcctcccaggctcaagcaattctcctgcctcagccccctgagtagctaagattacaggcacacgccacccctggctaatttttgtatttttagtggagacggggtttcaccatgttggccaggctggtgtcaagctcctgacctcaaatgatccacccgccttggcctcccaaagtgctgggattacaggcgtgagccactgtgtccggccccattttaaccatttttaaaggtacaagtcagtggcattgagtgcattctcagtgttgtacaatcatcactgttatgcatttccagatttttttcatcatcccaaactgaaactctgtacccattaaataatagcttctcattctgccttctctcaccccctggtaacctcattctactttctgtctctatgaatttacctattctaggtactttttgaaaaataatttcaacatttatttttgattcagagggtacatttgcaggtttgttacctggctatattgcatgatgctgaggttggggtacaattgatcctggcaatcaggtacagagcagagtgcacaatagtttttcaacccttgccccactccctccccacccagtagtccgcagtatctattgttgccatctttatgtctatgagtacccattttttttttttttgagacggaatctcgctctgtcgcccaggctggagtgcagtggtgtgatctcggctcactgcaagctctgcctctcgggttcatgccattctcctgtctcagcctcccgagtagctgggactacaggtgcccgccaccacgcctggctaattttttttgtatttttagtagagactgggtttcaacatgttagccaggatggtcttgatctcctgacctcgtgatccgcccacctcggcctcccaaagtgctgggattacaggcgtgagccaccgcgcccggctgagtacccattgtttagctaccacttataagtgagaacgtgtggtatttggttttctggtctgcgttagtttgcttaggataatggcctccagctgattccatgttgctgcaaaggacatgattttggtctttttttaatggctgcatagtattccatggtgtatatgtaccacattttctttatccaatccaccattgatgggcacctaggttgattctatgtctttattattgtgaatagtgctgcattaaacatagaagtgcatgtctctttttggtaggacaatttattttcttttggatatatactcagtaatgggattactgggtcgaattgagttctaagttctttgagaaatctctgtactgctttccaccacggctgaactaatttacattcccaccaacagtacctaagcatttctaggtacttttaataaatggaataatacaatatttgcccttttgtgtctggcttattttacctagcataatgtctcaaaatttcatccatgttgtagtatatgtgagaatttctttcctttttatggctgaataatattccattgttgggtaataacgttttaactggtcctcctaactccaggctttgccctatcaaatttgtccttcgtgatctgaccttacttacctttacaatctccttgttgttaccattcatgccatatgcctcagccataccagtggtggtccttaaatatggcatgctgtttgacaactctgtaactttattcatggctcttttgtctgaaatttatttccattcttctggagaactcctactcaatcttcaaggccgtttacctaacaatagtggatgggtgaaattatgatacgttcatatagtggacttctagtcagccttttaaaattatggcatatatattagtggttaaaagcacaggctctggaccaggcttactgggatcgaatttcaaatctgtcacttactaactatgtgaccttgggaaagttccttaccctctctgtatctcaattttttcatctatgaaacagggatagtaattgtatctatcccatcaggttgctgtgaacatttaattacttagaagtattagctaggccaggtgcagtgcctcacgcctgtaatcccagcactttgggagtcccaggcggatggatcacttgaagtcaggagtttgacaccagcctggccaacatggtgaaaccctgtctctactaaaaaatagataaaaattagccaggcttggtggtgggcacctgtaatcctaactacttgggagactgaggcaggagaatcacttgaacccaggaggcggagggtgtggtgagctgagatcacgctactgcactctagtctgggcaacagagctagattctgcctcaaaaaaataaaaataaaaataaaaatattagctattatgttttatttatttgttagtttttaaatttttcgtagagatggggtctcgctatgttgctcaggctgatcttgaactcctggcctcaagaagtcctcctgctttggcctctcaaagtgctgggattacaggcgtgagtcactgtgctcggtcaaaagtattagctattgttatatattaatatttactgtcatagaaaaatgtttattatatagtgttaaatgaaaagaaacatgctgtaaaatagaatagtatatcatttttgttaaaaatgtgtgtgttcttgggtgtggtggctcacgcctgtaatcccaacactttgggaggaccaggcaggagggttgcttgaggctgggagtttgagaccagcctgggcaatatagggagacctcatctctacaaaaaataaaaaattagctgggcatgtggtgcatgccttgagtcccagctactcaggaggctgaggtgagaggattgcttgagcctaggaagtcgaggccacagtgagctattactgtgccattgcactccagcctgggcaacagagtgagatcctgtctcaaaaaaatgtgtgtttatatgtagacacacatataataccctcctagacttacatacacacaccccaccccaccccacatacacaaccctcaacatgttagccttcattatttctcagtgatagaccaattggttgtttattttttatatttgcttatctgtatttcctgtttttctccatttgacatttatttcttacatttggggagcatgaaaaaagacacagttaaagcatctcttctgtgaagccttccctgatttcccttccttcgtcctttagggcaccagaataccttgcatccctgaactccttaaagcctgtattatattcatttacattttaatccccaactgggactagtgcagagcctaaaagatacatgaacttagccatattagtaaggtgaaaatggaattatgtgcaagcactttacacatgttatctcatatacagcactcagcagtctcatgagtaagagttatctgtgtttttcagatgaggaaactgagcatcagaagagaccaaacaatttgctgaaggtatacaacagtaagcaacagaatttggattcaaatccaagtctgtctgatgccaaaggtggtcttttcaatgtatattgaatgactgaatgatctaatgaatatatctgctgtctcagatgacataatttatgaaagacttattggtaaacaaatatgctatatgaatgtaaagatatgttgttgttattttctgctatattttcatctgcaccctagattctgactaggcaaatgagctttccttctccccatgcacaattttttccctctgttagtataaattggcaattttggctctccatttgtctttttatactgcccatgctctttccactctttaggaacctgactcataattatgatattaagcttttcagattaatctagccatgtccatcagatttactgttgtgtgtacatgttgagaaaactaattagaaagtatctggccagatacaatttgtttcagtgatgccaaagtatggtaattcctagtttaatgtgtttacctttttctttttttttctttctttctttttttttttttgagacagagtctgtttacctttttttgtgtgctgatatgtccacatttaatttcctacattcatattcataccgctttcaaaagaaggtgttgtcaatgataaaacattagacagaaatagtttttagacagaggatgttaataagttcagcctatgtcttatttaggtttatgtttttgtgtgtatgtgtgcacagccttcatcatttaagtttatgttttgtgtgtatgtgtatgcagccttcatcaaaagaaaaaaggcagatagtcaagaggtgttttaataatttatatcacagctacaacagaatatactaaaccaaaatttagaatttgattatagcttgactccctacaattttttcagaattaaaaagatgaatcccctttaaagcaaactaactgaagggaagcatctactttgtgaaaattgcctgtctaaaatggggtgggaaataactcccttttaagtaccgcacttttttttattctaccagaacctggtttctaaagatttcaacctatttttatagtctcagttttgtgagatgacaaagttcatcttagtgatttctaactaagaaagcacaaccacagaaacgaggaatggattctggaaagggaaacttcctgcaaattatgatgaatttacagaaatagtaaatatttaaattccataaatagttaatattgttgttgataattatttgtcttgatttctgttcaagaagtatacatttgaattagcacacagtttattttattcctagcaatttagtatatttttcatagccatcaatatttgggattctgcttgcttatgattacaaatcacttgaaacctgccagttgaaaattctcaagggtgtgaaatgatatgggccttcagtgaattcattcccctttatctgtataaaatacctggctaaacagttgtctttgacaattttaaattactgtttcctttcttaaaaactcctttccagaagctgatctcccgtacatttccagtacataatttttcatccttatctgtcctgacagtgattcagctttgaataagagagaatgttaccagagtttcacctttattggcctaagtctttgtttattttttgagacagagtcttgctctgtcgcctaggctggagtgcagtggcatgatctcggctcactgcaacttctgcctcccgggttcaagtgattctcctgcctcagcctcccgagtagctgggactgcaggaacgcgccaccacgcccagcttatttttgtattttgggtagagacggggtttcgccatgttggccaggctggtctcgaactcctgacctcaggtgatccacccacctcggcctcccaaagtgctggaattacaggcatgagccactacgcccagccagcctaaatctttaaaacaggacatgaaaggaattgaagggttgggtatgggtggggttgtagatctagactatatttatggaatgtttgcttccttcgtgctgaaaattgttctttggaccttgggatgaaaagagaaaatatatgaaaaataagaatgttatgaaaagtctaagtattctgaaaaatacattagtatactactttataatcataccatataaatatttcagctataaaaattaatgcaaaataaattttctcccaatatgttaactgctttaaaaaaaagtattggcaagattgattatattctttcctaagaggaaagataactttgcataatcaccaagatggtttaccaacatacaccacgtatactgagtattacagtcttcaccaacatgagtcaaatgctagcgtgtatagggttggtagtataaacctacctggtacctttttggttttgctgactaaatggtgctaatgaagccagggttatagacttcatctctgtgggagtcacttgttctttggagtcattaggtatgccactaactctgctccacagttttccgaatgcagtttgttcattaagaaagggaggctagtacagagtaaaaatagctcagcaaaaagccatcatcagtacccatgcccttagcctcctgatagggggaggagggtctttaatgtccaggctttcaaactcacatatacatttttattattaatcagtggaggctgcacttagaaatttatttctttggacttctgcaatattctgcttataaagtgtttctgtggtttcaactgtagatccctttttgcctttatctccagactcttttgtctcaaaactttatggtctcagagaactaaggaaagacttggctcactatatgcatttgcagaaagtaataaggctttttttttttttaacgccataaagtgatctcagcaaagtgacaaatctacagtttcagaactgaaactaaacaactctttcgtggtttattagactcttctatattaagtagagcagttttaggtgagcctctgggaatctcatgaaactgagcttccagtgtggctcatagtcgtttgtaatctatacaaatctatagtatctttcattgagtatcattaaagaatgaggtattttgcagaagtgaatttccaaataactgaagtataccctttacatttttgtcattcagggatctgatgcatgcatcctacaaaggcatccttgaaatacatttacttttccaaaataaaaatacttttatttctgattagaacattgataaatggtcaatgtaaaaacaaaatctagtcaatatttatttatttatttatttgagacagagtctcattctgtcgcccaggcagtgggggcaatctcagcccactgcaacctctgcctcccaggttcaaatgattctcctgcctcagcctcctgagtagctggggcaacaggcgtccaccaccacacccggctaatttttgtatttttagtagagacagggtttcgccacattggccaggctggtctcaatctcctgacctcaagtcatccacccaccttggcctcccaaagtgctgggattataggcatgagccaccacgcccagccccagtcaatatttagatatctctcctttctgagatttattttttcttacagcatttatcactacttgacttttgcaatttttttttttttgagatggagtcttgctctgtcacccaggctagaatgcagtggcgcaatctcagctcactgcaacctccacctccccagttcaagtgattctcctgcctcagccccccaagtagctgggattacaggtgcacaccaccatacccagctaatttttgtgttttcagtagagacggggtgtcaccatgttggccaggctgatcttgaactcttgacctcaagtgatcctcctgcctcagcctcccaaagttccaggattacaggcatgagccactgcgcctggctcactacttgattttatacattcctttgtttgcttattgtccatctccctcaagagaatatgagccccatgaaagaagagacagtgcccctcttcactgctgtatcaccagcacgtagattagtacctgaaacataatgggacttcaataaatatgtgctaactaaatgaagaaagtagaaatcactcttaattccaccatccagggattagccactgttaagattctggtatcatttctttctttttttttcttttttaaagagcaaccctattaactgatctggtatgatttctaacaaaagttttttctcttacatacacattctcatgtgtatatataaatttatacaacattttaatagaaataggactatcgtcaattgtttgtagcctcttttttcacttaactcatcacagacatgatgtcattaagcaaacaattatgtgtttttaatggagatatgataatatatttgaccaattctgtattgatatttaggttggttccagtttttcaatcacataaacaaccttgtgataagcatccttagccatacatcttagtacagttgtctgtacctttcctcccctttgaatatattcttagaactggaatttctgggttaaaaggtatgcattttttttattatactttaagttctagggtacatgtgcacaatgtgcaggtttgttacatacgtatacatgcgccatgttggtgtgctgcacccattaactcgtcatttacattaggtatatctcctaatgctatccctccccccatcccacaacaggccccggtgtgtgatgttccccttcgtgggtccaagtgttcttattgttcagttcccacctatgagtgagaacatgcggtgtttggtttttttgtccttgcgatagtttgctgagaatgatggtttccagcttcatccatgtccctgcaaaggacatgaactcatcaaaaggtatgtatattttaaggctttttttgagacggggtctcactctgtcacccagactggagtgcagagcttcaattatggctcactgcagcctcaagtgatcctcctacctcagcctcacgagtagctgggactacaggtatgcaccaccacacccggctaatttaaaaattttttgtagggacagggtcttactatattgcccaggctgcctattttaaggcttttgataaatattgccaacttgtcttttggaaactctgtagggattggtgttagtttatactaccatcagcagtatatcatagttcgttaactcaaaactattttgatattaatgattttgaaaaaaaagactttctaaaacacattaagtatttttagtgctttattgcttttctaagcagaatacctgtacctgatttaattataacacacatacacacacacacacactcatatatatatatgacatgacatgtgctcgacctgttattgctcactgtccttgagttgagagtagtgttcttccttctaccactgcctccatggggcagagaggtcctttccagagctgagaatgtcagtaagagatatatgttccttggcatcttgacttcctaattggaatttactatatgtttccccacacgaaacagtgttatagcactattaatatatagtccaactgtgctattgtctaaactcctaagaaatggacctttgaacctagccatcatttataaagttgttcttatgagaaaacatgtttcatcttcaaaattgagaaacaactgttcaagaaacccatttttaaattgaaggtacacattcaaaaagtatatattgagggcttattgtatgtgtgaagataaatgtgctaggccgtcaatgggtaattcttttcttgatgatgcaatgttaaggtacccctgccccctagtcatcattttggtcaggtcaggacaaccagttgcaattgtaacccagggagaaaatattactggagtgtgtttgctaggcaggggaccacgtacaagggtttctgcagaactttggaggccaggattgaaggaatagctgctcagaagaggtagaagagaaaaacatacaggaaatggtaaggaagtgggaaagttggaaagattaatgtgtttcttttagattaaggggagaagagggtactgtttgtcttctcgagatgagtgaggatggacattcaggctgacattctgccatcaaaatgccttgtgtaggaatattagtctttgcatataacttaacaaagctgacctgccattgttgtgtttttgcttgaggacagtgccacactgctgctgccatgtacccaaagaattgcttgaacccatccccttcattacttcaactctaatgactattacttttcattaatttaggctgtattcttttcagacaacgtaaggtaggggaaaagagcctactttttggaatctcagaggcctgagttagagtcagattctatcattcattaacttatttgtattaggcaaaggagctctcactatgtcttcgaacttgaatcttctctagaaggagaaaagttttatgtgattattaggattaaagtgtttaaaatgtctggagtatgataggaacgaaataaattttaatttgtttcttttctttttctttttttttttttttgagacagggtctcattatgttgcccaggctggtcttgaactcccgggctcaagcaatcctcccgctttggcctcccaaatttctgtgattacaggcatgagccactgtgctcagctaaatcttaatttcttttattctcctctcctccacctcattttccacccactaccagaatcatcttctattttaaaaatctgcgtctgaaagaataacattataaaagtagtatattgaggttaaacgtggccacctggccatatgtttagctctcgtccttcacaaaactccattaatgtgacagtgaaaagattttaaaaaggttacacctgcaaggaaaagaaaacaggagagctaaatcagcagagggatgaatttaatatatttttggaagataagaagcacatgaagagggagaaccttccagcagaggaggatattaatgagaagtgagctctttaatctcacattacccatgataggctcagaatttgaaggtaagttgtttatcctgaaaggtgaagaagagacccagggctgaaaataagggaaatgttttaaaaactgaacaggaagggattggacctcttagtttttctcaggagaccaggagtatagtctcagtactaagtgaatctgaaaggctctgagctcctggacagtggggtagagtggaggatactaaagcattgggttgagaacagggaaattcagtggaagtctgcatactgcgtggtcagccccttccccacaccttgctcccaaatatagcagcaaatataccttgctttgcagataggagattggagaattcttttcttggaaaatgaatgatcccagagaaaagaattccagatggtaacatgatagggttccgcaatgaaaaagatagctagctgccattcactcaatactgaaatgcatagtggttaaaggcatgggctctagagttaggcttcctgagtttgaactcagacttaactacttaccagctatatgaccttgggcaagttacttaacctatttgttcctcagtattcccatctttaggatggggaaaattatgtttacctcaagattgttgtaaaggttaaatgagttaacaaagcactgctgatggtaagctctggtaaatactagctgaggaaggaggaagtacccagggacttccttagctgtcaaaggcagctctcgactttagatcatgccccaatggtgaccagcagccttttctacataggtggtacatggggtctgaacaggggctttgaccccacagaagacacctttccccagttcctctctctcattcttaactctgtcttttaggaacattctttttttttttttttttttttacctttttttttattttttattttttattgatcattcttgggtgtttctcgcagagggggatttggcagggtcataggacaatagtggagggaaggtcagcagataagcaagtgaacaaaggtctctggttttcctaggcagaggaccctgtggccttcctcagtgtttgtgtccctgggtacttgagattagggagtggtgatgattgttaacgagcatgctgccttcaagcatctgtttaacaaagcacatcttgcaccgcccttaatccattcaactctgagtggacacagcacatgtttcagagagcacagggttgggggtaaggtcaccgatgagcaggatcccaaggcagaagaatttttcttagtacggaacaaaatgaaaagtctcccatgtctacttctttctacacagacacggcaaccatccgatttctcaatcttttccccacctttcctccctttctattccacaaaaccgccattgtcatcccggcccgttctcaatgagctgttgggtacacctcccagagggggtggtggccgggcagaggggctcctcacatcccagtaggggcggccgggcagaggcgcccctcacctcccggacggggcggctggccgggcggggggctgacccgcccacctccctcccggacggggtggctggccaggcagaggggctcctcacttcccagtaggggcggctgggcagaggcacccctcacctcccggacggggcggctggccgggtggggggctgaccccccccacctccctcctggacggggcggctggccgggcggggggctgaccccccccacctccctcccggacggggcggctggccgggcagaggggctcctcacttcccagtaggggcggccgggcagaggcgcccctcacctcccggaccgggcggctggctgggcggggggctgacccccccacctccctcccggacggggcggctggctgagcggggggctgacccccccacctccctcctggacggggcggctggcctggcgggggctgacccccacctccctcccggatggggtggctgccgggcggagacgctcctcacttcccagacggggtggctgctgggcggaggggctcctcacttctcagatggggcagttgccgggcggagggtctcctcacttctcagatggggcggccgggcagagacgctcctcacctcccagacggggtcgcggccgggcagaggcgctcctcacatcccagacggggcggcggggcagaggtgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagagcggctcctcacgtcccagacgatgggcggccgggcagagacactcctcacttcccagacggggtggcggccgggcagaggctgcaatctcggcactttgggaggccaaggcaggcggctgggaggtggaggttgtagcgagccgcgatcacgccactgcactccagcctgggcaccattgagcactgagtgaaccagactccgtctgcaaacccggcacctcgggaggccgaggctggcagatcactcgcggttaggagctggagaccagcccggccaacacagcgaaaccccgtctccacgaaaaaagtatgaaaaccagtcaggtgtggcagcgcgcgcctgcaatcgcaggcactcggcaggctgaggcaggagaatcaggcagggaggttgcagtgagccgagatggcagcagtacagtccagcttcggctcggcattagagggagaccgtggaaagagagggagagggggaccgtggggagagggagagggagagggagagggagagagcaggaacattcttaagactgtctccaactgcagcattgaactcttactgttcattttttcaataaatgtttattaggtgcctactctgtgcaagtactgctcaagctgctggaatgacagcagtgaaccaggtctgtcataatagctaacatttactgaatgcttactgtgtgctttacatgtattaagttgttgaattctcgaaacaaccctctgaaacagatgatgttatgatctctgttttacagataaggaaactgaggcacagagattaaatagcttgccaaggccacacagctagcaagcagcagagataggaatcaaatccagacagtcttgctcttgagtctgtttaaaaaaaactgtagagacaggggtcttgctgtgttacccaggctggactggaacttgagtctgtttttaaccattatgcctccctgttctcatggagcttatgttctggaagtgggagactgacagtaaataagtaaacaaagaaaatagagaccaagtagcaataggtggtaccaattgagtatcccttatcagaaatgcttaggaccggaagtgtttcggatttcggaatttttggattttggaatattagcatatatgtaatgagatatcttggggatgggactcaggtttaaacatgacattcatttatgtttcatctataacttgtacacatagcctgaagttaattttattaatattttaaataattttgtgcatgaaacaaagtttgtgtacaatataccattagaaagcaaaggtgtcactatctcagccacccatgtggacaatctgtgatcgacctaaccattgttcctgactctgaatttatatgctactggtaagcaatcattttcttgcacttattcacataactgtaaattttaatcaattaaaaaacatgacataccattaatacagtgaaaaaacaaggtgttcagggtagcaagcagtacagtagcatcaccagagttccttttttagctgttaaaccacagcaacaaacaacagcaagttttcagtctctacttatgatactgtgttttgattaaaagattactatatactatattttatgtttttaggtgaaaagaaacattagaagtaggtcctgtagggatgaggaggcattctgctgtatggctttttaaaatgtcttttctaggccaggcgtgatggctcatgtctgtagtcccagcactttgggaggccgaggcaggaggattgcttgagctcacgaggttgagaccagcctgggcaacatagcaagacctcgtctctcctaaacatttaaaaaaaaattagctgggcgtggtggcacacacctgtagtcccagctacttgggatgctgaggtgggaggattgattgagcccagaaatttgaggctgcagtgagctatgttaacaccactgtactctagcctgggtgatagagcaagaccctgtatcgaaaaaaaaccctgaagtttcctctacagtcttctgcctcattaacaatggttttttcttagaagtctctctttgatattttggacagatatgatgtcttgttctgttatgaatgcacgcaggtacattgcagctgaagggagctgggagggcctttttttcccccttagggatgctgaataaactgttgtgtgcctgcattttgattgcaacccatcacatgaggtcggggtggaatttctcaactcgtggcatcatgttagcactctaaaagtttcagattttggagcatttgaggttttagattttcaaattaggaatgctcaacctgtctgataacatataaaacaagggattgtgatacagagggactggcagagggtagcattagttggggtggtcaatgtttatgagcaccaagtgagataagttatagttttttttttttttttaaacagccttactctgttgcacaggctggagtgtagtggtgtgatctagtgtcagcccccagagtagctgggactgcaggtgtgcaccaccacacctggcttttttttgtgtgtgtgtcttttgtaaagatggcattttaccatgttgcccaggctggtcttgaactactgggcttgagcaatccccctgcgttggcctcccaaatgcgggattacaggcatgagccaccacgcttggctgagttctttaagaattaattacttagagtattgctgtctctgcagatttgcaaaatgccctttctatgatttgatttataatgctactcccacacgttttaatattactaataaaaagcaggaatagttcatgtgcactggtgtcttactgtgtatgagggactatactaagcaatttatatagattgtttcattttatgctcatagcaatgctataacaattcttttctttttcagtcatggaaaactaaagcttaaggagacaagtgacaggcccagggctttaaatttagcaagtggcagagccaggatttgaacagaggtagcctgattccagaaccactgctgttaaatacttaactattttattgatgaagtgatatgtgcaaggtaattctttttataaaaaatagctgacttttatagagatttaaaatattgtaagcattactgggtcttcacagtaacagtgaagcttacctatattttggaggcttcaagacaggacataaacaatacattttgagtaaagaagcttctagggttgtatgattttatcaccccaaattagcaattttgttcatatgaactaagatgcgtaagattctttagcacaaagccagagccaggatttgacaccaggccagttgacttaagatgtagagctgttacccattccactgcagagtaaatgataacatgtagcttatctttgttcaaggtactgtgggaagccaatctagtgaaattacattttaacagtccccaaggaatgtttgttaaataatttttagttttttaaaacttctaaatttctcaaaacaaaagctgagtgaagacagttttattttacagacttggagacagtatggagcagtggcccagagtgagagttcttgggtcagattgtctggtggcttacgctaattttcacttcttgatttaactgattcaagtattaatataattttgaacaggcaaccttgccctccaagtcttagttcccttaattgtgaaagaagctaatatagtatcttcctcataggataagtatgaggactaaatgagacaacctctctacaaagtgcaaggcatggtgccttttggccagccatctcttctcttggaaatggacccctcattcatcattcatgaatccaaagtgaagttttggctccattgccttggttttatcagtgcctgaagtattcttctgacaaatagtgtgcatgaacttagagtatagactttcctgacatatttttgttgctcactttcaagttttaaaaacttacagtaaaatacacataccataaaatttaccatttaaaccatgtttaactataccagttctatggcattaagtatagccatactgttgtgcaaccatcactaccatccacctccagaactttcttcatcttcccaaactgaaactctatacccattaaacaacactagtggcagtttttgcttattattcttagctttgtgaccaaggctgctagttaggagaaatgttactctgtttgtacaaagaaagactttgaaagaaatgtgattagaaatctatattatcccaaaagcataatccataaatgaaaaaatggatatactggacttaattaaaatgaaagcttttgctctgtgaaagaaagtgaaaagacaagccataaactaggagaagatattttaaatcaaatttttgtttaagagatgcagtctgtgttctccaggctggacttgaactcctggcctcaagccatcctcttaccacagcctcctgaatagctgggactacaagtatgtgccactgtgcccagctgcaaatcacatttttgacaaagacttgtatccataataaacttttaaaagcctccaaatttaacaatgaggaaacaaccaaataacaaaatgggtaaaagatgtgaataggcacttcacctagaagatatgaaaatagcaaataaaggaaatgcagattaggcagatgaaaattaaaaccaaaataacaattataacaaatgtaccactctggtatgtgatgttgctaacgagggaggttgtatgtatatggtggtaggaggtatttgtgaaatctctgtactttctgcccaattttgttgtgatcctaaacatcatctataaataaaattaaagtgagataccactgtacacttaaagcggaaataccagttgttggcaagtgtgcagagcaactggaacttttatacgtttctgatgggaatacaaaatgatactgccactttggaaaacagtttgccagcagtttcttatgaaattaaacctgtatctccaatatgactcagcaatcctacttctagatatctctccaagagaaatgaaaacctgtgtttacacaaaaacctgtatatcaatgtttatagtagcattgttcagcattagtcactaaaaattggaaacaacccagttctttcaactggtgaaaaagatgaatagattgttgtatttttataccatggaatatactccttgattcgtgcaataacagattaatcttaaaatgcattttgctaggtgaaagacaccagatacaaaaggctatgtatcatttcatttatccacttatatgaataatcattccatttatataaaaatctgaaaaagcaaaactatagggaggaaaacagtggatgccagggtttgggggtatagggaagtattggttataaaataaaggcatggcatgagggattttggaggtgatgggatggttctctctctctctctctctctcacacacacacacacacacacacatacacacacacacacaccccactacccctctctctctcgccaattgtcaccaaattgatgggcatgttgtcagtgttaatatttggtctggtgtactaattaccacccctcccaaaatctatattatcagcttggtagcatatatagtacaatttcattaaagaaaataaatgatgatttattaactaatatgtcacatgaaaagtcatagaatgtgtattttagtttaaaaatatgggtatggatatacacacacacatttatttatcgtaagcgtcttactttactggaatttgctggttataccagataaactttttccactgcttgagctttcagtagaccattgtgcaagttaatgataaatttcgtgagcataacacctacttaagtttctcagaatctgttacagaaaagcatttatcttgcggttcaggcagcctgggatggaaggtaaatgctttctttttataagtatcctgaaatttcaagtgtaatagggaacaagatattaacataaattttcaaaaggcctcattcagttctagttccttttttttctttacaaacttaaatctcttcataaccatcagatgccataccacccttgtgaaacagtctgctagaactagacatgtctcaggattcttagaggactggggtaaccaaagtgggatttgaacttgtttgaggaatatacatgggtagtgagctgaaccttttaattcctagaatttatgggtttaacactacaagggttgtcaccctgtttatttctgtaaataattaaggcatgtttattgtagaaaacttcacaatgcacagcacagattataagagtactaccaggattattactcctaagataactgtttatttagttttccaaactttgctacgtaggtatatacatgtgtgtctgtccatgtctccttttaaaaacaacaaaaaaacctcattttaatattcaatatattattgactgtctttgtatgtgagaaaatttaaatataatagttgtgtattctactgaatatatggaatattatttattttaccaattcccattttattagtcttttaacttatatccacttattttggctgggcgtggtggctcacacctgtaatcctagcactttgggaggccgaggcaagtggacaacttcagtccaggagttcgagatcagcctggccaacatggcaaaaccctgtctctactaaaaatacaaagaattagctgggtgtggtggtgtgtgcttgtaatcccagctactcaggaggctgaggcacgagaattacttgaacttgggaggcggaagttgcagtgaactgagattgcaccactgcactccagcctgggtgacagagcaagacactgtctcaaaaaaaaaaaaagtacatatatccacttatttttgctctgatgaatattcctatattagtatctttgagtatctttccattatccctccatttatttccttaggatatattcctgaaagcagtatggccgggtcagagagtggcactttttaaaaacttattttttattatcaaagtagtatatatgctcatagtaatgagaagacacaaggtgcaaaaaggtacaaggtaaacagaaaatgctctgacttaacagttcccctctcagaggaactgtaaaataaacagatatacatttacattaatttatacattctatagaaaattcatgtgtgttagatgatatatttgttttcttgaaacatccactctaattacagagtttactaaggttacagagttaatatagagaggtattagagagtttaataaggttggcagttaaatatatcaaaattatgcagttatacaattatatcacatatacaccaacaataatcatctagacaatataatgaaaaaagctcttattcgtatatatcttcttattaagtttattccttagtatttttttttgttttttgggggggaccccccaaaaacaaaaaaatactaaggaataaatttaagaaatgtgcagtaagattcaatattgtaaaaagaggttaactctatttaagttagtctataaatttaagagattttgatggagggaggatctgacacaatgatgttaaggttcatatgaaagagtaaatatttgaaaacacacagagaaattctgaaaaagaaggatgacaagggggatgtgccttattagacaaaaaaatgcattaaaatgtacaacaattttaaaaagtaacattgtacctaatatattgtacacttaaatatgtgttaagagggtaactctcatggtaagtgtttttactccaataaataaaattttaaagaatttcttcatcccccctccaaaagtactggcaccaaaatagaataacaaatcaatgcaagaaaacatccagaaagagacccccaaataaaaatttagtatactgtatatttaatagtggtagcttttcaggtagatgaggaaagagtggcttacttaacaaatggcattgggacaatcagttaatgattttgaagaaaaaaagttagtttcttatgttatatacttaaactaaaataaattctagatgagttaaggatgtaaatgtaaagtacaaaaggtactagaagagagtgtaagttgaggtaaggaaggccttccaaagcctgacaccaaaggcatggtacttaaaaattaaaaaaccccacaaacagataaaagataaacaagaaacttaaaaaagactaacaatatgtgacaggtaaatgatgaatatctttaatatgcaaagatctcttacctatctgtaacaaaaaaggtaaacacccaaaataaaaatgcacaatggaagtaaacaggcagttcacaaatgaagaatacaaatggtcaaaaaatctcacaaagttattggagataaaaaacagatgatcatttttcacataacagattgacaaagcttaaaaagaattttcatagtacctgataaaagtgtggctagacactttcctatactgctagtgtaagtgtgaaatgatatctttccagagggtaatttacagtatgtatcacaagccttaagaagtactatttatatttagaacatgtggaaaaataaaaaataaataagtactatttatatatgttgttagtgggtatataaattgatacagtttttctggagggcagtttggaactatttatcaaagtttagaatgtacatgccctttgtcctagcaataacacttccaggaattttatctaaaagatatgctcatgaagatgtatatacaaggatattcattgaagcagggtttataatagcacaaaactgaaaacaacctaaatgttaatcaaaaaggaactaattaaataaaatatagcatatccacataagggaatattacaaccattttataaaatggtacgtttatctatcttctttggggatagttcagttttgttttttattgtggaggtctatatgtccttaaaatttttttttctttttaataattagagatgaggtctcactatgttgcccaggctggtcttgaactcctggcctcaagtgatccttggcttctcaaagtgctgcgattacaggcatgagtcactgcacctggcaggaggtttatatgtcttgatacaaggtgtaaaagatatgttaaatggaaaatgcaaggtgcaaaatagtacatatagtatgatcccatgtgtgtaaagaagaaaaaatagggaagatgggcattacagaggctttaaaatgcactgggaataataaagttttcatttttatctttagagtatagttcatgagtgaattcttttccattttttttcccagttatcttaaaagctctgttgattgtggatctgagaactaacatcacatgttataaaatccaaatagaaaatatatttaaattattagacaatttaaagcttatgagaacataagaataaaattactgcattcctttgcttattaattaagtatatcacactaacagaatttatttctgtgggaacaatgttaactcataggacccagatggaaatgatatgccagggtagagattcagatctttgagccttttgagtagatttttctcagaaaaagaaagatgttctctcaggtttactatttttaggcagattgagatgaccatattgtcttagttatccaggcagtctgacctctaagacctctaacgttattttgcccaatgcagattgattggtatttgttgttgttggattgagtctaaaaaagaatattttctcaactccaaaccatcatattatcttctaatatcaaaatcttcatttaacatactaacctctgtaattgctcatccatggggttttaatgtaacttacccatgtcttgttcctaatttgataaattttctatattactagttttggagtagaagatttaattcaaatgttacaaattcctttgtcctaaatctatccccaaagtcagaacaggacatgctgttttcctcaaccagtttaggaactccttttttttttgcggggggggtaggggagcggacagcatctagctctgttacccaggctggagtgcagtggggcgagcatggcttactgcagccttgaccgggtcccaagtgatcctcctgtctcagcctcctgtgtagctgggaccacagtcacgtgccactatgactggctaattttttttattttttgtagagacgagggtctcattttgttgtccaggctggtcttgaacacctgtgctcaagcagtcctctcaccttggcctcccaaagtgttgggattacaggcatgagccaccgcatccagccctctttctctgaaagtattattttcttttcacaaatggatttttctagcttttgttttttgtttatttatttattttttgagacacagtcttgctctgtcacccaggctggagagcagtggcatgatctcggctgactgcaaacaccacctcccagtttcaagcgattcttgattctcgtgcctcagtctcctgagtagctgggattacaggcaagcaccaccacacctggcaactttttgtatttttttagtagcaacggggtttcaccatggccaggctggtctcgaactcctgacctcaggtgatccacctgtgttggggcctcccaaagtgctgggattacaggcatgagtcaatgtgccctgcctttctaagcttttaaactaattatagtgagacttgttggtgctgctttttaaaaattatccttttatgattgaagaaaactgtctgattttctttttgattctcttataaatttaagattaatcttacagatttgaaaattaaagaatcacattctgctaattattttagtgcccagcactaaaagaattccttttttggtatgttttctgtcagccctctcttactgttgttttcttcacttccttaattgcagtttcctctttgttatctttaacctttgctcatttctgcctttaaacaggaactgtatatgacctgcttaatcttgggtttgggaaaaagctatctacaaatgtccaaagctatagaagacaataaatgcatccaattcagacaaagaaaatgtttggctaatttcagcattttcttaattattttcctgaataataaagtaatacatgcaaaaaataaaaataagaaattaaaaaaataaaaaatacatgcttgttttaatgaaactaaagtaatatagaattacataaagtaaaaagatagtcactccctcaaagggtaatcactattaatagcttgtattcttctagaccctttactagtcacagatatgcttccatgtcagtatatgcagatttagcttcttgttcttaactgctgtatagtattctatagtatggatgcaccataatttatttatctattccctaattgataggcatttagagagtctccaaattttaactattttagatatgcttatacctataactttatacatctgtgtaagtatttttgtagctagattcttttaagtaaaattgctgggtcaagttaggtacacatcatatgttgataagtattgcaaatttgcctttcaaaaaaggccgtagtgatttacacttcattaacagtatgataaaatatttttctatacccttgaccatgcttaatagatacataagtcttttaaatttttgccaacattataagaaaaaaacacgatgtcattgttttagtttgtatttaaatttctcaaatttgtgtttttaactagtttagttgaacatcttgtaacaactacattatatgtcaaataaaaaagtttgtaaattagagcatatgctataaaccttcagcaagaaaaaagtgtacacagaagaaagtttgtaattgtttatccctctttttctgcatatgtttgggataaagtaacataatatatgaactgatcatcttttcaggtgcctataaagaactcccaactggtagactttagcatctgttgggatgataggccaagtgatatttttaatttaaaatttttttagagacagggtctctagctcaggctggagtgcagtgacatgatcatagctcaccgtaacctcgaactcctgggctcaggtgatccttcctcagcctctggagtagttgggactacaggtgcactaccacgctcagataattttttttaaaaagtttatttaaagacgggacctttctgtgttgcccaggctgatcttgaatgccaatcctctagtgatcctcctgtgcccggccccaagtggctcttttctaccctgctctctcacttgttgtctggctgaacaggctcaagtctgccagtgaaagtgacttagctttgtggacagttgtgtcattcctcagtatggtatgtatgtatgtatgtatgtatgtgtgtatttatttatttatttatttatttatttatttgtgatggagtcttgctcttgttgcccaggctggagtgcactggcacaatcttggctcactgcaacctctgcctcccaggttcaagcaattctcttgcctctgcctcccaagtagctgggattacaggcgcctgccaccacacccagctaatttttgtatttttaattgaaatggagtttcaccatgttggccaggctggtcttgaattcctgacctcaggtgatctgcctgcctcagcctcagcctcccaaagtgctgggactacaggcataagccaccacgcctggccgaggatgttatttaatgttttgttttgttttgttttattgagataagatctgactctgtcacccaggctggagtgcagtggtgacattttggctcactgcaaccactgcctgcctggctcaggtgatcctcccacctcagcctcctgaatagctgggaccacagtcattcactaccacacccaactaacttttttgtattttttgtagaggcggtgtttcgccatgttgccccggctggtctcaaattcccagactcaagcgatctgcccactttggcctcccaaagtgctgggtttacaggtgtgagccactatgcctggcctggcaattatctttgactttataaatctttcttatattttagataactgatatagctcactactatttaatgtttatctgccttgataactctttatgttgtgtttataggccagagtccctgtagacacatgtactaattgaccagaattacacaataaaattgcagagctacatagtagcagaatagtaatttgccaaattattttaataggtcaatactgaaaggataatattatttgctgacttttattaagacctatattaagattctatagtgttatatttctaaggttacaagtttttttcaagaataaaaatatatgtttaattatgagttttactgttcatccaaaggtgtaacataaaataaatttacaggtgggataagatggattgagttacaattttttaacctcaggatctttgatggctagttcctacccctaaggtcatcttatgtgttcatatgcggtaatgcttttttcattagattttgcatttcaatcacagacatatttgtcaaaaaagatgaggtaggctggacactgtgactcacacctgtaatcacagcactttgggagacctaagtgtgaggactgcttgagtccaggaatttgatgccagcctgggcaacatagtgagaccccatctctacaaacaaatccaaaacttagcaaggtgttggtggcacgtgtctgtaatcccagctactcaggaggctgaggcaggagaatcacttgaacccgggaggcagatcgcagtgagccgagattgcgccattgcactccagcctgggtgacagggcgagactctgtctcaaaaaaaaaaaaaaaaaattccatttccttttttatatccattctaaaaataagcatatgatgagccaagaacatccactaatgaccagttgttacatccttttatcttgatccctttgaactcattccaagttattgtactaacctattaagctgattgttcatgaaatagaaatcaaagccaattatttcacatttaaagtatatataacaaccagttcttgccagaaaatcagaagagagggcaaagtcaagaaaaattataaaaatacattacaaatgaaataaaataacaaggaaatgactgacaatgaaatgtatctttccatttattcatagttaattttgattcttcaattcttcattgaaatttctgaaatataaaaaataagtgtattaccacttcacatccactaggatggctattactaaaaaaaaaaaaaaaaaaaaacctcagaaaatatcaagtgttggcgagaaactggaactcttgtgcattgttgataaaatgtaaaatggtccagtcatggtggaaaacagtatggtggttcctaaaaatattaaatatagaattaccacatgatctagcagctccacttctggacgtatacccaaaacaatttgaagtagggatttcaacagatatttgtataccagtgttcattgcagcattattcatagtagcccaaaggtggtagcagcccaaatgtccatcaacagatgaatgaataaacacaatgtggtatgaatatgtatatatgatataatagaacattagctttaaaaaggaattaaattctgacacatgatactacatgggtgaactttgaatgtgttatgctaaatgaaataagccagccacaataggacaaatattatatgagtttacttatgtggagtacctagagtagttaaaatcatagagatataaagtagtaccgtggttaccagggtctgaaggggagggagaatagggagttattttttaataggtacaaaatttgaatttgggaagatgaaaaagttctgaagacagatggtggcgatggttgcacaacaatatgcatgtacttaattccactaaattttacatataaaaatggttaaaatggtaaattttatgttattgtgtattttaccacatttttttttttttgagacagagtcttgctcttgtagcccagactggagggcaatggcacaatcttggctcactgcaacctccgtctcccgggttcaagtgattctcctgcctcagcctcctgagtagctgggattacaggcgcccatcaccacacctggctaatttttgtatttttagtagagacgggtttcgccatgttggccaggctggtctcgaactcctgacctcgtgatctgtccgcctcggcctcccaaaatgctgggattacaggcatgagccaccatgcctggccaatttttttttttttttttttgcgacagagtttcgctcttgttgcccaagctggagtgcaatggtgcgatctcagctcactgcaacctctgtctcctgggttcaagcgattctcctgcctcagcctcctgagtagctgggattacaggtgtgtgccaccacacccagctaattttttgtatttttagtagaaacggggttttaccatgttagccaggctggtttggaactcctgacctcaggtgatcgccctcttcagcctcccagagtgctgggattacaggcgtgagccaccatgcctggccattttaccacaatttaaaaatatttatttatttatttatttatttatttatttatttatttattcattcattcattcattcattcgttcattcattcattcattcaagacggagtcttgctctgtcacccaggctggagtgcagttgcacgatctcgactcactgcaagctccacctcccaggttcatgccattcttctgcctcagcctcctgtaatggctggaactacaggcgcccatcactacgccccgctaatgtttttgtatttttagtagacggggtttcaccgtgttagccaggaaggtctcgatctcctgacctcgtgatccgcctgccttggcctcccaaagtgctgggattacaggcgtgagccaccgcgcctggctaaaaagtcttttaaaaaagtgtctgcctttctcagaaaatagtcattttgctatagcccatacatattttgagagaaaagacaaatgttgtataaaactgtgtgtgaggaaaatcatctctgacttccactgagtattctgaatggcagcaacttaaagaatagcagcaaaacctaatggacatatccatttataataggacattgcagccatggctttatagggcaaacactggggaaaatgcaatgatgggaagaacaaagtggacgtcggtagttttttcttctttgttctgtgatatggtccagactctttcctcacagacaatggaaacatggtagaaactctctaccatggtcggtcagttgaagaagggaatcgtaaaaattatgtaaatatagcctagtcatttttttaaacctaaaacatgttcatttattctccaatatttatttgtatttattttatttttatttttattctggagacggagtcttgctttgtcgcccaggctggagtacagtggtgtgatcttggctcactgcaacctccgcctcccgggttcaagcaattcttctgcctcagcctcccgagtagctgggaccacagacgcatgccgccacactcagctcattgtttgtattttaatagagacagggttcaccgtgttgcccagactggtttcgaactcctgagctcaggcagtctgccaccttggcctcccaaaatgctaggattacaggcgtgagccactgcgcccggccttattctccaatatttatatgtagggccacaaccttttctttgcatgtgggtcctttggaattcttcctttccttccctgtataaaccacacccataatgcttcattccagatttctatctcctagtttggttttattaaaatagagaacaaatttaagagatgagagttcttttaggtttttattattaccccccaatctcttaaagtcgcttcacgtacagctattttagcagtaactttgctactcaccttattgaacattcctaatgcattcaactttgttttcatagaaagaacaactctcctttttgctgttatttaatcaacgtacataatatttaattaaatcacttggccatgagaagttcagtggacataaacagcttgagggcaaacacagctgaatttctatatgccaacaattctactggtgggaacaaggagtgtgcatctaagtactaagcatgctatgggcatctgaatattttagtgatagaaaagagaccatcagttaacccattggaggttggttaagataaatttttgcagggtaaaatttgctttttcttaatgtatcctaacatttttcttgtatgaaaatagagatctacatcattgtttttaagggacacatggtatttattatacatgcattaggctgggttcttacttgaagacaacataaagcagttctgactcgcttaaccagaaacggaatttattggttaggctatttggattgtttatagagacaacagaagtcaatcagagtcaaccaggcttggaaaataggtaggaacacaatgagactaaaacaggccaaggacatgccccaggaagtctagtgaggacctcttcactggcactggctttctcaggacttttgccagggccacttctggcatcttgactgtattgctgcctgtgctgagaattatcttcatctgtccttgtgtattcatgtcactttctcatgattcaaaatcctgggcagaagtgtctgactagccaagtctagaatcatttagaagcatctcagcttcaaggggacagggaaaaggaatatctgtctcctcccttctcccttcctcccacaacacacatgctttggctttaataatgggagccagggttgtactgtttatttctaagacgcttgcggtgggggcattttcttggcatgggatgtgtgtttgaatgctgggtagccaaaaatatgacaagtgttacactgtgatgcactagagtttatttaattaatatcctattataaaaaatttagatcgtttccagttttgttctgttttaagccacatagtaatggacacatgtgagcaatctactgggggaatgaggtatcttagctgttttaattaattattttaatttttaattttagctgttttaatttagattttaaaagttattagtgaggtgcagtaacttcatgtgtattggcattttggttttcttattttgtcaattgtctggcatatatattttttgagatataatttaacataccataaattcattaataaaaaaatgtcgtccaggcgcagtggctcacgcctgtaatcccagcattttgggaggccgaggcaggcagatcacaaggtcaggagatcgagaccatcctggccaacatggtgaaaccctgtctctactaaaaatacaaaaattagcccggtgtggaggcgcatacatatagtcccagctacttgggaggctgaggcaggagaatcacttgaacccgagaggtggaggttgcagtgagccaagatcacgccactgcactccagcctggtaacagagtgagactctgtctcaaaaaagaaaaaaattaaaaaaaatttaaaaaagtcaaattcagcgatttctagtatgttcacagacttgtgcaactatcatcactatctaattacagaatatttttattaatacaaaaagaaattccatgtatatgtttttgcagtttgtttacatggtggtttttgccacacaaaattttaaaatttcatttaattacattttaatctcttttcctttacagtttctgttttggcttatgcttagaaatgctttccccacccaatgttttgttgttgttaggtaatgcttatttttatattttcctagtattttttactttttatttttacatcttgttctttaacttggaattaatttatagattgtaagatggtttctaaaaatgttcacaattattaaatggttagcgtattatcccagcactacttactgattttctcagtgatgtgaattgctgcccttgttatatactgaattcttatatacacacatatgtacgtttctggaactttctgttctgttgcaaggatctttctattctgacatcagcacaagacctttttttttttttttgagatggagtctcgctctgtcacccaggctggagtgccatggtgcaatcttggctcactgcaccctctgcctcccaggttcaagtgattctcctgcctcagccttccaagtagcttggactacaagcatgcaccaccatgcccagctaatttttgtatttttttagtagagacgggtttcgccatgttggccaggctggtctcaaactcctgacctcaggtgatccgcctgccttggcctcccgaagtgctgggattataggcgtgagtcactgtgcctggccaatactttttttaatagacaattttttagagtaattttaggtccacagcaaaattgaacagaaggtacagtatgtagccttttcagattggcttctttcacttagtaatgcacatataagtttcctccaagtttttttatgaatagctcatctttaatgtgtgtgctgaataatatttgattgccttgctgcaccacagtttatttatccattcacctactaaagggtatcttggttgcttccaagtgtcagcaattatgaataaagttgctgtaaacatctgtgtgcagttttggtgtagacataagttttcaactgttgtgggcaaataccaaggagtgcaattgctggattgtatggtaaattatatttagttttgtaagtaactgcccaactgtcttccaaagtggctgtactattttgcatttccactagcattaaatgagcattcctattgctccacatcctctttagcatttggtgttgtcagtgttctggattttggccattctactaataatagatatgtagtagtgtctcatcattgttttaatttgcatttccctgatgacgtatgatgtggggcatcttttcatatgcttatatattatctgtatatcttctttggtgaattgtcttttaaggtccttagcccataacatcaggttgttttcttagcacaagactttttaataattaaaacttttaaagactctttaatgtctggttgggtaattagcatttagcatcattattttttagtaatgacttttataaaattaatggtatacttgaaatgtttggccaaactgagttgtccttttcagcctcaccaaacttttattgttttcttgtagtttattcttaacaagttatgataaatataaaataagtgttttttctttttccttttttttttttttgatagtcttgctctgttgtccaggctggagtgcagtggcatgaacttggctcattgcaacctctgcctcctgggctcaagccgtcctcccacctaagcctcctgagtagctgggactacaggagtgtgccaccgtggtcagctaatttttgcattttttgtggagacacagtttcactatgtttcccaggctggtctcgaactcctgggctcaagcaatccgcccatctcgacctcccaaagtgctgggattacaggcgtgagccaccatgtctagcctgttttttcaacttattctacataagtggttaaatactgacagttattttcgttttcataggcatttaatgttttcgcatttgttggttttggcactattttgtcttagaagtaaatttgtcttagaagaaagcaataacattacaggcagttcttgatttagacatagattgtgtctgacaagttgaatcagatgatttaaaaataaattttcttaatatttttatattcgggggtacatgtgcttgtttgttacatgggtattacatgtgtaatcaggtgattgttttgatgagggagaggaggcattccaatcaccaaatagccttcatagactcaaagattcctgcaccaagaccatatttaacacataacattgttgaaaagtagctgactcatttgtaatttcaagtagttgaattctacttccccctaccttcctgagataatgatagctgccttgcaagaaaagttccacacacactaaaaacatgtttctaccttttgtctattattgacatggcagcaattgcttagcccctgttggaaaggcacatatatacttgaggcatatttctcacttttggggaacctgtctctacctgtgtttattgcagggtattggtatttttcaagcattctctccacaccactctcacctttggctggttttactttatgacttttgcacacattgccctgttaagttaatccttttgaggttattgttagctttggactccagcctgaattggctgtatgaacatagacaagtctcagctttagcttccttaattttaaaaggaggttatgattctatttacgtagcaggattggtgtgagacacatgcagtgctataggaatctgaagcatctgtattgttatcataggacaacttatttgtagagatgctatgactactctaggagtcacaaaaatgaccagtgaagtacattgccttttaatttgaatgttctgttcttttttgaccttattactgtgtttaagtattactacctaatcttttaggaatggtcaaataaaaaaaactgttatttattttattttttttcctgagatggagtctcactctgtcacccaggctggggtgcagtggcgtgatttcagctcactgcaacctctgcctcccgggttcaagcgattcttctgcctctgcctcactctccgagtagctggattgcaggcgtgtgccaccatgcccggctaatttttgtatttttagtagagacgggatttcaccatattggccaggctagtctcgaactcctgacctcattatctgcccaccttggcctcccaaagttctaggattacaggcgtgagcaactgtgcctggcaaacatacacctgcctacttcagttgtttcatctggaatcttagtcctctgtttatataatactggttgtttgatgaaagaaattagacacttagtattttggaaacaagttaagtaataagattaattttcattttaaaggtttatacaatttaaaagaaaaggatgaattatataaaataatagagaagctaatgctttccccttttgttttcattttagaatgtggtagcaattttaaataaaagtgaatgggtaggaaaaaaattaattgatctggaaatactatatagataccttgaaggcaactagttgattgttatttgcatagctagaaatcatctatttatttaataaaataagcacgtttttatagccttggtataataaaatgggttatttgggctttttatatatatgaatttatcattggtcttacttattgaattatttcagtttcagtaacttttctcttaatttctacgtactttgtattttttttctttttcatttcccattaaaatgagttggctttatgagatgaaataatttaggcctacaatgagtataggtagtcctatgacatacctgtgtatttactacccagcctaagaagttaaacattaaatatatagttgcatttcccctttgtgctcctctcaagtcactcctctcccctctctcccctcaatctgttgaatttggagtttatcatgtctgtgcacatttttatatttttactatcacaactatatatgtgtgcatacaaaaacaatgtataacattgttttatgtttttaaacctttgtatcctttttttggacataacatcaacattttattttattttttattcataagcattgttttcttttgtcttgcatattttaaaatgtattagatggtatcaaactatcactttgtcatttgcatttttcttagaacattgttttcttagaacaatgtttcttagaacatttttcttagaacattgttttcttagaacatgcatttatttatcaacatatattgatacataaaaatacttctagttcatttgtttttaaaattattttgtggcacattataattattcatatttatggggtacaatttgatgttttgatacatctacatgttgtacaatgatcaaatcagggtatttagcatatctatcacctcatacatttatcagtgctttgtgatgagaacattcaaaagcctctcatccagctattttgtaatgtacaataccttactgttaacaatcctcaacctactgtgcaataaaaacaccagaacttattccttctatctaaatgtgaccttgtagccatttaccagactctttccatccttccctccccagtctctggtaaccactgttctactctatgacatcaaccattttttttttttttttgaaattccacatgagcaagatcatgtggtatttgtctttctgtgtctggcttacttcacttaacatgatgtcttccaggtccatccatgttgtcacagatggcagaattttattcttttttatggctgaatagtattccatgtatatatatacaccacattttgtttatgcatttatccattgtcggacatggattgattccatattttggctattgcaaatactgctgcaataaacatggcaatgcagataatctcttcaacataccaatttcatttcctttgaataaatacccagtagtgggattgctggatcatatggtagttcaattttcaattttttgaggaatcaccatactgtttcccatagtggctatactaatttacaatcccaccaactgtgtataagggttcccttttctccatatcatcaccacccctcttttcttttgttattttgataataactggagtgagttggtatctccttgtggttttcatttgcattttcctggtgatcagtggtatggattgcatctgtgtcctggccaaatctcatgttgaaatgtaatccccagtgttggaggtggagcctagtgggaagtgtttggaacatggaggcatatccctcattaatggctttgcactatccccttggtgatgagtgagttcacatgagatctggttgtttaaaagtgtgtggcacctcccattctgtctctcttgctcccacatcaccttccaccatgaacaaaagctccttgaggcttcactggaagctgagcagatactgacaccatacttgtacagcctgcagaactgtgagtcaattaaaccttttttctttatcaattacccagtctcctttctttctttctttctttctttctttctttctttctttctttctttctttctttctttctctttctttcttttttttttttttaactgacacagggtcttgctctttcacctagtctggagtgcagtggcccagtcacagctcactacagccttgacctcctgggcttacgtgatcctcccacctcagcccccaggtagctgggaatacaggtgtgtgccactacacctggctaatttttgtattttttgtagagactgagttttgccatgttgcccaggcttgtctcaaactccagggctcaagcattctgcctgctttggcatcccaaagtggtgggattacaggtgtgagccactgtgcctggccaggtatttctttatagcaatataagagcagcctaacacaattagtgatgttgagtgttttttcatgtgcttgttgggtatttgtatgtcttcttttgagaaatgtctattaaagtcttttggtcatttttaaaaaaatttattattatcatactttaagttttagggtacatgtgcacaacgtgcaggtttgttacatatgtatacatgtgccatgttggtgtgctgcacccattaactcgtcattggaaacaattaacaaagtaaagagacaatctacagaatgggagaaaatatttacaaactatacatttatcaaggggttaatatccagaatatataaagaacttaatgaccacaaaataacctgactaaaaaatgaccaaatgacgagtcttattttgtggttgttaagttctttatatattctggatattaaccccttgataaatgtatagtttgtaaatattttctcccattctgtagattgtctctttactttgttaattgtttcctttgctgtgtaaaagcttttcagttttatgtaatctcatttgtctacttttgcttttgttgtctgtgcttttgaggtccactcaaaacttccttgctaagcccagtgctgtaaagcatttcctgcatgtttttttttagtagtttcatagtttcagattttatatttaagcatttaatccattttgagtagatttttgtatatgatgagaggtaggggtctagtctcatttttctgcatgtggctattcagttttctcagcaccacttattgaagagagcagtgtgtgtttgttatggtttggatgtttgtcctttccaaatctcatgttgaaatgtgattcccagtgttggaggtgggacttgtgggaggcgattggatcataggggaagatccttcatgacgggtttggcaccatctccttggtgataagcaagatatggtggggggttttttttgtttgtttttgtttgtttgttagtttgtttttcaccatctcttacaggaaggagaaatctggttgtttaaaagattctggtacctccccctgtctctcttgctcattctcttgccatgtgacatgctggcataccttcgctttctgccataattgtaagcttcctgaggccctcacaagaagcaaatgccagcatcatgcttctgtatagcctgtacaaccatgagcccaaataaattctcttttctttataaattgcccagtctcaggtatttccttatagtgatgcaaaaatggactaacagtgttcttagcacctttttttgaaaatcagatggctgtaggtgcatgaatttattttagggctctattctgttccattgtgtatgtgcctgtttttataccaatactatgctgctttgattactatagccttgtagtatattttcaagtcaggtagtgtgatgcctccagccttgttctttttgcttcagattgctttggctatctggggacttttgtcattccatatgaattttagggtagttttttcctatgtgaagactgtcattgatatttttatagggattgcattaagtctatagattgctttgggtagtatggccattttaacaatattaattcttccaatccatgaacatgggatagcttttcatttgtttatgtcttcttcaatttctttcatcaatgttttatagttttttttttttttttttttggagacagagtctcactctgtcacccaggctggaatgcaatggcatgatctcagctcactgcaacctctgcctccagggttcaagtgattctcctgcctcagcctcccaagtagctaggattacaggtgtgcaccatcacactcagctaattttgtatttttagtagcgatagggtttctccatgttggccaggctggtctcgaactcctgacctcgggtgatctgctcccctcagcctcccaaggtgctgggattacaggtgtgagccaacgcacccagccagtgctttatagcttttagtgtagagatctttcacctccttggttaagtttattcctaagtatcttttttttatgtagcaattgtaaatggaatttttttttcaggtggtttgctattagcatatagaaacactactgattttaataagttgattttgtatcctgtgacttactgaatttattttttagttctgttttttagtagattctttagggttttctgtatataagatcatgccacctgcaaacagggacaatctgactttcttctgaaacttttttttctaaactatgttaatgggatttatccctgttgctacttgcagctctacttcaagctttctcattctcagtgctatagacatttggggccagatcattctttgttgtgaggggctttcttgtccattacaggataattggcagtatccatggcctctatgcactagatgccagtagtactcccttgctgcactctgagttgtgacaaccaaaagtgtctccagacattttgaaatgtcctattggtggtgacatcaccccttctctcagtgagaatcacatttctagttcattcattttaacttctatattatgtttcattataaatataccacaaccaattttttcatttccttgttgatggacatctagattatttccaaagttttaactattagcaacattgttgcaatgagcatttttgttcttgtttccttgtgcacatgtgtgagactctgtctaaggtactatgcttaggagagaaaatgttgagttttaatatatgcatattttcaactctaccggctatcatgaagcagtttccataattgtactaatttatactctaaccaacggaacaagagagatcctgtttctccatatcctcaccgacacttggtattgtcagattttgagatttttatctacctgatggaggtacattatattccttgattaccacaaggatcacaaattgtgcagatagagttgtatccaaaaaaggattaaggctgggcgtggtggctcatgcctgtaatcccagcactttgggaggttgaggcgggtggaccacttgaggtcaggagttcgagatcagcctggccaacatggtgaaaccccatatctactaaaaatacaaaaattacctggggcctggtggcatgtgcttttagtcccagctactcaggaggctgaggcaggagaatcacttgaacctgggaggtggaggttgcagtgagctgagactgctccactgcactcccgcctgagcgacagagcaagattctgtctcaagaaacaaaaacaaaagcaacagcaaaacaaaacaaaacaaaaccccaaaaaagaattaaatcttactgcatgattattgagaatacaggagcctttcccaaattataagtgctgattattttaggggaattttagaatgatgtttgagcttctgtgaccagctttaagaagtggttttgaacaatcagacttcatatgtgccatgttttctactcaatttctgtagtttctatttccaaaccagagatgatcatctagtcataatattgttcttcatcttagaaaatgatattactgatggtgattaccatctctacttagggaatggctcaaaatatattaataacttgaagttatttccctcagtgttgttggatgcttttgttctcagagtcactcatcactaacagctggatgccaaatttgtctctttgatactgtcgtttcccagaagcctacatgttttttccatactatatgaaactgtttatgatcttactctgttttctgagtcattttgctaaatgcagtaggatgttacaaaagatattcctggttttgtacctacctttaagatttaaaatgaaaacgatggacataacatatataacaaagtcaattagagttgtgtgtatatgtaataaagtagtgagagtgagatggaattcctccaaggtttcatgtgtaaagtccaatttaagtagagttttgaaaaaaaaacaatgcaggtgaattacgaaagcgaaagaaatatgtattcagaattgatatgacttaaattaagatgtagtgggaaaagtggcttaattagtataatttttgtttgtgctcacacattgtggactcctcaatacttacttcctgggtgaattatccagtgcctttctgcctgactgatctctctcagttcctcagtaagcctgagagttagtccagtgctttggtctgggacataccccatgataaaactgtatttcagtcttacattcctaaacaggtaaactagccttcacctaccaaaggtattgtattctaaaagtttgttgccaattctgtttgttgaatttgatgttttcccataaaacgatttagtcaactttggtaatcttgcaagatcagccctcaaaagccccatttgacccataagatacaggagcaagtctgagttctgtgttctggaggtagacagccaaagctataagaagaataaggaagagtttccttttttaggctcaggactatccttagataaaattttgataggatctgtttgttttagacattcttctacttccatttttatacccttgtactgcttcccactgactcctcctgggctcctaataccttcatgcttgccttaagtactccatcctggactcgccacctgaactcatcctatttgtcctttgctcccaaacttgcctttcctgtcctatctgggcttttgttctcttgtagtaactgaccttatgtaggtattaagagatataattccaactatcacccccctgattatcaaaaaagagtttatattttaaaaagaagatacactggatgttaagacaactgaccttcaaaaagtcacttcatgggggaaaagagatatggaaggagctattctagattaaatgagacaaaagagacataaaaccaaatgcaatgtgtgaaccttgtgagggtcctgaatagtaaaattggacttcttcagacttgaaaacttgtacacaaaaggacactatcaagagaatggaggatttgggtacaagcggttgaaagatggtttggctgctctggtcggattctgccgtcccagtgaggctggaaaatagggtctagaggcaggaacataaggctgattcacacttcagctatgacaggaaatatcctctcatagagcataggccaagtaaatgattttgtaactttacttcatcctctccttttacatagggtgtactccaagtagagggtatttaaactcaaaaaaactctgtaagagggccttttgagcccctgtgctcaggcctgctcccatactgtggagtgtactttcattttcaacaaatccctccattccttccttgctttgtttgtgcgttttgtccaattctttgtttaagacgccaagaacctggacaccctccactgttaacaccagcccttccctgtggctgaccctgaggtgttatgagtttcttcacagccctacttcctctctcttctccctcattttcagacccttcttcagcatcttccctgggcattgctgtgagtttaggccggcccgttttgagcaggagcagcagcggaacagtagacctgctggaggaagtggggctgcagatcagagacacagcattttcgtcaaccaaacttcttgaagccatatctacagtatcagctcaagtggaagagcttgccgtcaaatgtacggaaaatgcacgtttccttaaaacatgacgggacctcttgaaagaatgctgtgattcttggaaacctgacaattgatttggcatacttagctctttgatagtgactgtgtaataattcatacttcctcatatatgatcatttcacatgtgccacatatataggataatatctagcagttctctatatcttcagaatgaagtttttcttggttttcttgacctttgtaaaagcagaatactgattctatttttgatgttgatcagtacttgtttattcttacactttctgcccttcaaactttcataaaatcctttacaaaatttaattttatcagtagatagttaatattaattgtgccacagtgctaccagtagcaaactaagtggaccattatttgttttgcagtaagatgccaagcatggcagaattagaagttgagcttcatcttatggaccaagggagataactttaaggttccagctccattaggctgagttctctaggcaaatgattgtcttacttacttcgatatccccagcacctaaaacagtgtcacatagcattcactaaatgtttattgaaaagaagagttgattaacataatacaaagctattttttcttcctgtatttagcaggaagactataattgtttctctaaaaatgtatgaatcaggactttgttgacttgaaggaaaatgttatctttttcacagagattttaactttgatgatagcttttaaaaacatgataaatacttttgtcctcaaatgattattttaaaaagtcttttttttttgagacagagtctcattctgtctcccaggctggagtgcagtggtgcgatcttggctcactgcaatctctgcctcctgggttcaagtgattctcctgcctcagcctccctagtagctgggattacaggcgtgtgccaccatacccggctaattttttgtatttttagtagagacaaggtttcaccatattgaccaggctggtctcgaactcctgacctcaagtgatccacccgcctcggcctcccaaagtgctgggattacaggcgtgagccactgcacccagctaagaagtctttatttcagaaaatgaaagactgtctagaaagaacgaattttttttcctatttatttctatggttactgcttttacacttaatattttttgttttcggtatttttatatgtttgattgctgtctttaaagtgccttatcagatttatggctctgtactatgaattttggagctttacaagttatttacataactctaagttactttgcttccaatacatcaaatttaaataacatgattgtttttatattatttgaccttagtgacaatgtcctattttatttgttctgtatcttatgtcgctttttggtagtttgtattatgtgtgaatgattaagccaactaattctgtaccatatataacttctggatatctttgatatgacatcttaattctttgtagatatggtgatgtgtacagaatgatattctgaagctccacaatggtgcattgaaaggctgcagatggatggccaaagaatagttttgtttagcatattaggtctagttctggacttttttttttatactttaagttctggggtacatgtgcagaacatgcagttttgttacataggtatacacgtgccatggtggtttgctgcacccatcaacccatcacctacattaggtatttctcctaatgttatccctcgcctaatccccaccccccgacaggccccagtgtgtgatgcttccctccttatgtctgtgtgttctcattgttcaaatcccacttacgagtgagaacatgcagtgtttggttttctgttcatgtgatagtttgctgagaattattgtttccagcttcatccatgtccctgcaaaggacatgaactcatccttttttatggctgcggagtattccatggtgtatatgtgccacattttctttatccagtctgttattgatggacatttaggttggttccaagtctttgctattgtgaatagtgcctcaataaacatacatgtgcatgtgtctttatagtagaatgatttataatccttcgggtatatatcctgtaatgggattactgggtcaaatggtatttctagttctagatccttgaggaatcatcacactgtcttccacaatggttgaactaatttacactcccgccaacaatgtaaaagcactggacttttttttttttaagttaaaagatcacacacagggtgtgatttctataccaaagatatgcttatttcagtatgaggaaaaatatttttcttacatgtcctgaaaattgcaattttaaaaatgtacaaaataaatttttattaaaagcaaattttatttcaaaaaaaaagagtgaaagacaaccaactggataggagaaagtatttgaaagtcatatatctgataagggattaatatccaagaatataaagaactcttacaactcaacaacaacaacaaaataaccttattaaaaattgggtagagtgcttgaatagacatttcttcgaagatatacaaatacccaataagcacatgaaaagatgcttgacatcatcagtaatcagagaaatgtgaatcaaaaccacaatgagataccacttcacacctgctaggatgggtagaataaaaaagataataggtatcggaggtggaacaattggggcccttatatactgctcatgggagtataaatggtacagtcactttggaaaacagtctggcagatcctcaaacaattaaacatagagttattatatgacccagcaagtctactcttaggtattaccaaagagaaatgaaaacacaaaagtttgtacatgaatgtttatagcagcattattcataatagccaaaagatggaaacaacccaaatgttcatcaactgacaaatagataaattatggtgtatctatgcagtggaatattattcagccataaaagggaatgatgtactgatatgtgctgtaacatggatgaacactgaaaacatgctacatgaaagaagtcagtcacaaaagaccacatattacatgatttcattcatctgaaatgtccagaagaggaaaatctatacaagcaaagtagattagtggttgcccaggacagaaggcttaggaggtgatgactgataggtaaggggtatgttttgttgttgttgttgttgtttttaggtgatgaaaatgttctgaaattgcctgtggtgatggttgcacatgtctgtgaatatgctaacaactattgaattctacactttaaatgtgcgaattatataatacgtgaactacatctcaagaatgttttaaaactggtgttgggaaaacaggacatccacatgtaaaacaatgtatgtcagatccttaccatacaccatgtacaacaattaactcaaaatggattaaagacctaaatataagagccaaaactacaaaaactcttagaagaaaacatagcagtaaatattcgtaagtttgaatgtggcaatggtttcttagatatgacacaaaaaacacaaaagaaaaaagataaattggacttcacaaattaaaagcttttgtgattcaatggacaccatcaagaaagtgaaaagaatggaataccgatacattttacacatcaatgtaccttgaaaacattatgctaagtgaaagaatccagacacacaaggacacatattgaatgaatcaatttatatgaaatggccgtataggcaaatccgtagagataggaaataaaattagtgtttgccaggggctgtgagtagagaggaaatggggagtgttgctaatggacatgggatttctttttggagtaatgaaaatgttttgcaactacatagtcattatggttgcacatccttgtgaatgtactaaaaagtactgaactggataccttaaaaggctgaatttttttcatttcttctaaaaaaaaccaggatagatgtgcagaacgtgcaggtttgttacgtaggtacatgtgtgctatggtggtttgctgcatctattgacccatcctttaagtttcctcccctcacccctcaccccccagcaggctccggtgtgtgatgttcccctccctgtgtccatgtgttctcattgttcaactcccatttatgaacaagaacatgcagcatttggttctctgttcctgtgttagtctgctgaggatgatggtttccagcttcattcatatccctgcaaaggacatgatctcattcctttgtatggctgcatagtattccatggtgtatatgtaccacattttctttctccagtctatcattgatgggcatttgggttggttccaagtctttgctattgtaaatagtgctgcagtaaacatacgtgtgcatgtgtctttatagtagaatgatttatattcctctgggtatgtacccagtaatggggttgctgggtcaaatggtatttctggttctagatcctcgaggaatcgccatactgtcttccacaatagttgaactaattcacattcccaccaacagtgtaaaagcgttcctatttccccacagcctcaccagcatctattgtttcctgagtttttaataattgctattctgactggtgtgagatggtatctcattgtggttttgatttgcatttctctgatgatctgtgatgttgagctttttttcatatgtttgttggccgcataaatgtcttcttttgagaaatgtctattcatatcctttgcccactttttgatggggttgtttttttcttgtaaattgtttaagttccttgtagattctggatattagacctttgtcagatgggtagattgcaaaatgttttctcccattctgtaggttaaaaggctgaattttatagcatgtgaattatatcccaatttaaaaaagaatgcatatgtcttagttcaggcttccataacataataccatagactgggtggtctaattgttcaaagctccacagaaattagttggagaagttacaagagtccattaatcatcttgctttgttagtagcagcgggcatggttcagcattttctgcttaagtttctctgagctcaccaaaactaaaatgatgttgtaatactttttttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcactctcttctgcactgaggtgaggcagatgtcaaactcatagccagcatctcgtagcgcctgcccgccgcgcttcgcctcctcgtggcccgccgggctcagatcggcgtcgtaccagcagctgaagcggttctccaggttccatgtgctctcgccgtgccggatcagcaccagtttgtaggcggccatggcggtgggctgcaatactttttataccatttgaagtaaaaggtacaaaaggttatacgctgaaaattctttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctattggcgggaggccttaggtctttgctggtttttgacatgaggcctcagttcctcaccatatgaacctctccataaggctgcttgtatgtcttcatacttggtaggtggcttcccccagattgcgtgattcaggagagaggacaacaaggaaaacacaatgcttttttctcctcttgcaatgttttttatgacctagtcttggaagtcacaccttgtcgcttctaccgtagtctattcattagaaacaagtcattaggccaggtgtggtggctcatgcctgtaatcccagcactttgggagggcgaggcgggtggatcacttgaggtcaggtgttcgagaccagcctagtcaacatggtgaaaccttgtctctacttaaaatacaaaaaattagccgggtgtggtggcatgcgcccgtaatctcaggtactggggaggctgatgcaggagaatcacttcaacccgggaggcggaagttgcagtgaactgagatcgtgccacagcactccagcctgcgagacagaattgagtctcaaaaacaaaaacaaaaacaaaaaccaaaacaacaacaacaacaaaaaacaagaaacaagtcattaagttcaggccacaccgaaggggaaaggattaaattccacctcttgaaggaaggagtagcaaagaatttgtgggcgtattttaaaaccaccacaggaaggcagacaataagcaataaacagaataaatcagcaagttatggagtatgttagaaggtggtacgttctatgaaaacaaaagaaaaagcagaggtaaggggaatcagagtatgtttgtgtggaagggatgtaggttgcagttttaaatagggtggtcagcatagtcctcattaaggttagatttgaacaaagacttggagacaaagaagttagccaagcagttatctggaagaagaaagtcccaaagcaagagaatagctaaaataaggccttgaagtaggagtcatccttgcatgcgtaacagccaggaggccagtatgactggcacagagaagggtttggtgagtggtagaagaggaggccaggtaaacttgagggggacaggcatgggaaatcatgtgggaccttgttggctgttgtaaggatttgaggcatttttgattagttcttaattcgtacttacaaatgttaaatgagattatgtatgggaaacattagtaatcaggaaagcactctatgaaagctagttacttgtattaaagtattgaaatttttatttttagttagcatatccatagaaacaactttcctttacttcatctaaggtgataagaattttttttctaagcaggaagaatgcttaccatattttattactagcacattttaattttttaaacatgacacttgagcatatataaaatgtagcatatttttaattggggaggtgggggaaaagttgaggaaagattatttgcatggctgaaattaatgaatttattgtttctaacaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaagttactctttggaaactgaagtcaaatgccattgaagagaattctactagaaattacttctaacaatgagatagaagcagacacactgacacatttggcaataaaaactattgtacttcttatcttgaagctaaataagttttctttgacccattaattcctctcataaagaaaaaagatatattttcaatttaaaaacatctgaacatggaatcttgatattgtggttgtatatttatagatttatattttataagtatatgagtatttatatactgtttattactctgaatctcatactgaactaaaatgtatgttttcaggggatgggttagggttttctttttcttttataacatggtgattattttgcaattaaaacttgaagggaaaatgtctagagaattactagtatactttggtttttatttttagtttttttttcagacagggtcttgctctgtcacccaggctgcattgcagtggcaaaatcacagctcactgcagcctagatttcccaggctcaagcaatcctcccatctcggcctcccaagtacctaggaccacaggcgtgcaccaccatgctagctaattttttttttttaagatggagttttgctcttgctgcccaggctggagtgcagtggcacgatctcagctcaccacaacctccacctcccggttcaagcaattctcctgcctcagccttccgagtagctgggattacaggcatgcgccatcactcccagctaattttgtatttttagtagagacagggtttctccatgttggtcaggctggtcttgaactcctgacctcaggtgatctgcccacctcagccttccaaactgttgggattacaggcatgagccactgtgcccggctgcatgccagctaattttttaatttattttttgtagcgatgggggtctcactatgttgtccaggctgatctcaaactcctggactcaagtgatcctcccacctgggcctcccagagtgcggggattacaggtgtgagccaccatgcccagccaaaattactagtacaccttgtatgatatgcctaaggaagactctattattggttttttgtttgtttgtttttcagactctagggctttaagttgaagactctattgttgtttaacattacttgagcatcaacagcattctagatatactgtggttaaagatgtagttcaggttataaaaaagccttctgaatactgcatgaagtacctgtggttatcataagaaacttcatgcatatatggcagggattggaaaatggtgatctgcaggccaaacccagtttgccaactgctttcatatggctcataagctaagaatgccttttacatttttacaccattgaaaaaaattaaaaaaatatttaggaacttatgaaaagcacatgaaattcaaatttttgtgtctgtaagtaaagttttagtaatatacagttttattagaacacagccacactcattcatttacgtattgtgtacagcccttttttcactacaagagagttgaatagttgtgacagagcccatacgtggtgtcctcattggtaagtgatacactgccaaatgatttaccacagtggaaataccattttatcttcccaccagcagtgtttgtgttccactttgaaagtgttccattttctccacattccctccaacaatttgtattgtcagtcttttaaattatagacattctaatgggtgtgtaatattacatcactaattctcatttccttaatggctaatgatattgagcatcttttcatgtgtttattaggcatttgtataccttctttggtgaaatgtgtgttaaaccctttggccaaatttttagttgggttttttgttttgttgttattgaatttcttctttttcaaaattgttttggttagtctaggcccttttactttccatataaattttagaatcagtttataagtttctacaaaaatatctgctgggattttcgttgagattgtgttgattctacagatccatttggacagaagtaacatcttaccaatattgagttttccaatccatgcacatagtatatgtctatttatgttggtattctttgatttcttttatcaggaatcaatagttttcagcatgcagtttctgtacatattttgttagatttatatttaagtactttatgtttttgaatgctgttataaatggtactgtttttaaattttaaatttaagtttaatttcaggtgttcattatgaggtttttatatgttgactttgtatcctggaacgtagccaaactgacttatcaaacctattagcttttttgtacatttcttgggattttctatgtaattatgtcatcaaggtatatagtttttttttttttttaagatagtctcactctgtgacccaggctggagtacagtggcacaatgttggctcactgcaacgtccacctcctgggttcaagcaattctcatgcctcagtcacccaagtagctgggattacaggcacatgccaccacacctggctaatttttgtatttttagtagagttggggtttcgccgtgttggccagggtggtcttgaactccagaccttgagtgatccgtccacctcggcctcttaaagtgctgggattgcaggtgtgagccactgcacctggccacatagttttatttattcctttgtagtctgtatatcttttttttttcccttgtattatcaaaccttcattacaattttgattgggagtggtgagagtgaacgatggttgggggaaacattcagtcatttacagttagcattgtgttagttgtagagttttgtaaatactatttatcagattaattaagttatttctattactagtttgctgagggtttttttaaacatcatgaatggatgttgaattttgtcaagtgctttttctgcatatagagatgatcatatggtttttctcctttagtctgttaagatggtgaattacactgattgattttcaaatgttgagccagccatgcattcccagggtaagcctcacttggtccaagaagacttactttccattaaaaatttcaaacatacacaaaggtggagaaactatttttttttattatactttaagttttagggtacatgtgcacattgtgcaggttagttacatatgtatacatgtgccgtgctggtgcgctgcaccactaactcgtcatctagcaactattaatagtacaagaatctaccctatacccatcacctagaaaaatccttgctatttatttgcatgccattctcatcagttgaattttataatgtgttttgctgatgattctaagagttggtccaggccttcctgcctattgtattctgttaaggtagatgtctctgactagtggattggaacttcctagtatatctccataccagttgccatttctaagccttttggccaccccctgccaccacccctgcccgcccctttcccttgtcactcttcgcaattctcagcactaattgtagtgtatataatttcagtactctttcccatgctttatttagtttgtttttgaacatatttttttctcatttctctccaacttgtatctcaggatccaaagaattaacaatatctcatgccaaaagcttgaggattcctactgtattgacaataacatacagaagctttgcttaaatattatgcttactttttttttttttttttttttttttttagatggaatctcactctgtcgcccaggctggagtgcagtggtgccatctcagctcactgcaacctctggctcctgggttcaagcaattatcatgactcagcctcccaagtagctgggactacaggtgcacgtcaccattcctgggtaattttttgtacttttagtagaaacggggtttcaccatgttggccaggctggcctggaactcctgacctcaggtgatccgcccgcctcggcctcccacagtattgggattacaggcatgagccaccacgcccagcctgaattgcttacccttaaacatgtttatttttactgccaggccttaatgagtcagtaatggatatgtcattttagctgagttgtattctcatttgtgtaatatacttatcattttaatgttatcttatcattaaaacaaccttatattggtggtaattctatttgctggaggttctctgtaattttgcttttatgcaatgttcattacagtaatggcgggaagttaatgccactttggaatttgatcagcttgcatcactaccagaatggttttcctatgactagttgagatccacatgcaatacattttttgacatactaccaggagcagatgttaatatcataatgaaagctttgtccaactggacatcagatttagcacaaaattcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatctgaggtggggctggtgttgagggccagaacagaagctgaaccttactaattatatagtagtgtctgtgctaattgcagtaaagctgttttaaccatttggaaactagttcatgtaattttttgccaaatgacttaggtacttattgtccactgacagctaaagtattttccaaaaccctcaactctctgtctagcaaactattgtaggtgaatatttgtctctgccaacatatccatgtataactataaaactagattctgctttgatgtttgcaaatacattcttgcttcccaaaacagcctgtttgcatcacactcatatgtaagatggctatttccgctgcatcttcccaaagttcaccactgcttaataaggtctgtttaaggtcaaacaaatgcaattgaattttgattacactgaaaatgaagaatagcagcaatataatgtgaaagcactttgtgttgtcaacagtgatttatacaaattccagtgacagatactcaagactactttccagggcacattcataatttgattgctaaaaataaaagaaaacacacttgttctgcctttttcagctctgcttctcctctttcagtcaaaagcccttatgttagtaacctttattcttttttaaaaaaatattttactaagtgtgaagtgttctggggccagagagagattttctgtgaagttaatgaagcttaagtttcagagctcctcatttgcagtgaccttcttctaagactctggaaggagtatcagcaatgtgtttatatggtcatgtgtttttgtacaatttgaaaaattaaaaaaaaatttaaccacaacccttcaaggccattgtccatttctacttcaatgactcttctgttagacctcccctttgtgttagtgtgatattggaatggccatgagctttttggggatgtgactaaggggaggttgagttggggatatgtttagtttggggttagtaggctatttggctataggtggttctttgtcacttctgtgtatagtggagtttttgctaggaattctgatatagggatggcttcttggaacacccctactactcatggggccaactcactaagcatcatgacatgaagatgcagggctcagtgtaaaactggtaaatgaatgttaccagttcaaagaatatgtaagattagtcacttcacaagtaaatttgaaatgccctgaaatcttacagctcatatatgaaagaaactcaacagttttctcaaatttgacagtagctttaaaaatgtatcaatgcctagttgttatgttgaaaggaacttttctaaactatcattaattttaaaaatttttatctagagaaaagactgaactatttttattttctttatatacaagtgattttataaagtcgtcaaatgaagcactaaagaatatacagccaaaaacataggaaaagaaactatcagagaggtatatcaggcattattaataaaaatgttattgttatggatttttatgatatttgttagctttaaaaatttataacttgtgatttaaatttttttaaattttattttgagacggaatcttgctctgtcatctgtactggaatgcgatggtgcgatctcggctcactgcaaccttcgcctcctgggttcaagtgattctcctgtctcagcctcccgagtagctggcattacaggcacgtggcatcatgcccggctaatttttgtatttttagtagagacagggtttcaccatgttggccaggctagtttcaaactcctgacctcagatgatccgccccccttcaccttccaaagtgctgggattacaggtgtgagccactgcacccggccatataacttatgatttttgttatgcgctcagaatattttcttttgtacaaaattttgtgtttatggttttttattcctttttttaaagaaggcccttcaaattgtttaagtttcagacaccacaaagtgtgaattcacctctttctagacatcatatagaaagctgtctttgcccaaacataatttatagtcagaatgtagttcaacatgatcatacataaatattgattactttttaaagaatgttaaagcttaaaatttctgcaaataattaatgggaactaggcttaatacctgggtgacagaataatctgtacaacaaacccctatgacacaagtttacctatatcacaaacctgcacatatacccctgaacttaaaagaaaagttaaaaaagaaatgtacacaaaaaagaatatttctgaatcataacttctaggattataattaagcctcaggtgcagttaatttagaaatcagatttggggagaagagtgtttcaactaagtcaaggagctcttggtagtgtttggaatgaagtaatataattgtgatattaaattgagtaaagttgttttattggaaaatgcaacagcagaacagattaattaacagaattcaaaaagagtgaatagtcaggaaatctctaattttggaataaatagaatatgactatttgcctttgcaactttagaatttaaatgcattttgggaattgtgtcctaagttatacagtaaataaatgtaattttcttgtttgtactgccagtgttaagactgtagactttaaagggattaacctgaagtttaatttaatcaccctggtggtctgttcaaaggaaaagtaaaataggcagataatgtgaagatctttctccggggttgtttggcctttttgaaagtggaagtataaaaacaaatttaattagatataagtactgaatgattccaaaggttaatgccttattaacaaattagtttgtccctgaaacttacaacactaactttttgagtgcttttcctttttaattagataaaggctatagtccattctcttaatagagactatcctttagaaaaatgaccacctcacggatcacgaggtcaggagttcgagaccagcctgaccaacatggtgaaaccctgtctgtacttgaaatacaaaaattagttgggcgtggtgtcgcgcacctgtaatcccagctactcaagaggccaaggcagaattgcttgaaccctggaggtggaggttgcagtgagccgagttcatgccactgcactccagcctgggcaacagagcgagactccaactcaaaaagtaaataaataaaataaaataaaaatgaccacatcaatgctagcagttactaaattcctcctttggatcaataaatacattccttactccccttacaattaattggtgtttttattattgaaaaagtaacacatacacagagtaaaattcctctcccaaggaaaaccagttgtcctatgtatatgtatccttccagaaagactattaatataaaacttttttttaaattattttttgagatggagtctcgctcttgtcacccaggctggagtgcagtggtgcgatctcggctcactgcaacctccgccacccgggttcaactgattctcctgcctcagcctcctgagtagctgggattacaggtgcctgtcaccatgcctggctaatttttgtacttttagtagagacgagttttgccatgttggccaggctggtctcgaactcctgaactcaggtgatccgcctgcctcggccttccaaagtgctgggcttacaggcatgagccaccgtgcccagccaaagctatttacatgtacataagtatatatacttgatgtgtgtgtgtccactttttctaaaaatggaagcatactatgcacatcattctgcaccttgcttttttttaaattagcaaatatatcttagatattgttccacatcaatatacagagccccatctaatatttttctttctatatgggactctttttttggcttcttagctttttctggcaaatgacagtgcattgaatattctgtttttcaaactggtgctctgtcaccaatactatattagagtaacataggcatttttattattataaattagtaggtaataatcatttatccatgaagatgtcgagtcagcttcaaagaggattaggtttctgatttagctgaactctattctgaggaccaaaggaaggtcaaatccaagataaaaaatttagcagtgaaggaatggtgtaaagagggactttcactatttcttttgtatatttttgtgtttaaatttttatagcgaacaatcatacatttgtcatataatgtttgaagcaaagtgaaaatacattagaaatggccaggcatagtggttcatgctgtaatcccagtactttgggaggccaaggtgggaggattgcttgagaccaggagtttgagaacagcttgggcaacatagcaagaccttgtcttttaaaaagaaagagagaaagagagagagagaatgagaatatattagaaatgagaattctgacaaagtactcagtttaaagatggtttagttcatgaaaaacaatgctacaatgtaataaaaactaacagaatgtctgcatctttttcatcttaaaacatttgatttttgaatttttagattgattttggactattatttagtgtctaaggattgtctttttctagtttataatctgatataatagttttaaagtgataacctttatttaggttactcaaataggataaatgttcatggagcttgatggcttcctcttacaatattttaattttcaatattctatattgaagcatcaaatagagtgttaccctattaatgtaaatacattatatttttcagcaaaccataatggaatttgtattgagactgtatgtattataagtgatgatctttttgtatattataaataatttttagttgattcaaaaatatattatgggtggtgaatcaaacatattagaaattcaggataattgattaatcatgtcacttttctgacttcagtctccacatctgtaaaataacagaatcctttcaagctgtgaaaaatctcttataacctttatgttgagttgttatatgaaaatgtaagaaagtaagctttaaactgtctgaagattcccacactgagcagcatgctaacctgaatttattatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaacaaacaattaaaatttggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctcaaaggccccctgccaatattattaccttgggaattagcatttcagcacatgaatttttgagggacctttccctatcaaataagaaagaatacagaagagaaaacatgtactgatgacaacctaagaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccacaaaaattaaaagaatcgatctttacaatctctgtgacagtcagcactctacaccaccattaatactatgaaggccacagagtacgtttggtatattttccttttttctctcccactactgccttcatcaaaatacagtgaatagtcctccatcttcagtctttcctatgagctatatttataatttgtaggctgttacatttattttcagaggaacttttttttttttccgagacggagtttcactctcttgtccaggctggagtgcagtggcacgacctccgcctcccgggttcaagcgattcttgtgcctcagcctcttgagtagctgggattacaggcgcccgccaccatgcccagataatttttacatttttagtagagacggggtttcaccatgttggccaggctggtctcgaactcctggccttaagtgatacacccacctcggcctcccaaagtgctgggattacaggcatgagccaccactccggcccagaggaacgattgatataatggaaaaatagttcctctgaaaataaaaataacaacattggttcctaataaaagattaagagaaaaagacaagctgtcgaaatattggagcaatgtggggaatgaggaaggtggggtagggcagagaagggaagttatttttggagcaggggttggggttagaggacatatgaaaggagagcagcacagacccggaatcagactgccgccagcactttccagctctatggagtctgcctggttttgctcatcactgtatctctagcagctagcatagtgccgggcacataatggacattcaataaatatttgttgaatacataagtacctttttttttttttgaggcgaagtcttgttttgccgcccagcctggagtgcagtggtgcaatgtcggctcactgcaacctccacctcccgaggttcttcaagtgattcttcaagtggttcttcaagtggttcttcaagtgattctcctgcctcagcctcccgagtagctgggattacaggcacccaccaccacggccagctaatttttgtatttttggtagagacgggttttcctgcattggctaggctggcctcaaactgtgacctcaagtgatccgcacacctcagcctcccaaagtgctgggattacaggtgtgagccaccacgcccagccaataagtaccattttgacttcctgcccaaagatttagcacccagagctgtactgtgaatttgtttcctttgagaccttaggtttgaaaagtctctttgctatctaacattcagaggcaaagttgagtgctgttaccccaaagagggatacttttgtttgtgctgagtgtggttggtcagcttttaaaacagaaatagaatttactaaaggaagtgttttctcatctgcagcatgcaaatagcgtagggtactttgacttctcttttgtgtagtattttatgcatagttttcttatgccttttataaataaaagataggctaaagcagttagaaagtatagcaaaccatccagtgacaaagtgatttttttttttgagacagtgtcactctgtcacccaggctggagtgcagtggcacgactttggctcactgcagccttgaccttcaggctcaggcaatcctcccacctcagccccttgagcagctgggactacaggagtgtgtcaccatgcctgggtaatttttgtattttttgtggagacagggttccaccatgttgcccagactggtctggaattcctgagctcaagctatctgcccaaccacctcagcatcccaaagtgctaggattacaggcgtgtgccacctggcctgaggaagtgatttttgcttttaaaatgagaacaatttctgattggctatgttggtaaattgacatttttggggggggtgggtgcgggggaaccaggtcttgtttaagatgtaccggatacaacgtatttaaagggcaagaatcctttacgttggtactttatcagaaaaagtatagtagtacctagagcaataccacccaagaatggtctgtgatgatggaaatactgtgtatccgccctgtctggtaggactaaccacattggccaatgaacacttgaaatgtggctagtgcaaccgaggaactgaatttttaatcttatttaatagttttttttgttttaaaaaataatcatctagtaaaatagactttttttgggtatatagttctatgaaatttttttttagttttgtgaatgttaacacatgtatagatttgtttaacaccaacacaaccaggacatagcgcagccctgttacccctaaaaaactccctcttgctaccattttccctacctctaacccctggaaaccactgttctgttctccatcttcccctttagttggaaagtttaaattatttacagtcattttcttaaccctaaaatcacctcaggggagggaaattaaagtttaaaagaggccttctttaaaaacacaaggacacaaaagccttcatttgatggtggctactcttatattgcatgtctttcaatactatatgtctcaactatacgtggtttgactattctgcatttttttttcatggaaaatgttatatagtattatccaaaaccaaatataatttatttccccacttctgttttggatcatttatgctagtgatttcctccatccctaagaaccagctagccaactagaattatcagagtcttagaaactttccatgccatgggtacatttcacattttcacccaaatacacagtcatcaattatcaagctaaaggaagaaataaaaatatgttcattaaaataagtgaaagatttaactattgtagacaatttaaagagagattttctatgctgaattacttttaattataattttgagtttttattttatagagcaaagcttttcactagaaattaataacacctatatttaactgcttttttgaatattaatatcctatggccatctcaaaaatcaataggtccagcactgaatttatcatctctcctttccctccactttaacctcttaatttcctcctgatttcctcctctctttctgatatcagttaatgacgccaccatctatctatccactggcccaagccagatacctttaagtcatcctagtcgtctcctttatcctatacatcttgttaggaggccctaccctcctgaatgtatcttggagctgcctcttttatctttgcccccagtattcatgtcttaattcagaccctctattgcactacttttgcaattgcagtagcctcctagctgatagtcctccctcctgtatcactccaccctactacactatcatcttccacactgcctccagaatgatccttctctaaaatgaaaatctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaaattaagaaaatatgatgacaagaatgagagagaaacaattatttgtggttattgatttagaaaacagaatgttttctgaagtagcccaggaataactgaattaattatatttctttttattaactagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcaggtaattatcattttttctttgattaccctaatgttcttttacttccattttgctgcttcttttggcatttatcaatgagaaatgattcataggcactgtaattccacttttgcaaatatgtcctatggaggtagccagcagtatatacaaagatgcataaggatgtttgtataattgcttatgatatttaaaaactggaaacaataactcgtggtgcaacaataaataactcatgatgaaatgctatgaagtcataaaacattatggtattaaagataattaatgccacaggaaggtgtctgaggtattttgttaaatgaaaaaaagctgaaaagctatatatacaatgtgatcaaaattttataaagaaatgtatctgaatttacgccatgtatatattgtttatgtatatgaataagattcctggtaggatatgaaccaaaattttaacagtgattatctttgggtggtaggataaatgtgatttttgtttccattgtgtttcctggttttataagttgtttttacaataagaatgtatgtatgtagctatgtatttatataatgggggaagccagtgctcttttaaaaacaaaagtagttgaaataaataataggattttaactataattttatatttaggcattcaaattaaactgactccagagctgtcccaaagttttcgtatttcctgacagctcttacctttgaactgaaacaaaaaatgtatattcaatggaatttaattatgtgaaattgttcttttgaaccagaattgaacctggccttgaattaaactggaaaatgcccaaatgaaattttttgcttgaaataacaattgaaacgttttacaaccaatttctggacaatataattaatctttgctatcctgattagaatgaaagatatcaaatagtagtattccctttttaggctcactaaatctgagtaaaaaattttactaaacacatgtctaaattgttatggtagattaatgtcagtgagagaggacttagagacataccattattaatttttagttcttaatttttctgttggtgacaaatggtagaaattatagaattctcactttttaaaattgacacatagttcacataccataaaatttgcccatttaaggtacacaacccagtggttgttagtatacttacagagttttccagccatcatcactatataattttagaactttttatcactcccaaaagaaatcacatatccattagcagtcattgcccatttctccttcccctccccaagctcctgataacaactgttctactttctgtctctgaatttgactattctagggacatcatttaagtggaatcatacaacatttgtccttttgtgcctgaattattttatttagcataatgttttcaaggtccatccatgttgtagtatgtattagaacatcattcctttttattgctgaatattattccattgtatggatatatcacatttttgttttttcattcaacagttgatgggaatttggattgtctccactctcttgcctattatgtataacactgctatgaacaatttgagttcaaatttttgtatgaacatatgtttttatttctcctgggtatatatctaggagtggaattgctgggtcacatggcagctaaactttttgagggactgccagactgtttttcaaagtagctgttccattttacattaccatctcaaattctcactctaatgtagaaaatctcaattttttgagatttttaaattagaatctggcctggtacggtagctcacaactgtaatcctagcacttttggaggctgaggcaggcagaccacttgaccccagaagttcgagaccagccttggtaacatgatgaaaccccgtccctacaaaaaatacaaaacatcagctgggcatggtgacacacacctgtagtcccagctactcagcgggctaaggtgggaggattgcttaagcccggaagtcaaggctgcagtgagccgtgatcgtgtcactgtactccagcctgggtaacagaacaagaccctgtctttaaaaaaatagattttagattagaatctaatctaaaaaattagattcttttttttttttttgagacggaatcttgttctgtcacccaggctagagtgcagtggcatgatctcagctcactgcaaccttggcctcccaggttcagacaattctcctgcctcagcctcctgagtagctgggattacaggcgcctgacaccatgcctggctaatttttgtatttttagtagagatggggtttcaccattttggtcaggctggtcttgaactcctgacctcgtgatccaccggcctttgcttcccaaagtgttgggattacaggcgtgagccaccatgcctggcctttagattcttttgctctaaaaaagagatacatagttctctattagaaaattcatacagaacactaaaatgttaaagggactctagtaccaaaagtctgaacgaagtgtaggaaatccataattgctgaaggaaataattatgaaaccagaagaaaaatttaagttggaaataagtgcagttatatcagggagccataaaaatgactaaaattggtttcagcaaaatttcattttacctatcaccacttaattttttttttctttttgagatggagtcttgctctttcacccaggctgaagtgcaatggcatgatctcggctcactgcaacctctgtgccccgggttcaagcaattctcctgcctcagcctcctgagtagctgggattacaggtgcacgccaccatgcccagctaatttttttgtatttttagtagagacagggtttcaccatgttggtcacgctggtcttgaactcctgacctcaggtgatctgcccgcctcggcctcccagaatgctgggattacaggcgtgagccactgtacctggcccacttacatttttttaaatttttgaaaatgacagtgtttgaaattatattgattcacatttcactacttcataatgttggattatttctcagagcttctattaaattaaaatactttgatatgcataatggattatgttgtcaataatgagcaccacataaattagttatatcagtatcaccaaaacaagttacttacattataatattcctatgcctcttacatataggaacacaattataatcatcttacatcacatatggtataaaactgaaatatttttcatgttcaaatgtggtatctgtcattacagtaagcaagggcatcataaactttcagattggattcaaaaacagaatttttttctattcacttgggtttatatttttgcaactcacatttttgcaagtgtggttcacagaccagcagcacctaggaccttgttagaaatcagactctggcccactgcagacccagtaaatcaaattctacattttaattttaatgagctctccaggtaatccatttgcacattaaagtttgagaacactgatctacataatgtgattcattgacctttaaattctaaattaaatctacattaactttgtttacataaacaagtccagaaatttgattgaaggcaataatatcagtcataacaacatttcgatcaacaatggaccacatagacgatggtggtcccgtaagattataatggagcatatatagaaacctcatataaggcatttgatattggcatagcagatcaagtaggagaaatgattgatattcattaatggtgctaggacatttggtgttccatctgaaaaaatatatataaatacaaatataaagagcatctagttttgtgtaagtacactctatgatgttcacacaatgatgaaattgcctaaagcatttttcagaacatatttccatcgtttaagtgactcatgactgtataatattaaatattataatttaaaatagctagcatttttttaggagaaaagccatataaatttatttgatcatagttttacatgacatgggagccttcagaatgaagacccaaagatacaggagaaactgcccatttttgtgcttagatttagcacaatatggatagctaaaatagctagcattttattattattattattattggagacagagttgcactctgttgcccaggctggagtgcaatggcgcaatctcggctcactgtaacctctgcctcccgggttcaagcaattctcctgcatcagcctcctgagttgctaggattacaggcgcatgccaccatgcccggctaatttttgtatttttagtagagacagggtttcgccttgttggccaggctggtcttgaactcctgacctcaggtgatctgcctgcctcagccttccaaaatgctaggattacaggtgtgagccacagtgcccagccaaaaaagctagcattttatgaaggtttatataacaaatgtgagcagagtaaaagcaacttttcaattaccttagctgatcaaactagtaaatggaattcaagagtacttgatcagtctctggcaccatgtatagcatctacctagtccttaggaactatgactgcagcaagttcagtaacttttttttttttgagacacaatctcgctctgttgcccaggccggagtgcagtggcacgatcacagctcactgcagccttaatttccggggcttaagcgatcttcccacctcagcctcctgagtggctgggactataggcgtgtaccaccacacccggctaatttttttctattttttgtagagatggagtctcagtttgttgcctaggctggtctcaaactcctgggctcaagcagtccacccaccttggcctcccaaagtgctgggattacatgtttgagccaccatgcctggcctcagtaacttttaacaatgtcttttacctcaacctactattgttaagggccccgggaatcaattattcaacaaatgattatcaggagccagttatatgccctgcatctgttagggcttataacatacatactaatggccatgatgggtaggtaaaaaaccttggcatagtgaatgtcaccataaaagaattgatagagcttaactacagtgacccatattatcgggacatgaagtgactgcattctgtgattctgctagagattagagtttaagatttcaccagaattgtaactacccattttttaagtgtaagtgtcagtgctgatccaggttctcacagcctacttctgccacccattctcagacagaaggattgacacattttgcctttgtatcatactagtcctaggtgagctataaatcttaaaagaggtagtgagaagccagacgcagtggcttacgcctgtaatcccacgactttgggaggccgaggcaggtggatcacctgaggtcaggagttcgagaccagcctggccaacatggtgaaaccctgtctctattaaatatacaaaaaaaattagccgggcgtggtggtgggcgcctgtaatcccagctactcggaaggctgaggcaggagaaacgcttgaacgtgggaggcgaaggttgcagtgagccgagattgcgccactgcactgcagctgggtgacaagagcgagactccatctcaaaaaaaaaaaaaaaaaaaaagaggtagtgagaaaaatgggagatgccttttatcctgactatctgtattatcgtttccttaaagtaaaaaggcatgatatatgaagtaatcactaaccaattaaagcaatctaaatacttgattaaattccttccattttgtgactttttatttttgtttgtttgtttgttttgcgaaggagtcttgctctgtcgcccaggctggagtgcagtggcacaatcttggctcactgcaacctccgcctcccgggttcaagcgattctcctgtctcagcctcccaagtagctgggataacaggctcacgccaccatgcccggctaatttttgtattttttttagtagagacggggtttcaccatgttggccaggctggtctccatctcctgatcttgtgatccacccgcctcggcctccccaagtgctgggattacaggcgtgagccaccgtgcccagccgtgactttttatttttaactaatttcaagcttacaaaaaaactgcaagaaatagtagagaattcctgtttaccaatttcatgcaggttccacagttaatattttacatcgtttatcattctctcttaatagatagatatacatttatatatatatatacacacacacatacatacatttttttctgaactatttgagagtaagctgcagacatgatgtttatgattattttaaagccatttttagattatttatgtattcttcacactacaccagaggctgaacttcacatcggttttgagtatcagactggaaattctttcttgaaatatttggaatcatttgtagttgttgcctcaagtgcaggaaaatcaattttcctttgaatttatttaaaagtttaagtagtgttgttacagcctgtagaaaaattaaaattaaaattaaaaaattaaaattcattgtgaccttttcacacccttactgtctctgtggaggatgaagaaggctttgctcttttgcttgccacactcacagagctaaaggatacaattttatggatctttatttagaggtcatgctaaggtagctaaaagggactacctcttatgacttattttaatataatactgtatttccagagtgtgaaaattacagatggtattccaggttacctctggtacctaaaataacgaaattgctctggaacaacaggtaaagtgatgaacagaaaaaactttttttttcattgtccaagttcataattaagtctcaatagtaattatgagagaatgaaggaaccttctggttggattaaaatggtggttttattcaaaaccaaagtgattttttttttggctactcagcctcctttttgtttttctttggtttttaaaaaagcataacagcagtactatttggtaaatttcacagtctgtgttctaaataaagttctcacaatctgaatcagtatctttctgaagtgattcaattaagaccagagacaggctaattaaggaacactttactattcaaagtgtcctttgctggaatcatccaaaatccaaacctcagtgtcatgtggtgttcccatgtgacagacttgtacacgtacctcctgaatctaaaataaaagttgaaattatttttttaaagtgtcctttgctatactcagacctaggctggcagcactgccatcaactcagagcttggtggaaatgcagaatctcagaccctaccttagatgtattgagtcagaacctgcattttaacaagctcccccaggtgattgtgtatgcattcagatttaagaggcattaatatacttatttgagaagtctacattattctgtagggaagtggtcaggcttttgttaaagtttcttccaaacttgctcatcttcaacatcctgaaaaccagctcttctgtgcaggggttcctttgtctgctagctaaatagacatgagctggtattttgtccaaggacaagaatgaacaaattagatagactagtggaaatttgctcttttcttccttttctctacaggggaggagaaaatctttggcttttttttttttcaggtgcagggatgtgttagaataatttctcctttcttgggaggtaactaatactgcagtggataaactaaaacaaaatagcagaatttcagagacttcaggggagcttctgggatgatatgagcttccacagtccataaagattctctgaatactccattgtgcaaaatagactttttgctgacttattccttgcctcttcttccactgtccacagacatattaaaatttaaaaatattatatatgtatgttaaaaattcaaacaatatagaagtatagatagaggaaatttattcatctgtctgtcattctattcctgccttaaccctattccccagaagtagccactgttaatagtttggtatgtaacccccccgcccagctttcttatgcatgttctcatctatgcatacactaaaattaaaaaaaaaaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctgcctcagcctcccaagtagatgggactacaggcatgcaccaccacgcccagctaatttttgtatttttagtagagatggggtttcaccatgttggccaggctgatctcaaactcctggcatcaggtgatccacccaccttggcctcccaaagtgccaggattacaggcgtgagccaccacacacggcccataaattttcttctaaagctatgcctaaaactgacaaatagaatatttaagaatttcattattactatacccagaccaagcaccagaccaaaaacaagtttgtttagaattatatttttctctttgcttgtggtaaaaatgttcacaagttacttaatattgtatacaagtgttaattttaggttacacaatcttagaaaatgtataccacagttttttaaattcagtcacactcagatgttttagcttattaatttgcactcatatttatagacttcccagtatagcacagtagatttgttaaccataaagatatgtgatgatggccaggcacggtgactcacacctgtaatcccagcactttgggaggccgaggtgggcggatcgcctgaggtcaggagttcaagaccagccgggccaacatggtgaaaccccatctctactaaaaatacaaaaattagctgggtgtagtggcgcatgcctggagtcccagctacttgggaggctgaggcaggagaatctcttgaacctgagaggcggaggttgcagtgagctgagatcgtgccagccactgcactccagcctgtgcaacagggcaagactccatctccaaaaaaaaaaaaaaaaagatatgtgatgaggtttcatgagatcaaagtcataaatttggtactttggctgccctacccctaggtgtcttaatgatacatatggttagtcacagagctaaataaagaagtatggactagtataagcttatccccaccattgagaaaattactcaaaatgtatgtagtaatcacctcacctcatatattaagggcagaacattattataataaaatgtatggtatacggagtcatcttcagttcaatattaccttgtctgcattctatgatttctgcttcagtttagcctccattatttctaactggaatgcactcaaggctaaagcttctattattctttttttagattaattaaaaaagaaaaggagggaggttgccaagcaaatgaaaatgaaaagaagcattcaaggtttctatttaatttaagaaccaactattttggggcaattcagaaatagctttcttcatgagacaagcaatgcctatgccagttacaattttttttaagtctgttaagctgatttttccaattacttccatattatcccctttacaacctcttagcccagttagaaataactttagcctagctggagtcactacattcattttgtttttaactaagtagcattggtcttctctcaatttagtctgcaacatacatatatatttatatatattttataatatatgttatatataaatatataaatgtatattaatataatatataaatatatatgtaatttatattttgagacaaatcgcactctgttgcccaggctggagtgcagtaggaccatctcagctcactgcagcgtctacctcctgggttcaagcgattttcctgccttagcctccctagtagctgggactacaggtgtatgccaccatgcctggctaatttttgtatttttagtagagacagagtttcaccatgttggccaggctggtcttgaactcctgacctcaagtgatccacccatctgagcctcccaaagtgctaggattacaggcatgggccaccacacctggccctgcgttatatttttaaaaaatgaacagaaagagttcttattatagtttgaagagtttttttaaattatctgcaatttacataagtattgaacttatgtttttgacatttgaaaaatcaaattttcccttctatttctgtttgcccatagattacattcagctgaagcaaaaagattttttcctactttctctatacctttcctatattactgacactttcccattaactgatcacctgaattgtttgataccaacaaagcccaaaatgtaagcactttatatagaaaaattagattatattaggtattttttctttttttcactgtgtatacgtttatctacttttttaatttttaatttttgtgagtatataataggtatatatatttataggttacatgagatgttttgatacaaacatgcaatgcataataatcacatcatggaaaatggggtatccatctcttcaagcatttatccttgtgttataaacaattcaattatattctgttacttttaaatgtacaattaaattatgattgactatagtcacactgttgtgccatcaaatactaggtcctattcattctttttatttgtacccattaaccatccccacttccccttacaacccccactatcctgtttacttatttaaagctattaaattaatatttaatcattttttctttttttatcaaacctcagacttgacctatggactgttgatccccattccctgtcaggtagccatcaaatgccacagaatcctagaaagaacttctatttttgctatgtagaattaattttcttcctggcaatgacagcaatagctggcctagaaaagtggaatggttgttaaaaaaaaaaaggtttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccaggatgtattatttacttaagcaaaacaagttgcagtgtaatacttatggcataatctcatttagtaaaaaatgcaaaactacatgtatgtgtacttacatatgtatataaacacctagagaaaggactagtatatacacatgattaacactgtttatctcaggaagagagcgggattgagggagaagatcaaagagaaacttgcatcttttcaacattgaaatttttacagctagaatgtatttaaatttatttgtataacttaaaaaattaaaacaaaaaatcttgtaccaaaataagttccagtttaagcaaaaattcaaatgtaggctgggtgtggtggctcacgcctgtaatctcagcattttgggaggccgaggtgggaggatcacttgagcccaggagttcacgaccagcccaggcaacaggtgaaaccccgcctctacaaaaagtaaaaatttaggccagtcatggtggctcacgcctgtaatcccagcactttgggaggccgaggtgggtagatcacttgaggtcaggagttcaagaccagcctgaccaacatggtgaaaccccgtgtctactaaaaatacaaaaattagctgggtgtggtggcatgcgcctgtaatcccagctactcgggaggctgaggcatgagaattgtttgaacctgggaggcagaggttgcactgagccaagactgcgccactgcactccagcctgggcgacacagtgagattccatctcaaaaaataaaaaaataaaaataaaaataaaaaatttaaaaagtaaatatttagccaggtgtggtggtgtgcatctgtagtcccagctacttgggaggctgaggtgggaggattgcttgagcctgggaggttgaggctgcagtgagctgtgttcatgccactgcattccagcctaggtgacagagtgagacattgcctgcctcccaaaattgaatgtaaacaatgaaaccatgaaattactagaagaaatatttggagcattttttttcaatattatgaaactttcggacatacagaaaagtcagaagaattgtacagtagatatcctatatacaccagctagattctacaattaatactttactatatttgctttatcatacatcaatccatcaatacatcactgaaataattttagactcacaagtaagtaaaaaaaagtacagaaaatttccatgtagccttcatctagcttttcccaatgataacatctaattcatttataaaacaatattggaggctgggtgcggtggctcatgcctgtaatcccagcactttgggaggctgaggtgggtggatcacctgaagtcaggagttcaagaccaccctcgccaacatggtgaaaccccgtctctactaaaaatacaaaaaattagccgggcgtggtggcacgcgcctgtaatcccagatactcgggaagctgaggcaggagaatcacttgaacccgggaggtggaggttgtagtgagccaagatcacgccattgcactccaacctgggcaacaacagtgaaactccatctcaaaaaaaaaaaaaaaaaaaaaaagaaaaaaaaagaagaaaaaaacaatattggatttggaagcgtttttctaaaatatgatacaaaaccaataaaagaaaagattaatagattgatgaattcagatacctaaacatttcttcttgggatgaagacaccaaatggaaagtcaaaaggcaattaaaataattataattcatatcatagatgaaggttaattttttcatatacgaagaacttttatacatcaataagacaagcgtcagcaccccaaaatttcttttctatgataaaggatatgaactgacagttcacagaaaagcaaaaacaatacctcttaaacatgaaaagatgttcaacttcattcgtaatgagtaaagcaaattaaaatggcactgaaataccattttcacttattggattggtaaagttaacaattttgttaacactatgtttctgatctctcatgtattgctggtggtgtgtacattgatacaagatgccaacagaggaatttggcaatatctgtcaaaggtgaaattgcacatagcctttgcctcagaagttccacttgtaggaatttatccaacagacatttttgcatatgtatgaaatgacatgtatgcaaagatgttcattatagtattgtttacaatagcaaaatatgaggaaaaactaaatttcagtcattagggactaaaattatgatacaatcatatcatgggatactgagtagctattaaaaacaatgaaaaagaatgagtaggtttttatatgtttttaaggattaaaaaataatagcttttttgaaataccataaaactcacctttttaaagtgtacaacccagtggtttttagtatattcacagacttgtgcaactatcactactatctgatttcaaaacattttcatccccattaaaataaaactcattagtagtcattctttagtcctaatctcttacctgtactggttctactctctctaccctaggcaaccactaatctactttgtatttgtatagatttgcctattctggacatttcatataaatggaataatataatatgtggtcctttgtaaccggcttcttttatttaccatagtgtattcatggttgatccatgttgtagcatgtatcattactgcattcctttttattgccaaataatattccaatgtatgaatatactacattttgttgatttagtcatcagttgatggacaattgggttgtttccactttatgaatattgctgctattataaataatgctgctatgaacattcatatacaagtttttgtgtgaacttatgtttttaattcccttggggatatacctagaagtggaattactaagtcatctagtaactctatatttaaccttttaagggactgccagactgttttctaaagcagctgtaccatttcatatccccaccaacattgtattgacgttccaattgttccatatgcatgtcaacacttgctattacctttttattatagctatcccagtggaagtgaactggtatctcattttggtttgatttgcatttccctgatgactaataatgttgagtatcttttcttgtgcttattggcctttcataaatgttctttggagaaacaattcgaatttttaccttttttttttttgagacggagtctcgctctgtcgcccaggctggagtgcagtggcgcgatcttggctcactgcaagccccgcctcccaggttcacaccattctcctgcctcagcctaccgagtagctgggactacaggcgtctgccaccatgcccggctaattttttgtatttgtagtagagatggggttttactgtgttagccaggatggtctcgatctcctgacctcgtgatccgcccacctcggcctcccaaagtgctgggattacaggcgtgagccaccgcgcccgaccatttttgcccatttttaattggattgtttgtctttttattactgagttgtaagaattctttatatattctagatacaagtcccttatctgatatatgattttaaaatattttctcccattctggtattgcctcttcgttggcggtgttgtttagagcacagaagttttctgggtacagcataggtgcatgtgcctgtatttatgaggtatatgagacgttttgatacaggcatgcaatgagtaacaaacacatcatataacatggggtatccatcccctcaagcatttatactttgtgttacagataatccatttatactcttttagttatttttaaatgtatgattaagttattattgactatagtcatcctgttctgctatgaaatactatgtcttattcattctattttttgtactccatgttgttttcttgaataaatgcttcctagattgctgcaagcttttgtttgatttccagatttctggaaaaagatggttcttacaatttctgccagttttctcattgcttttacagaggagagaattttagaggtcttactgcaccatttgcactgatataccttcagcagatattcttgaataaatccttcttaatttgtggtatgccctttggtcaatttccagagtatttcaatggctgttttttgatacttttgtcagttttatcattgctttttgaggaaaggatttgctgagctcctcacgcagtcattctagaagtcatgcccatccattttataatttaacgcccagctaaactataaccccactcaagatatagggaaagatacatttttagacatacaaagtcaaaacacttttgccatccattaatttcactgaaagctatactagtgattatatacttcagcaggatgaaaaaaaaatccagcgggaagcaagactggatacaagaaacaataataaatgtcaaatcctctatcactgagtagtagtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctcttaaaaaaaaaaaaaaaaaaaaggaagaaatatctgattttccttgtattatggaatatccattggatcatagatgatagccccacaggcttgtgcagcaatttgaatacctccctctgcatgtacatctattgaaatacaaacacgattgttttggcttaatctccctttagtgtttatggattagctaaaagccaaagaaagtgactattgatactttaagttattgagatatatatgtgaatttcagcattttttaaaattcaatgattatcattcctatattgcagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaaggtaaagtaagaaagggtgacatttgttaaaatgttgggtggataaatgaccttagtattttttaggccaatcattggaaatacatgcttttatgtagttaaccatttactgaaagacgtattttcattttggcaatattttaagttaaatatcagtttagaagatttaccaaatatggaattaatactgtagatagtacagtatgtctgtttattttaagagagacaaatgagaaatacttatcacttatttacttacattattaattgaaaaattgacatgaccacatggtttaaaataatgatagaaaaaattcacccatattcccttgctataatgtaaatcattttctaattccattctacatacctttctacttaacagagttgcaaatgtagtattcatactactttgtacccttaacactataaagtttttcaccatttttgcagtctagattattatctaatatttctgactaagtctgtcacatcagtttgctttaatttaataaaccattcaggtgtttttcaccattagattgtttctaattttttatttttagataatcctgcattgaacatactcatgtctaatagtcatttccattgagctaatatcttagaagacattacaaaggatgtgtttactgggttaaagggcataaatatttctctggttcatggtacaagttgtaacagtttttgccagcaggggtatgtcagtgaagtatttttactacaacttcaccagcattgcatcccccccacaaattctttctaagttaatagacattaaatggtattacagggtaactttagtttgtgtttcttccattaatggtggggataaacattttttcatcatcggatgtttatatttccttttgaatgatttgcttatatatgtcctttgcctgtgtgtttattgggttcatgtttttcttattaatttatataatttcttcataaattatacctaataatacttttaaaatattttgtgtacttttaggctgggcgcggtggctcatgcctgtaatcccagcgctttgggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatattgttttacggctaaatattctgtgttatctctaaaaaaggatatattctgatataactatactaccgtactgtacctaacaaaatgaacattaattccttaatgtcacctaagacccaattcatattcacatttctcctgttgtctccaaaatgttttaagtctctttgcctgaaatagaattcaaacaagatccatgcatcatagcatttgactatcatatggcttatgttcttttaatctaaaacagcgcctctcttctttctcctcattgtccttccttccctcctccccacaaaacaattgacttgaagaaatagccatcagttgttctgtagaatatcccacaatgtgaatttatcctttgtttccttttggtttcatttaacttgttctataactcctatgttacttgtaaattggaagataaagctaaagacttgattatatttcattcttttgtatttctcatttttatactaataaaattgtttaggcaaagttacataataaagaaatttttagttaaatgaaacccattacattattttttaaaactttcatttttaatttaatgactgttcaaaaaaatagagtgcctactttgtgctagctactgtgctgttcactaacagtaagcaagactgacatactagttcctagtttaaatgttggttctagcttccattggcagtaattatggagccacaagcttgacgtgaactaaagagcttacatggagaggtcagggtaggaagcatattatcatggtgctttttatgttaacttatatccagtgaagaacaagtggatgtggaacttgtacaacgtggagatatcattaaagtagttccaggaggcaaatttccagtggatggtcgtgttattgaaggacattctatggtagatgagtccctcatcacaggtatgttctttcaaaggatcatgaccaaaatgttaagaaaaatagacatgaaagatgaagcactttttgtagaagctatgaataactaaattatgaacagagagaataagttcttttaagactgtattaaatcaatttcctcagatttactttgtggctttagttatgctattagtccattttcacattgctataaagaaatacctgaaactgggtaatttataaagccaagagatttaattgactcacagttctgcatgtctggggaggcctcaggaaacttgtaatcatggtggaggagaaggggaagcaaggaccttcttcacaaggcagcaggagagagaagtgctagcaggggaaataccagatgcttataaaaccataaggtctcatgagaactcactcactatcatgacaacagcataggggaaaccgcccccatgattcaatcacctcccctcctcgacatgtggggattacaatttgagatgagatttgggtggggacacagagccaaaccatatcatcccacccttgacccctcccaaatgtcatgtcttttcacatttcaacaccaatcatgccttcccaacagtcccccaaagtcttatttcagcattaactcaaaagtccacaatctaaagtctcatctgagacaagacaagtcccttccacctatgaggctgtaaaatcaaaaacgagttccttccaagatacagtgggggtgcaggcattggataaatgctcccattccaaatgggagaaattggccaaaacaaagggactacaggccccatgcaagtccaaaatccgttggggcagtcattaaatcttaaagctccaaaatgatttcctttgacttcatgtctcacatccaggtcatgctgatgcaagaagtgggctcccaaggtcttgggcagatccacccctgtggctttgcagggtacagcccctgccactggctgctttcactggctggtgttgagtgtctgtggcttttctaggtatacagtacaagctgttggtggatctctaccattctgtggtctggaggatagtggccctcttctcacagctccactaggcagtgccccattggggactctgtgtgggggctctaaacttatatttcccttctgcactgccctagcagaggttttccatgatggcttctcccctgcagcagacttctgcctgggcatccaggcatttccatacatcctctgaaatctaggcagaggttcccaaacctccgttcttgacttctgtgcacctgcaggcccaacaccacgtggaagctgccaaggcttggggcttgcaccctctgaagcaatggcctgagttgtaccttgaccccttttagccatgactggagctgaagctgctgggatgcaggatacgatgccactgaggctgcaaagagcatcagaggccctggttcccagcccacaaaatcattttttctcctaggcctcagggcctttgatgggaggggctgctgccaagatctctgacatgtcctggagatgttttccccattgtcttggcgattaacatttggctcctcgttacttatgcaaatttctgcagcccgcttgaatttctccccagaaaatgggtttttcttttctattgcattgtcaggctgtgaattttccaagcctttatgctctgcttcctttttaaacataagttccaatttcaaaccatctctttgtgaacacataaaactgaatgctttcagaataatgtaggtcatgtcttgaatgctttgctgcttaaaaaatttcttctgccaggtatcataaatcatctctctcaagctcactattccacagatctctagggtgggggaaaaatgccatccgtctcttttcttgtttctttttttttttttttttttttttttttttgagacggagtctcgctctgtcgcccaggctggagtgcagtggcacaatctcggctcactgcaagctctgcctcccggttcaccccattctcctgcctcagccgctggagtagctgggactacaggcacccgccaccacgcctggctaattttttgtattttttattagagacggggtttcaccatgttagccaggatggtctcaatctcctgacctcgtgatcagccggcctcggcctcccaaagtgctgggattacaggcgtgagccaccgcgcccggccaccacccatctcttttctaaagcatagcatgagggacctttactccagttccccataagttcctcatctccatctgagaccacctcagcttggacttcattgttcacatcactgtcagcattttgatcaaaaccattcaacaagtttggctgggcgcagtggctcatgcctgtaatcccagcactttgggaggctgaggctggtggatcgcttaaggtctggagtttgagaccagcctgaccaacatggtgaaaccccgtctctactaaaaatataaaattagccaggtgtggtggagcatgcctgtaatcctagctacttgggaggctgaggcagaagaatcacttgaactcaagaagcagaggttgcagtgagccgagattgcaccattgcactccagcctgggcaagaagtgcgaaactctgttacaaaaacaaaaaacaaaaaaacctaacaccattcaacagatttctatgaagttccaaactttcccacattttcctgtctttttctgagccctccaaactgttccagcctctgcccattacccagttccaaagtcgcttccgcattttcaagtatctttatagcagtgtcctactccctgtggtaacaacttactcaatttactacattagtcagttttcacactgctctaaagacatacccaacgctgggtaatttatgaaggaaggagatttaattgattcacagttctgcatgactgggaaggcctcaggaaacttaaaatcttggcagaaggtgaagggggcaaggaccttcttcataaggcaacagtagagagaagtgccagcaggggaaatgccagacacttataaaaccatcagatctcgtgaaaactcactcatcacaagaacagcataggggaaatgcccccacatgactcaatcacctccctcccttggcatgtggggattataggtccctccctcaacatgtggggattacaattagagatgaaacttgggtggggacacagagccaaaccgtatcaactattgaagacttttatcactggagattattagctgctagaatgcataaccaaaggaagttgtctcagtttcctgtagacttgatggactttggcaaattttcctgggcaaatacctattctgcccttcctgctgtaaagactggtctaatctgagctatgacacgagtccaggttttccacatcagggtctactctaagggaataggcctggcatagttttagaaattttaggtaactaaggccaatctgaggcagaatcaaaatgatacctttccaatctcaactctctgatagtcctagaagaagctcagtttatgaaccatgtggaaataatttaggactgtgtgtttctttctttctttcttttttgtttttttgttgttgttgttgttgagacaaggtcttaccctgtcacccaagctggagtgcaatggcacaatcttgactcatggcaacctctgcctcccaggctcaaacaatcctcccacctcagcctcccacgtacctgggactacaggcgcatgccaccatgcctggctaacttttgtatttttttgtagagatcgagttttgccatgttgcccagtctcgaactcctgagctcaagccatctgtctgcctcagcctcccaaagtgctaggattacaggcatgagccgctgtgcccaacaagactgtgtgtttctcaataggggtgctattgccagtttggatggggcaattcttagttctcggggactctcttacatactgtagtacaattcagtgcccctgaccctggcactggcacactaaatcgaagtagtagcacccccttccccatcccgtgcagtcattattacaaacgaaaactccctcccacatttctaaatgttccttgagaacaggttaagaaccaatgttctaggactagggtgaaactctaaaagtatctgccaacaagagctaccatacaggtttttccagttcaaggtttatattcctggcattggcctagaactgatataaggaaaaagggaaagcaactttcacctaggcatttgttcagattctattttatatctagatatttttgacaagtaacaaataatgatatgtttcatgatagtgatcatttatgctccttaaatctatctttactctccatacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggtaacttaactccctaggagaaacacaaactattttctttaaagccttctcagtataaatcttcacctagtttttacgttttccaataaaaattttagttgcattaatatggagttcgtttgtttttgttttgagatagggtctcactctgttgcacaggctggagtgcagtggcaccatcatggctcactgcacccttgacctcctaagttcaagcgatccttctgcctcagcctcccgagtagctgggactgtgtgtgggcacatgccaccacacccagctaattaaaaaaatttttttttatagaaacagggtctccctaagttgcccaggatggtctcgaactcctggactcaagctatcatcctgccttagtctctcaaagtgttgggattacaggtgtgagccaccacacctggccattaacatgaagtttgttaaaatatttctatttgtgctaactactaaatatactctgcattcagtatcagaaaagactttgatatgcttcttcttcttattattgttgttatttttaattctaggctcctatccagcagtttgcagacaaactcagtggctattttgttccttttattgtttttgtttccattgccaccctcttggtatggattgtaattggatttctgaattttgaaattgtggaaacctactttcctgtaagtgacttgtaataactcgttactatatgcagaacaatttgtgagtcttttgcattagtaattcattggaaataactttaataattaccaggatctttaaaggtttggagtgggagagtgataagaataatatttgcatttttataaatataaaaaatttccttttggaaaaaaaattttattatgactggtgattttccaaaagcaaataccaaacttttacatgttatgcttagtctcatttctgacatggttttgctttcacagaggactatagatatattgaggaaaacctcaggatttcagctctgtcatttactgtcaatatgatcttagactacttaattgctctctgagcttcagtttcctcaactataaagtgaggttttaataatacccattttgtgtaacttaaggttgttgtgaaggttaaataatatattagaaataatttgtaacttattaaatgctttacaaatataagatattattagtgtctactcatctagttctctgatgctgtctatggtgttgtaaagtggtaaagcagaactggactgtgcctcaaattagatatataaactttaagtcatgtaagttttactatcctcagttctcttatctgtaaaatagggaaaatagtacctaagatacaggattggaattagtataggtgaaagcatctaacatattgacagatgcaggtgacagccaagggtccccctgcgaaacccctgaaggttgaaaactttcaagcctaaaacatcctgaaggttgaaaaaccggactgctggtcccagatgaagcctgccctactcccctacccccgactgattctttctaaataatgtccacctacgcactgggaggatggggtggggcccctggaagttcaccccgtttgtatagggaaggagtctggactgacctgttcctgggtggtacctggggttcagtcggtgaggtggagagcctgttaacaggactcaatctcattttgttgagttgtttttcctttttcctttttggccaataaattcctttcccctcgcccttcaaagtgtctgcagacctaatcttttcctggtcgtgtgacaagaatctgttctttttctataacaacatgtatacatatgtgaagtttatggaagcataagcctagaaatctatgaaagccccttccagctgtgtttctatatagatctataattcttggatgaatatttaagtatttgagaacttaacctaacactgtaaaactgttactgataagagctgcagtgagccatgatggcactaatgtactccagcctgggcaacagagcgagactcctactcaaagtaaataaagtcttactttgttgtatttatttattttattttttattcaggaggtacatgtgcatgtttgtttgtttgtttgtttatttatttatttatttatttatttattgcgacagagtcttgctctgttgcccaggctggagtgcagtggcacgatctcggctcactgcaacttccacctcccaggttcaagtgattctcatgcctcagcctcctgagtagcggggattacaggcttatgtcaccatgcccggctaatttttgtatttttagtagagatggggtttcgccatgttggtcaggctggtctcaaattcctgacctcaggtgatccacctgcctcggcctcccaaagtgctgggataacaggcatgagccactgtgcccggcccgtggatatattgtttattacatgggtatattgggtgatgctggggtttaggcttatagtgaccccatctcccaaacagtgaacatagtactcaataagtagtttttcatcccttgcccccctcccttcttctcaccttttggaggccccactgctcattgatttcatctttatgtccatgtgtagccattgtttagctcctgcttataagtgagaacatgtagtatttgattttctgtccctacgttaactcacttaggataatggcctccagcttcacctatgctactcaaaggacatgatttctttttttatggctgcatagtattccatggtgtatatgtactacatttcctttatccagtccaccattgatgggcacctgggtgactccatgtctttgctattgtgaagagtgctgtgataaacacacacatgcagttgtcttttgataaaacaatttaaaataaatataagaaaatcctttgggtagatatccagtagtgggattgctgggttaaatggtagttatattttaagttcttggagaaatctccagactgttttccgtagaggttgaactgatttacattcccaccaacagtatataagtgttcccttttctctgcatcgttgccaacatctgttattttttgatttttttaattatagccattctgactggtgtgaaggggtatttcattgtggttttaagttgcatttccctgatgattagtgatgttgagtattttttcatgtgtttttttttatcacttgtatgtcttcttttgagaggtgtctatttatgccctttgcccacttttaaatagggttgttttatccttgttgatttaagtttcatatagagtctagatattagtcctttgttggatgcatactttgcaaatattttctcccattctgtaggttctgtgtttattctgttgattgtttcttttgttgtgcagaagctctttcgtttaattaaatctcctttattaatttttggttttgttgcaattgtttttgaggtcttagtcataaattctttccctaggataatgtctagaagagtttttcccaggttttcttggggtttttatagtttgaggttttacatctaagtcttcaatctatcctgagttaatttttttatatggtgagagatatgagtccagtttcattcttctgcatatggctagctagttttcccagcaccatatattgaatagggtgtcctttccccattgtttgtttttgtcaactttgttgaagaccagttggttgtaggtgtgggctttatttctgggttctctattttgttcagttgatctacgtgtctatttttgtatcaataccacgctgttttgattactatagtcttttagtataatttgaagtcgggtaatgtgatgcctctagttttattctttttgcttaggattgcttcggctatttaggttctttttccatatgaaatttaggattgctttttaaattctgtgacagagaacattagtagttttataggaattgtgttgaatctatagattgctttggacagtatggtagataggattagggttagacatggagagaagatcatctcctgccacacccttcccccacacctacagtgctgcggatgcagcagtgctatttcccaccaggggccagctagcgcacacttggacaaagcatatttcatgcttttcatggtggctccacccctactgcaagtgagtcacgtgccgcttgggttttttccaagggcgaggctcaactccctctcccgacagagtggcactgtcccagcaaggagggacagacaaatcactgagttgcctgctttggtctgggggaaaagactaacccaaacccattttagtggtagctatcagaggggcatactcatgggaaccaaaggacaaagtccttatgaaatgaaggtcaggagccctataacaagggcacaaaagagaagctgatcatgttcttgctggcacaggatcaggagtgcgagtgcaccctaatataatctcttcccaccacccctgcatcagggcaggtgcttctacctggcaccaacctacctgctgtctcttactcttgagtgccatctactggtgtgtatcctgaactgcatcataaaatttaaaatctgctaacagaagggcttagttctagcccttaagataagtccacagggacctctgcaccctaaaccctataggagattgttagctctaatggctaatacctcactacaaaaagcagcatctgagaaagctatggcatagaagctatccacaaccaagtaatctgtacagcaccttggacccctgaaagcaccaaaaacaaagctaaatgatcacacacaacatgcaccacagtaaagcacccaagggaaaaaaaagaaggaaagaaaacgtcccttggaaatgatagcaaattcaaaaacaggaagcaaaagttcccttggatgggaaagaatcagtgcaagaactctagcagtacaaaaagtgttttcacaccgccaaacgattgtaatagctctctagcaacggatcctaagcagacagataagtaatttaaaatatggattgcaaggaaacctcaatgagatccaaatgaaagttggaatccaatgtaaagaaaccagaaaaacgattcaggatatgcaagacgaggtagccatattaagaaaaaaaacaaatggaactgctggaactgaaaaattcagtaaagaaatttcaaatccagagaactcctgcaagacactatacaagatgaccatcctcagggcacacaggcattagaatatccaaagtcaatgcaaaagaaaaatatcttaaaggcagctacagaaaagggccaaattacctacagagcaaaacccatcaggctaacagcagacttctcagtggaaatgttacaagctggaagtgattgagagcctatttttagtttccctaaagaaaaaaaaaactggcaaccaggaatttcatatcctgccaaattaagcttcatacatgaagtagaaacaaagtcttcctcagacaagcaaacagtaaggaaattcatcaccaccagaccagagctataagaaatgttcagagaagttctgaacatggaaacaaaagaatgatacttgctaccacaaaaacatatataaatacaaagctcacagaccctataaagcaattacacaattgagactacaaagaaactagcaaacactaccataaggaacaaaaactcatatatcaatattaaacttgaatgtaaatggcctaaatactccacttaaaagacatagagtggcaaattggaataaaaaaacaagatccatccttttgctgtcatcaagagacccatctcaaaggtaataactcataggttgaaggtgaagggatggagaaagatctatcatgcaaatggaaaacaaagagcaggggttgctattcttgtattacataaaacagagtttaaatcaacaatagttttaaaaaaaggcaaagaagggcactacaaaatgataaagatctcaattcaacaagaagatttaactatcttaaatacatatgcacccaacattggagcatccagatttataaaacaaatactgctagacctacaaaaagaggtagactgccatacaataatagtggaggacttcagtaccccactgacagcactagagagatcatcaaggacaaaaattagcaaagaaactctgcacttaaattggattctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaaccctatctctactaaaaaatacaaaaattagccaggcatggtggcacgcacctgtaatcccagctacttgcgagactgagggaagagaattgctcgaacccaggaggtgtaggtttcactgagcctagatcacgccattgaactgccgcctgggcaacaagaacaaaactccgtctcaaaaaaaaaaaaaaaatctctgttcctgatgacatgattctatacctagaaaaccataaagatttctccaaaagactcccagaccagataaactacttcagtaaagtttcagggtataaaatcaacatgcaaaaattattagcatttctatacaccagcaacgtccaactcgagaactaaatcaagaactcaatcccatttacaataatcacacacaaaacatacctaggaatacatttaaccaaggaggtgaaagatctctacagagagaagcataaaacactgatgaaagaaactgaagaagacacaaacaaatggaaaaacattccatgcccatggattggaagcattaatattaaaactaccatactgtccaaagcaatctatagattcaacacaattcctataaaactaatgtcctctgtcacagaattaaaaaagcaatcctaaaattcatatggaaaaagaacctaaatagccaaagccatcctaagcaaaaagaataaaactagaggcatcacattacctgacttcaaattatactgcaaggctatagtaatcaaaagcatggtattgatacaaaaatagacatgtagatcaattgaacaaaatagagaacccagaaataaaaccacacacctacaaccaactgatcttcaacaaagttgaccaaaacaagcaatggggaaaggacaccctattcaatatatgatattattatatgggattacagacatgagccactgtgtccagcccactactgtaatattaaaaagtttctttaagtgattcatgtctgtttagtacacactgaacaaaaggattgttgggaagtttttttggtatttatttatttatttatttatttatttatttatttatttatttttgagacagggtctcgctctgttgcccaggcaggaatgcagtggtgcaatcatggctcactgcagcctcaaacttctgggcttaagcgattctcttaccttagcctcccgagtagctgcaactgcaggcatgcaccaccatccctggctaattttttttttttttttgagaccgagtttcgctcttgtcacccaggctggagtgcaatggcatgatctcggctcactgcaacctctgccttccaggttcaagcaattcttgtgcctcagcctcccaagtagctgggattacaggcatgtgccaccatgcccagctaatttttgcatttttaatagagacggggtttcaccatgttggccaggcaggtctcggactcctgacctcaggtgatccacctgccttggcctcccaaagtgctgggattacaggcgtgagccactgtgcccggccatacctggctaatttttcacaaattttttttgtagagatgaggtcttaccatgttgcccagggtggtctcaaactcctggcctcaaatgatcctcctgccttagcctccaaaagtactgggattacagatgtgagcccgtgcacagaccagcaagtagcttggaatgtgtttccttcaggaatttttctcatgagttcaggatgtcttagatttcttctaaaactaccaattatatttttcccacatgagcaaacactgaacgtcactaagagcttaattagcagatatacttggttcacattgttatgtccaaaaggattttgttgaaatatgactaaggtccctttgcatgccatgtgattctttttcattgtctttcaagaatagtgtgaaaggcagaattatggttttactctacagagattgagaattctgtttattcagtatcaaattttttgaaaattatgtctcacatttgcagctatttctgaaaatttctaataaaaacattcattctcaatatggagcacttatattcagtccatagtttgtaattctggaatctcagtatgtcccaatttcttatattcataaaagaaagaaagtgttttcttacctgtaactaaaaaatatatgtaggtagctaggtaggatatgtcactttttaaattgtggttttatttaaatagtgttaagttttgtgtcttttgttttgtacagctctaaatcaataaccaaaatttatgcctttcttctaaagggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaagacagtccccagaactaaaacctgtaccaccaaactatcaatagcacccctcacatgtgagaaacacatactcctaaattatttctctgtggtccatgagctgagctgcttctaggactatccagagatttgaggtaggaaaggtgttattttggttctgcttcagattggcctttgttacctaagattcctaaaactactccaggcctatttattagagcagaccctaatgtggaaaacctggactcctatcctagctcagactagactagtctttgtggcagaaagacagaataggtgtttgcccaggaaaatttgccaaactccagcagccttctaacctatttgtgtgtgacttgttttcttcactgggaccttcaattgcagtgccgtttctttgcctttgctgccaccagccgacagtttgcagctatgactttaggaatataatcctatctctgatctcatattaggatttccataatcatctcaaagctacttgacttcaactaaaaccatgtttctactagtatgttcttattatgaggatgtaagctatgtacagaggtatatagtaaacatagaacatatcttagaacaaatctggaaactcacctcgccagagaatacaggctagtaatttttatagacattttaaactttgatataatttcaaacttaaaagtcgcaagactagcctggcacagtggctcacgcctgtaatcccagcactttgggaggctgaggcaggcggaccacgaggtcaggagtttgagaccagcctgaccaacatggtgaaaccccgtctctactaaaaatacaaaaattagctgggcgagttggcacacctgtaatcccaactactcaggagactgaggcaggagaatcgcttgagcccggagggcaggggttgcagtgagctgggatcgcgccactgcactccagcttgggcgactgagcaagactccatctcaaaaaaaaaaaaaaatgttgcaagactagtacaaagaactcctatatgccctttactgcagtcgttgggctcttttcctaagaataaggacattctcttatgtaaactgtagtacaactatcaaaatcaataaattaatattgatatgttgttatctgatctgtagtccatgttccagtttcctcagttgtctcaataatgtgctttatagctatttttcccctgtccagaatcatactttgttggtttatttttcttttctttctttctttctttttttttttttttgagatgaagtctcgctctatggcccaggctggagtgcagtggtgcgatctcggctcactgcaacctccacccaccaagttccagcgattctcctgcctcagcctcccgagtagctgggattacaggcatgcaccaccatgcccagctaactttttattattagtagagacggggtttcaccatgttggccaggctggtctcgatctcctgacctcaggtgatccatacacctcagtctctgaaagtgctgggattataggcttgagccaccgcacctggccatttacctttattcttataatcatttccctactgcttagatttcctcatcagatctataattcattatattgaaagcctttcttttttaccttgaggcactagaggcgtctcttaattacctattaacagtcaacccttaaaaattagctctagttgtttaacatatattcacagttatttagcatgaacaaacagttcagcattggcagaggagagctgttgtgtataactaagagtatttcttcttttattttcccgaagaccatcagttttttaagtcaaattaagtcaaaggtcagtttactaagaaactaaatagtcatctctttgtcaaaacagaccttttttcttatttctggaaaggtgatgtggaggatcatcaagtcattgtatcttaatttttttacaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggtacatttttttcctcttgtttattagtgtagtcatctcctgtaggaattccccggatcaaatctagtctggtgtttgactgtgatttgcatatatagttggtatgaggctaaaaagacttgtattttctcatttaattgtatgtaacttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgtgcatctgttaaccgtttttaatgcatatagccacatatacgtatttatcatcttttaaactttatacagaaaggtcatacaatgatcaatctttgttaccttgcttttttattttattaagtgaattttcctgtcaggaaatgcagatctgcctcattgtttttaatggctgtattatactctatagtgtgagtgtttgtttttttttgacttttgcagtatatactcaacatccttatcagtttttgcaagtctgtctctacattaaatgcctatcaatgcaattgctaagtcaaaggatgcatgcagttaaattttgatgaatgctaccaatacccatatgatgaatattaccaatatacatgaggggttataccaatttatacctgcaccaaaagttatgagtgctcatttccccacattcttaccaacgctttatttttattttctcaatttaataggtgaaaaaatatttacttgatggtttgctttgcatttccttaattatgaataaggttgagcatctttttatatatgtattgaccatttgaatttcttttcctctaacctgtttgtatctatgacctatttttccacagagttgtttgtctttttcttattcatttgcatgagttctttatgaattgtctcacattaattttacacttaaaacgtggcagtttctaccattggtgttgccatttatttatttgttctttctcttttacctattacctattactgacctggcttccttacacccaaatcaaacagcagagaggatgaagctataaaaagctaggaaacaatgagggcccccagaacttttcggcttgctaaagatgtagactatagagcagatggagagcctccggtaactaaaggccctatactttgttactctttgccctgtactgagtagaaaacctgacttgactatggagttaaaaatttaatttgtaattatctactggaaagagcagagaatactgataagctttccatgttttctataaattttagagagtgggattaaaacaaagatttttttttattattgtttttgagacagagtctcactctgtcacccaggctggagtgcaatagcgcaatctcaactcactgcaacttccgtctcctgagttcaagtgattctcctacctcagcctccctagtagctgagattacaggtgtgcaccaccacacctggctaaatttttttgcacttttagtagagacagggtttcaccattttggccagcctggtccctctgcccacctcggcttcccagccggcttcttcagctgggattacaggcatgagccactgtgcctggtcaaaacaaagactttgaggctcttctgtaactttgaatgttatgtttgatgctctattcctttgtccttatcaaaatccactgtcaagtaggcaatatgtgacaattttattataaacatttagaattaactaggggtttttatcttgctaatgaatgaccttgcattatcagaacagtagaggaaatccttttgtttctgtttgttaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaagtaagctaattttctttgtagtaccaattatggggcagttatgaacagatggctaactttataaccctgaactgttatagaagaaacaaaaattggcatcataatttcatttcctcaagtcaataccctatgccttctgatcatttaaattagtcaagaatatttcccaactgtggtcattgacaccaccatagggtgatgaggtctagccttagctgatcatccatgatcattcttttgtcactacaactactccaaaccttttctatctttcacaagatcctgtgactctctcctttgtccctctgcaaattatcttattttttatatagaaaattatggttcttgggcatgtgttcttacatatttttgcccagaatcattccttttttcagggaaagcagtatccttcatcttgcctaatgaatcccttcatctagatcccaccctctcttgattcatcagggacctccctctttctgttaggtccccttgctgctttatttttcatctctttctgttttagcttcttttcttaaacatataaacatttcttccatcaaaatcactatattcccatctagattttgtcctttcccatctatattcccatatagattctgtctttttcttttatatccaagttctagaaatggtaatctaggtttgttgaattcacttactccacagtcatgcctcagttcattgcagtctggcttctcccccatccatactactgaatccgttctttctaagttaactgatgaccattgacctcactgctctctccagtggtcacttttcagtcctcatcctgcaagacctcattaagatatttgacaatgttgaccatcccttccttcctaaaggatgattccatgaccctgctttgtctagattctcctctcacctccctggctgttcctttttttttttttttgagaaggagtcttgctctgtcacccaggctggagtgcagtggtgcaatctcagctcactgcaacctctgcctcctgggttcaagcaattctcctgcctcagcccccaggaagctgggattacaggtgtgcgcagccatgcctggctaattttttgtatttttagtagagatggggtttcaccatgttagccaggatggtctcaaactcctgacctcaagtgatccacccacctcagcctctcaaagtgctgggattacaggtgtgagccactgcacccctggctgttccttttaattgtcctttggttcctcatttctcttgctttcaaatgtcgtatgtcgtcagggttttgttctttgtctttttctcattttataatacatactctctctgtacaatcttattcatgctcatcacttagtctaccacccacagacttccactaccgctctaaaatccatatctttagctaagtcctgtttccttggctccatgccgatctatctatctgcccccaaaacatgatctacccacctaagtgttccaacacctccctcccgatttgtgcctgagtgattttgctaacatggaaatctagtcgtgtcactctctaaccagtaccttttattacagtgttttataagctgtttttgagccatagacctttggaggaatatgatgaaagctatgggcccacccctcagaaaatttttgtttcaagagatgcacatgtatcctgaaacccatccacgggtctctgttaaggatcccagctttaatgggtctctctctcctatgggacaaagtccagtctctctggactttgttttagatctgttccccatgatatgtctcctgcctccctgcatcactcatcttctttttccactaccgcatatgtactccatgttccatccctacctaactacttacagttcttccttacggtgtgtcatttccttattagatcatttcatttaccattttctctatgtaatgttcttgttcacaaatggcatctatctcgtgaacttacgcttatctttcaagacccagcttatatctctctcttcagtgacaccctcattgactgacatatattgacagaggtatttgctcttcttcctgaatcataactgtacttaatctctgttactgtactaggacagtgtatgataattatatatttacctgcctgtttctactagtctgtgacttctttattatttgtctatgaacttctagtatcaagcacagtgacaaataggaaattcatttgacagcttttattgagcacctactgtgtgtcatgcactgttcaaggcactaaagaatcggcagtaaacaagataaactaagttcttatttcatggagcttacattcttggtggaagaacacaagagagtgagcaaataagaaaatacaataattccaatggagatagtgctgtggaggaaaattaagtggggcaaggggcataggggtgctgggagtagtgggttctgtttcatatagggtgatcagggtaggcctcactgagaaggtagtgtttgaacgaagatctgaggggatgagagaaaaagctatgtggatttctgtggcaaacacgttctaggcaggagaaatagtaagtaccaaagcctttagtcaggagtgtgcttgacttgtttgaggaatggcaaggagaacagtgtggcaagcgcagagtaaatggatgggcaaggggtataagacaaggtcagagaggtggtttgggactagatatgtaaggacaaaaccaatatgacagttttgagtagaggagggacaaaatctgacttaacattttaaaagtaaaccgggcgcggtgactcacgcctgtaatcccagcactttgggaggctgaggcgggtggatcacttcaggtcaggagttcgagaccagcctggccaacatggtgaaaccctgtgtctactaaaaatacagaaattagtcgggcgtggtagcaggcacctgtaatcccagctactcgggaggctgaggcaggagagaatcttgcggggattcggggcaagggcagaagcagggagatgagttggtggacattgtcataatcgaggtgaaacataatggtagcttggaccagtatagcagaggttgtaagaaatgatagaattctagatgtgtcttaaaaggagagtcacagatttttctcatgggttggatatatatggcgtatgagacaaacaggagtcaagaattatgccaaggtttgtggcctaagcagttagaaggatggagttatcatttaaataagatgggggatcccacaggagggacggtattgggaaaaagatcaggagttcagttttgtacatgttaagtttgagtacctattagagatatcccaagtggtgatatcatataaatggaaatatgaagtaagcagttggctacataagtttggaattccaggaaacagactgaatcagagagatggatttgggagtcctctgcttatagatctgtggtgtctaggaaaatagccactaattatatgtgactctttaaattagttaatttacatttaatttaatttaaaattcatctttcagtcatactagccacatttcagtgctcaatagccacatctgtgtgttagtggctattgtattaaacatagcagatatagaacatttctaatatcacagaaagttctcttggactgcagtggtatagatggtatttaaagccatgagactggataagaaccccaaggagtgagagtagataaagggaaagagagagttaagtactgaatcctgcagcactataaattaagaagttagggagatgaggagggatgggcaaagaaggccaagaagtggccaattaggaggtaacccctaagaatgtggtatcctagaagccaaatgaagaacgtatttccaggagggagtgaacagctgtgttaaattctgctaataggacaagtaagatgaggaatgagaattaactattaggattattaaagtaaaggtcactggctgtaataattcactggagtattagagtcaaaagcataaagcttttgactaccccaataaatggggtaggttcacaagaacatgggaagatatgaattggagacagccaatagagatacttttggaaagttttgctatgtacagaagcagataaatgtggtagctagagaggtgggtgagatcaagaaaggttttttttttttttttttttttttttaagataggacaatgtacagcagagaaaagttgtgcaggagtgggcggggagaattgttgggttggagagatgttctagaataggcaaaggagcgggggtgtctagtgcacaagtagaaaggttggccttaaattaggagcagaatcagtttataataacagaagggaagctagatacacagacacaggaggcacaggtagttgagtggatgcggcaatgagagctgtggaagttcttttctgattgcttctattttctttctgaagtaggaagcagagtcatcatatggtattaggatggggcaggagaagttggagatttgaagggagatgagaaggtatgaaatagccacctagaagaaatggagaatgaatggactagggaaatatagttaagttgccagatagcactaagagcccacttaaagaaaatgagatgtcagcatgattgtacatgttcatctagccacattcagctactgatgcacagtaagtatttttaaatttgattgaatttttatggaaggtcaaagggaaagcctcaccaagaaagtaatatttgaactggctcttgaagaatgtgattgagtttgctgtctggagaggagggataaggacatttcagatgaaggcagcaatgtgtgcaaaggcccagaggcatggaagaacagagtatgttcttagaaaatttgaacatcactgttggaggctatgttctaggagcaatacaatgtagtgactgtgcaaggttagacaggaagaacttgcttcatggggttttataaagattaattgaacttactaaatgttatttctgtgcctactttcagatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatggtaaggttttccataagtatgctataactcaatgttttgttattgttttattaatttatttatttttgagagacctctgaactatgagggttattcaaaagcatcttgaatgcaaaatgaaaatgtcaacaacacatgattattactgattaatttaaaattctctcgcatttgcctgcctttgttactttcttccctagcctatgttttaaatgaaggctaatcaaggattttttaaaacctaaaaatagcaacagtaaaataatagcaaagtaaaataatattcgtaatcccatcatcctaacacaatgtcaggttttttttgtttgtttctttgttttgtttttgttcttgtttttgttttttttgagacggagtttctctcttgttgcccaaactggagtgcaatgatgtgattcggctcactgcaacctccgcctcctgggttcaagcgattctcctgcctcagcctcccaagtagctgggattacaggcgcgcaccaccatgcccggctaattgtttgtatttttagtggaaatggggtttcaccatcttggccaggctggtcttgaactcctgacctcaggtgatccacccacttcggcctcccaaagtgctgggattacaggcgtgagccaccatgcccagcccacaacgtcagttttaattttgtatattccattcctagttttcttgaaatgtgtgtgtgtttgcagaattacagtattagtacatataccattttttactgggtacattttatcgtaagtaaattttacctcaataaagttaaaatcacttgtacacatactattttattatgctttattttacttaatgctttctaatgttgctatataattttactataatactgcataatttatcaatcttacacactataatcattcccctcttgttggaaatttaggctattcctaatatttcactattgtaaatgacactacaataaatatctttgaggttgtatgtgctttattttgttatttcttagggtaaatttctagttgtgagattaattccactctacatttataatgtctgctaagtatgaaggcagtcttttactatggcctttttaggtctgggaagaagcagagaataccattttacttttgttttgtaaatagaataaaataataagatttatggtaatatttttcccactataaagtgcccattttgtctctctctgcccccccccccttaccttaaaaagaaaaaaagtattaatcttcagtttcatttgcctataaattagataaagtgtttgaggctgttggcaaatacctttctgaggaacaaaaagggtcttctaatatccagtaaggtctctctttttattttcctgtgattactttattagtaacccctacctcactctgaaattttcataaccaaatatggaggcttgttacagagtttgtagtataaagtctgtgtgggcttagagatattttaagttaagccatgccctgaacaactttacttgagaaaattcatttcattctgaaatttcaagtcaaaatgttattctcctttcagtatattccaagttcttttattttgtgctgcccctatattagatgagctgtgtggcttgatagccattgcagacacagtgaagcctgaagcagaactggctatccatattctgaaatctatgggcttagaagtagttctgatgactggagacaacagtaaaacagctagatctattgcttctcaggtaattgataggggtatgtgataacttctaattattgatatacattttatatcttgccttcaaatgctaagaaatttacattacctactattttcattatcactgagtagtcctatctggttccttcaagaaaatttaccatgctttgctggaaagactttgggctttgtgtgttgctgttatacgtaaaaaggtatttgcttagttcatgggatgcttgcgtgacactgtacaccaatttctgttgatgtgccctttgaaatgttgctcatattctttaccagtgctgccaacctaagctgggctctcctgatctcatgcctgaaacacagcaatagctccacacacatccctctctagtccatcctaaataccaccaccaatggaactattttcctaatgcaccactttgacataccatttttctgctcctgactcccacatctgccttatctctaaaatttttcaatctttttaactttggaatgccttctcccctcttctaataaataatgcaagtaatcttttaatacattcttttgtttcttttttttttcttgggacggagtttcgctcttgttgcccaggctgaagtgcagtggcgcgatctcggctcatcgcaacctccacctcctgggttcaagcgattctcttgcctcagcctcccgagtagctaggattacatgcatacaccaccacgcccggctaattttgtatttttagtagagacagggtttctccatgttggtcaagctggtcgtgaacttcggacctcaggtgatccgcccgcctcggcctcccaaagtgctgggattacacgtgtgagccaccgcacccggcctattaacaccttcttatgtaaaaaatacagaaggatataaagtaaaaatgtcctcttttccccatgctccccattcagtcctactgcccctcacactgccactttttcatatgcatatatgtgcatatacagagtacatatacagtataattctggtcttttcaacatcagatcattttgaacagattgttcagtagtttgctttttttacgtaacagtatactttggagcttcatccatatctgaacataaagttattttggccgggtttgttggctcacgcctgtaatcccagcactttgggaggctgaagtgggcagatcacatgaggtcgggagtttgagaccagcctggccagcatggtgaaaccttgtctctactaaaaatacaaaaattagccgggtgtggtggcgcatgcctgtaatcccagctactcaggaggctgaggcaggagaatcgcttgaaccaggaggcggaggttgcagtgagccgagatggtaccattgcactccagcctgggtgacagagcaagactctgtctcaaaaaaaaaaaaaaaaaaaagttacaaagttactttattctttctatactgaattccatggtatggatgtatcataatttatttaaccatttccctaatgatggacatttgggtggttttgaaaattttctttttgcaaacaaggcaataataaacatctttggacatgtatctttctgtacatgtgcaagcctgtccaagatagagctagacatggaattgctagaccaaatgatgctcacattttgatagatgctgccagatgccctccaaaaagagttacaatttacacaccagccactggtgtataagagagctcatttctccacatccttgctatcactagatattatcagtcttttaaaatgtggacatcttgtgggtgaaaactgatggcttgttattgctcagttatgtttcacgtactcattattttttaaatgaattgagtttattttcatcacataggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataagggtaagtgccatggcttgacctttgaggagtatgagactgccctatgtggtcaatgataatgtcataaagtatattgagcataacaattctgtcttaagttccatgctatcagccattaagagtttaagaatatggagtgggattatgggaagtcatgctaatttaccccctgactttctcaacccagctcataagcaagtgagaattataagtttctgaagtgaagaagaagatttaagaatggattcggaataaaatgatcttcaacaaatagttgctgagattattttaagtagatttaatcatagtaccagcatacacccctaaaagtgttttcagaaccctgaggaaaatttttgaaaaacaccttcggaagctgagtctaagttttagcattatctgagatttgtaattaattcacatattaccctaaggtagacgtaatcttcaacatacacagtatcaaatgtaaaagttactggttaagttagagtctcttactaatatcacaaatatttctgttcttagaatgatcttctggatgtagtggcaagtattgacttatcaagagagacagtcaagaggattcggataaattttgtctttgctctaatttataatctggttggaattcccatagctgctggtatgtgactcttaactagtactgctttttccactaaagttattagagacctaacatattggaagcctgtcttcttactattagttttgagcttagtttttgtttgtagcctactggtatggtgagaggtaatgttaaaatcaatcattttaattttcagtaatgtttgttatagcttaagaatatataagcattctgacagatttatttttttccctccaacttttttttttttttttttgagacagagtctcactctgttgcccaggctggagtgcagtcatacaatctcggctcactgcagcctccatctcctgggttcaagcagttctcctgcctcagcctcctgagtaactgggactataggtgcccgccacaacgcccaactaatttttgtatttttagtatagacggggttctccatgttggccaggctggtctcgaactcctgacttcaggtaatccacccacctcggcctcccaaagtgttgggattacagctgtgagccaccactcccagccttcaactttgtattttgaaaaatttcaaacttgacacctgtaatcccagcactttgggaggctgaggtgggcggatcacctgaggttgggagttcaagaccagcctgaccaacatggagaaaccccgtctctactaaaaatacaaaattagccgggcgtggtggcacatgcatgtaatcccagctactcgggagacggaggcagtagactcgcttgaacccaagaggtggaggttgtggtgagccaagatcgcgccatcgcacttcagcctgggcaacaagagcgaaactccgtctccaaaaaaaaaaaaaaaaaaaattcatacctccaaaaacattgaaaaaaatggtacaataaaaatctgtatgcctttcacctaaactcaccaactgatggtattttgccacattgcttcatctctttctgcatatatttgcacagagatatgtatttgtttgcttattaatttttttctaaatagatttacctttaatctgactacccaaacccaacactgtttgcaagattaattcatggagcaaatgatttttaaagaattatacaagtattttcctctagtcttttttttactctacatcagtttttgtcttgttacatagttgtgattgtagcttatggagaattttctgctcttcacttaatattctattatagtcagctggtattttttttaggttgagagaccagatgacagagagagtgaacaaagcaatataactgagaaaaaagaatttagagttatttaataagcatctgagaatctcctaaacttagggacctggtaggagttagtaatgatgacataaaagaaataagtattgttttcttcttgttctctctggtttgagggccaaggaaagacaagaaatgacatgagaacaattacaaaactgtttatcagcaaggacacacaaatactgagagaacaaagaacaaaagaacaatctaagtccagtaagattaattcatggagcaagtgatttttaaataattatacaagtaatatatgatcaccatagaaaaagtagaaaaatataaagaagcacataaaaagttaaaagtatgagtctatttcatcctcatcatgtgagcaaacattcttatgtctgtgaaaaccaagtgtggatgagtttgtagaacatgaactcccatacgctattggttggattttgaatcactacagccactttggagaacagctgaggaatatccacgtaaagttgaagatgtgcccatgttatgacccagtagtttcacccctaggtatataccccacagaaactctcaaacatggacacggggagacatgtacaagaatgttaacagcaacactctgttagtgaaaaaaatggcaacaacaaaaatctctaccaccaagaggataaatgctgaagaagtatcaaacaaagaaatgatttgtatgtatgttagaaacacattaataatctgtttagtattatctactctaactaatccatacttgtttcttaggagtttttatgcccattggtttggttttgcagccctggatgggatctgcagcaatggctgcttcatctgtttctgtagtactttcttctctcttccttaaactgtaagtatgatagcttgctcacatttgtattttgtattcctgttatcatctagtcattcttggtaggttttattcttgtattgatcaatgataagcccaaaccattcttaatgagaattattattagcggccgggcgtggtggctcacacctgtaatcccagcactttgggaggccgaggtgggcagatcacctgaggtcagtaatttgagaccagtctggccaatatggtgaaaccctatgtctactagaaatacaaaaattagctgggcatggtggtagacacctgtaatctcagctactcgggaggctgaggcaggagaatcacttgaacctgggaggtggaggttgcagtgagctgagatcgtgccactgcactccagcctaggcaacagagtgagattccatctcaaaaaaagaaaagaattattattagctaacagtaataattagctatgtaattgttacttcgtgtactttatgcatagcaaccacaagcactgagtgggataaaatatagtgcactaattctgagaagtagggtttctgatgatataactccacacaattcgtttcaagctattttcctaccagtgatcacctttatacatttcataccaaaactaagtgtggatgagcaaatcttctttcttttctgcatgtagcgagcatctcatttacttttggttatttgaaactagcatacttttgcatatgtccagttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaata

SEQ ID NO: 4748 - DNA, 139698 bp, human; identical to SEQ ID NO: 4746

SEQ ID NO: 4749 - DNA, 135987 bp, human
ctgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtggcatcttatctttgacacttttcttcgttgtagacgttgagattatcttaagcacaaacacttatcgtttcacaattcagcgtttgtccaggatctgatctttattttaatcacagactctttatctacaatagtatggctttgtattgagaatatgtgcagaacattgaattagatgatactgaggttattaatttttttttttttttgccgggtgcgggggggtggtggggagggggtgatgcacaagaaataagacagagttcctggcctcaaaagagtttacttacagtaggctgggcgcagtgtctgacacacctgtaataccaacactttgggaggccgaggagggtggatcacctgaggtcaggagatcgagaccagcctggccatcatggcgaaaccctgtctttactaaaaatacaaaaattagctgggcgtggtggcgggcgcctgtaatcccagctagtcgggagactgaggcaagaggatcgcttgaacctgggaggcggatgttgcagtgagccgagatcgtgccactgcactccagcctgggctacaagagcgaaactgtctccaaaaaagaagaaagaaaaataaacagtttacatacaattgagtccgaattgagtcagttgaattcagctatgaagacaacggtttctagcagccccactgactgaattactaggttgcttatcacatccttttcaatggttatttttgaactggcattttattatatttaacattttctggtgtctaaggtcatgacatgagagagttttttttgtacttgaggatctcaatgtagtaggaaagaaagatacacgattacctaaacatttaaaaaatctcactaacgttatatattagaaacaggaggtgttatgagagtgcagggaagggagcatgtgaactgggctttgaaaaatagataggatttagctttgcaggaatggaggaagaggaagacatctatctggactgatagatagaagaaataatgtgagcaaagccatgggggtctggaaagttgcccgacatccagtaacacactgtaagtcaatattcctatttctaacagccacatcttccaagatgtcactgattaaaattagaaaaaatatagaatacaaaactagtcagctcacaaacatatccaactgccctccagccaataagaaagcttatatagagaaaaaaatacatggaaatgacaaaagcaatgttaatgtatgaggcttaattctgatgtaaactcaaatctaaaagagaaaaaatgtaaaactcgctatactttaattctgattgagtgttgtgccttaaatataatttggaatcatttttaaaattgttgggaatgaataacattttctgaagtgagcaactgttccaggttttccccaaggaatctctgcttttccttttttcctctaaattgatttctctctattgatcttcttaacttgataggaactattctattccgatcacagccttagaaagatcttgatgcctgccctcaagataaggttaaacactaatccctccaaaggataggttaacatctctgttctctaaagcagaaggttgattttctttgaaaaatgcttgcagaagcagtaaaatttgcttacaaaacaagagagagagagaaaagagtgcaaaaataaccccagctaacacaccacaaccttcacttctgtgagggcgctaaaggaaatacattttaaaaaaataaattccttgttataactccttttatctatatatttaaaagctcttggcaaactttattaatcaagactttggacatcctgatgagtgaaaataatcttcatttgccagttgggaaagtaaattgcaaggagagatttttgtctgaactcatagaagcactagcatagatgagaatagtatttgggagttttgtctcaaaattccttctattcatctttgttaaagggcagttcaggttttagcgttttgtttttagacaacgatatttcttaggatatagctcaacatggggccggggcaagggggaggctgggggacagatgagtgataggcaatggttaggcagagtattttagttcactctaccatcccagcaatcatgtttttccctcttaaatctcagtcttcaggttgatttaatgtgatattacttgcttacttaacttgctgagatagtttggcaggaaaaatatcaaaattcctttagaatgtgtttcattaaagtaaaagggtcctgtgtttctgattttataaaatgttcttactttttccagcactgtttgcaaattgaagtgatttcctaatctttttgtgcccaaatgtatgagatattggtagactacatcagttttcacagatacctctttccttgaaggaaatgagggtaaaataccccattttgagtcagttatgtgtactttgtaccatattttctgttcacatttaaaattatacagctatgtctcaaggatgaaaaaagagttttacttatttttactattaatctctagtgtagaagtccagtttttcagacctataatcaggagtgcatttttaacaatttaccagttgaaataaatgggttatttcacattgtagggatattgttttagactggccattaaccttattttattttatttttattttaaaagatgttattgttattatttatctatgtatttatttctagaggcagggcctcgctctgtggcccaggctagggtgccatggcacaatcatagctcactgcagccttaatctcctgggctcaaatgatcctctggcctctcaagtagctggaaccacaggcgcatgccaccatgcctagctacttatttattaattaattattattttttaaataatattatttttaagagatggggtcttgctctgtcacccaggctggagtgcagtggcgccatcataactcactgcagtctcgatctcccaggctcaagcgatcctcctacctcagcctcctgagtagctgggactataggtgtgtgccaccactcccagctaatttttaaactttttgtagagacagcatcgtgctgtgcagtggtgctatctcggctcactgcaacctccgcctcctgggttctagtgattctcttgcttcagtctcccaagtagcggggattacaggtgcgcgccaccacacttggttagtttttgtatttttggtagagaaggggttttgccatgttggtcaggctggtatcgaactcctgactgacctcaagtgatccaccctcctcagcctcccaaagtgctgggattacaggcatgagccactgtgccaggccttaaaacacctagtgttaaaaatggtgtcttaattgtattctcagattctcctagaaagaaaagatatactaaatgtatatttagatatactaaaacacctaatgtttatttttgtttatttatttttgagatggagtctggctctgtcacctaggctggagtgaaatggtctatgtttgttttttcatcttgacagtaatatctttgaacattttctggagtattagatattattctcttgatgcttcaaggtatcttaacttcaccattgtattgcgatatattgttttggagagacagtataatataggattaagagtggaggctaggtggggcacagttgctcacgcctgtaatcccagcactttgggaggccgtggcaggcggattgcttgagcccaggcgttcgagaccagcctgggcaacatagggaaaccctgtctctacaaaaaatacaaaaattagctgagtgtgttggcacgtgcctgtagtcccagctactcaggaggctgaggtggaaggatcgcttgagcctggaaggttgaggctgcagtgagctgagatcacaccactgcactccaccctggatgagagagtgacagagtgagaccctgtcttgtccggaaaaaaaaaaaaagcctgtcttgtctggctcagtccaggtgctagactgtctaggtgggatcccagcccctctgcttactacttgtatgaccctgcgcagatttcatactcctctgtgcctcagttccttcaaatttctaaaatggggacaataacagtacctgtctcacaggattgttaatgatctaatacatgtacggtgtctggcagatagtaaacatacaataaaatgtagttacctttaatattttaatatattatttactgtaaaagtaattttaacatcctatataataaaattataaattacagttttgctgtactataaatttagtagactacaggatcaatatactaatcaatcaatacttgcaagcaatatttaaattctttaaaaaaattttttttggagacagggtcttgctccgtagcccaggctggagttgcaatggcacgatctcggctcactgcaacctctgcctccagggttcaagcgattctcatgcctcagccccccgagtagatggggttacaggcgtgtgccaccacacccggctaatttatttatttttagtagagatggggtttcgccatgttggccagcctggtctcaaactcctggcctcaggtgatctgtccgcttcagcctcccaaagtgctgggattacaggtttgagctaccgctcccggccctgccaccacgcccggcacaatacttaatttctaacttacaccatagaaaattggccggtgcggtggctcacgcctgtaatctcagcactttgggaggctgaggtgggtagattgcttgaattcaggagttccagaccagcctgggcaacaaggtgaaaccccatctctacaaaaattacaaaaaatagccaggtgtggtggcatgcgcctatagtcccagctactggggaggctaaagtgggggaattgcttgagcctgggaggttgaggctgcaatgagctgagatcatgccactgcagtccagcctgggtgacagagtgagaccctgtctcaaaaaaaaaaaaaaaaagaaaaaaaaagagaaagaaaatggaaaactcagattgagagggtcccccagtagcctatagtacacctacatatgctaacatggcatcttaaagctcattattacagctggcaaatcaaatcactgtgatgtgctcatcctatttccctatcaagaaaactcataacaatctgcttctgtaattagtgagccacagactctaggccatcgagattttccacattccctaattgtcaaatgctgaaccatacttgtactgaataagttgtgatacagtgtaagcaagggaaaaggccttatgtatgtctaacctactctgcaaatagctgcattcttacaaagttgtgtgtaaattgaatttttacaaagcatgtcagcactttgattagtacatttttattgtgtgcttattgcatattcagtgtttcctgtgagctatacaaagaagcataaggcatatgttccaatgtctagcaagagaaagaagtttaataccaagcagagagaaattaggtactactaaactatgaaactgattccagggtattcggaatttaaaaagaaagtggctaggagtatttgacatgatttttcatgaaggaggtgggacttcagttcatttacttactcaacagtgatttattgagtagccaccatgttcactggtggtatgatagtgaacagagcagatatggtcctgtttctgtggagtttacagactagtgaagtaatagaacttaaatatgtgcaagaaaacattctaggtgaggggaccagttctaaacaaagtcatagaaataaatgataagagcatggactatatggcaatcagtgaagggacttgcttgattgtagtagagattttatgttggggaggagcactgcaagtgatagatgcagaccatcttttgaatgctttgaagaactatttaagtctgtctaaaagtcctttggatacactgttctggagagggtttggggctttggggtcatactgccttggtttgatctcatctctactctaatttgtttaagtttagaattttatagtaagttttctcagtgacacaactctataggcaacaaactgatatttacagagtggttggggtcagtaacccttgtatcagttaagcaatgtacacatgaagtgccagtaggaagtccaaggaaaggttgggagaaataaaaggaggttagtaaaggaaagagaaataaatacattctgtgatagttggtagaatgtcatcagaaatgtcttcaagcaaaacaatacatttgcctgtcttttgtttctagttgcgtttaatggtagtgtgttttccttgtctaaatatgagaaagagaaactaaactgcagctacttgacgtgggcatctgagagctaccaatggttggcttaggttatgttctacatttgaagcatctggtcagttttagattgtcttctatatttgaagcatctggctagaccacttgtgtcccagttttctattttacctaaactcaacttggtcagaagcttatgtagtaagtattgtttgtaacctgtgttagtactctcttaacatggcttaaagcatgaatggattgtcaaatgaatacctgttatgacctgtattttttcttgttacctttggatttaatgtaagtataataatgctctaagaacatttgacagtattgttcaggcacttttttttttttttttttgagacagggtctggctttattgcctaggctggagtgcagtggcacgatcacagctcactgcagcctcaacctcctgggctcaagcaatcctcctacttcagcattccaagtagataggaccacaggcatgtgccaccatgcctggctaatttttaaaattttttttttgtagagacgggatcttactttgttgcccaggctggtcttgaactcctgggttcaagtgattctcctgcctcagcctccccaaagtgctaggagtacacaggcatgagccatcatgcatagctgcttattcaggtgcttttaagaaattttttccaccagaaaagtagaaatgatcataccagactacctttgtctcctcccaatcttttattatggtgatgtccaaccttgttataaggaggagcttcttttaatctcagagtcatgagatcagggcagatactgacagtatagttcctgagaagtagttgctggctgtgctgttcttcctttcccaatgggaatcttagctgagacatgtagcagagagaagacattatggggagccagcatggagctttataggaggtgaggtgtctagatctaccagtagatcccgatttgcaggtttgagactcctaccttatttcatccatggctgttgcattgtacaaatctagtgggcagcagccacagtctgtaaaaattatgacatggaattacacaatgtggcagccctggaaactacccaaaccacttctatttctagtcctgtattcccttcaatacctactacatccagcagccgtgatagtcccaacacgtttatcatttgactctctttgcctcccacttgaaggctcccctttaatccaacagataaaaattacatctttgtctaaggatttcaaggtgttgcataaattttcttattctatttaagtatactcatcaagaaaatgataataactgcctcgtctaattcataggtttttatcagtatcaagtggaataatgtatgcaaaaacttcataaattaaagaatactacacaaatataatattcttttcagatatattatgttgtggaaagaatactgaattccaatcagatgtctggcatctcagttctttctgctattaacaaactgtgactttggacaaattactttgtgctctggggactttgtttccttacctataagaggaaacttataatgccactcctatctacccagacacctaagagctactttttcctcacctccacattcagtcaccaaatttgttgtctagttcttaaaatttcttaagttggtcctgccctctctatctccattcagttcctaatcacttcccttttgggcagcagcctgttaaaaaaaattgtggtaaaatatgcataatataatattgactattttaacctttttttttgagacgaagtctcactctgtcacccaggatgcagtgcaatggtgtgatctctgctcactgcagcctccgcctcccaggctcaagcaattctcctgcctcagccccctgagtagctaagattacaggcacacgccacccctggctaatttttgtatttttagtggagacggggtttcaccatgttggccaggctggtgtcaagctcctgacctcaaatgatccacccgccttggcctcccaaagtgctgggattacaggcgtgagccactgtgtccggccccattttaaccatttttaaaggtacaagtcagtggcattgagtgcattctcagtgttgtacaatcatcactgttatgcatttccagatttttttcatcatcccaaactgaaactctgtacccattaaataatagcttctcattctgccttctctcaccccctggtaacctcattctactttctgtctctatgaatttacctattctaggtactttttgaaaaataatttcaacatttatttttgattcagagggtacatttgcaggtttgttacctggctatattgcatgatgctgaggttggggtacaattgatcctggcaatcaggtacagagcagagtgcacaatagtttttcaacccttgccccactccctccccacccagtagtccgcagtatctattgttgccatctttatgtctatgagtacccattttttttttttttgagacggaatctcgctctgtcgcccaggctggagtgcagtggtgtgatctcggctcactgcaagctctgcctctcgggttcatgccattctcctgtctcagcctcccgagtagctgggactacaggtgcccgccaccacgcctggctaattttttttgtatttttagtagagactgggtttcaacatgttagccaggatggtcttgatctcctgacctcgtgatccgcccacctcggcctcccaaagtgctgggattacaggcgtgagccaccgcgcccggctgagtacccattgtttagctaccacttataagtgagaacgtgtggtatttggttttctggtctgcgttagtttgcttaggataatggcctccagctgattccatgttgctgcaaaggacatgattttggtctttttttaatggctgcatagtattccatggtgtatatgtaccacattttctttatccaatccaccattgatgggcacctaggttgattctatgtctttattattgtgaatagtgctgcattaaacatagaagtgcatgtctctttttggtaggacaatttattttcttttggatatatactcagtaatgggattactgggtcgaattgagttctaagttctttgagaaatctctgtactgctttccaccacggctgaactaatttacattcccaccaacagtacctaagcatttctaggtacttttaataaatggaataatacaatatttgcccttttgtgtctggcttattttacctagcataatgtctcaaaatttcatccatgttgtagtatatgtgagaatttctttcctttttatggctgaataatattccattgttgggtaataacgttttaactggtcctcctaactccaggctttgccctatcaaatttgtccttcgtgatctgaccttacttacctttacaatctccttgttgttaccattcatgccatatgcctcagccataccagtggtggtccttaaatatggcatgctgtttgacaactctgtaactttattcatggctcttttgtctgaaatttatttccattcttctggagaactcctactcaatcttcaaggccgtttacctaacaatagtggatgggtgaaattatgatacgttcatatagtggacttctagtcagccttttaaaattatggcatatatattagtggttaaaagcacaggctctggaccaggcttactgggatcgaatttcaaatctgtcacttactaactatgtgaccttgggaaagttccttaccctctctgtatctcaattttttcatctatgaaacagggatagtaattgtatctatcccatcaggttgctgtgaacatttaattacttagaagtattagctaggccaggtgcagtgcctcacgcctgtaatcccagcactttgggagtcccaggcggatggatcacttgaagtcaggagtttgacaccagcctggccaacatggtgaaaccctgtctctactaaaaaatagataaaaattagccaggcttggtggtgggcacctgtaatcctaactacttgggagactgaggcaggagaatcacttgaacccaggaggcggagggtgtggtgagctgagatcacgctactgcactctagtctgggcaacagagctagattctgcctcaaaaaaataaaaataaaaataaaaatattagctattatgttttatttatttgttagtttttaaatttttcgtagagatggggtctcgctatgttgctcaggctgatcttgaactcctggcctcaagaagtcctcctgctttggcctctcaaagtgctgggattacaggcgtgagtcactgtgctcggtcaaaagtattagctattgttatatattaatatttactgtcatagaaaaatgtttattatatagtgttaaatgaaaagaaacatgctgtaaaatagaatagtatatcatttttgttaaaaatgtgtgtgttcttgggtgtggtggctcacgcctgtaatcccaacactttgggaggaccaggcaggagggttgcttgaggctgggagtttgagaccagcctgggcaatatagggagacctcatctctacaaaaaataaaaaattagctgggcatgtggtgcatgccttgagtcccagctactcaggaggctgaggtgagaggattgcttgagcctaggaagtcgaggccacagtgagctattactgtgccattgcactccagcctgggcaacagagtgagatcctgtctcaaaaaaatgtgtgtttatatgtagacacacatataataccctcctagacttacatacacacaccccaccccaccccacatacacaaccctcaacatgttagccttcattatttctcagtgatagaccaattggttgtttattttttatatttgcttatctgtatttcctgtttttctccatttgacatttatttcttacatttggggagcatgaaaaaagacacagttaaagcatctcttctgtgaagccttccctgatttcccttccttcgtcctttagggcaccagaataccttgcatccctgaactccttaaagcctgtattatattcatttacattttaatccccaactgggactagtgcagagcctaaaagatacatgaacttagccatattagtaaggtgaaaatggaattatgtgcaagcactttacacatgttatctcatatacagcactcagcagtctcatgagtaagagttatctgtgtttttcagatgaggaaactgagcatcagaagagaccaaacaatttgctgaaggtatacaacagtaagcaacagaatttggattcaaatccaagtctgtctgatgccaaaggtggtcttttcaatgtatattgaatgactgaatgatctaatgaatatatctgctgtctcagatgacataatttatgaaagacttattggtaaacaaatatgctatatgaatgtaaagatatgttgttgttattttctgctatattttcatctgcaccctagattctgactaggcaaatgagctttccttctccccatgcacaattttttccctctgttagtataaattggcaattttggctctccatttgtctttttatactgcccatgctctttccactctttaggaacctgactcataattatgatattaagcttttcagattaatctagccatgtccatcagatttactgttgtgtgtacatgttgagaaaactaattagaaagtatctggccagatacaatttgtttcagtgatgccaaagtatggtaattcctagtttaatgtgtttacctttttctttttttttctttctttctttttttttttttgagacagagtctgtttacctttttttgtgtgctgatatgtccacatttaatttcctacattcatattcataccgctttcaaaagaaggtgttgtcaatgataaaacattagacagaaatagtttttagacagaggatgttaataagttcagcctatgtcttatttaggtttatgtttttgtgtgtatgtgtgcacagccttcatcatttaagtttatgttttgtgtgtatgtgtatgcagccttcatcaaaagaaaaaaggcagatagtcaagaggtgttttaataatttatatcacagctacaacagaatatactaaaccaaaatttagaatttgattatagcttgactccctacaattttttcagaattaaaaagatgaatcccctttaaagcaaactaactgaagggaagcatctactttgtgaaaattgcctgtctaaaatggggtgggaaataactcccttttaagtaccgcacttttttttattctaccagaacctggtttctaaagatttcaacctatttttatagtctcagttttgtgagatgacaaagttcatcttagtgatttctaactaagaaagcacaaccacagaaacgaggaatggattctggaaagggaaacttcctgcaaattatgatgaatttacagaaatagtaaatatttaaattccataaatagttaatattgttgttgataattatttgtcttgatttctgttcaagaagtatacatttgaattagcacacagtttattttattcctagcaatttagtatatttttcatagccatcaatatttgggattctgcttgcttatgattacaaatcacttgaaacctgccagttgaaaattctcaagggtgtgaaatgatatgggccttcagtgaattcattcccctttatctgtataaaatacctggctaaacagttgtctttgacaattttaaattactgtttcctttcttaaaaactcctttccagaagctgatctcccgtacatttccagtacataatttttcatccttatctgtcctgacagtgattcagctttgaataagagagaatgttaccagagtttcacctttattggcctaagtctttgtttattttttgagacagagtcttgctctgtcgcctaggctggagtgcagtggcatgatctcggctcactgcaacttctgcctcccgggttcaagtgattctcctgcctcagcctcccgagtagctgggactgcaggaacgcgccaccacgcccagcttatttttgtattttgggtagagacggggtttcgccatgttggccaggctggtctcgaactcctgacctcaggtgatccacccacctcggcctcccaaagtgctggaattacaggcatgagccactacgcccagccagcctaaatctttaaaacaggacatgaaaggaattgaagggttgggtatgggtggggttgtagatctagactatatttatggaatgtttgcttccttcgtgctgaaaattgttctttggaccttgggatgaaaagagaaaatatatgaaaaataagaatgttatgaaaagtctaagtattctgaaaaatacattagtatactactttataatcataccatataaatatttcagctataaaaattaatgcaaaataaattttctcccaatatgttaactgctttaaaaaaaagtattggcaagattgattatattctttcctaagaggaaagataactttgcataatcaccaagatggtttaccaacatacaccacgtatactgagtattacagtcttcaccaacatgagtcaaatgctagcgtgtatagggttggtagtataaacctacctggtacctttttggttttgctgactaaatggtgctaatgaagccagggttatagacttcatctctgtgggagtcacttgttctttggagtcattaggtatgccactaactctgctccacagttttccgaatgcagtttgttcattaagaaagggaggctagtacagagtaaaaatagctcagcaaaaagccatcatcagtacccatgcccttagcctcctgatagggggaggagggtctttaatgtccaggctttcaaactcacatatacatttttattattaatcagtggaggctgcacttagaaatttatttctttggacttctgcaatattctgcttataaagtgtttctgtggtttcaactgtagatccctttttgcctttatctccagactcttttgtctcaaaactttatggtctcagagaactaaggaaagacttggctcactatatgcatttgcagaaagtaataaggctttttttttttttaacgccataaagtgatctcagcaaagtgacaaatctacagtttcagaactgaaactaaacaactctttcgtggtttattagactcttctatattaagtagagcagttttaggtgagcctctgggaatctcatgaaactgagcttccagtgtggctcatagtcgtttgtaatctatacaaatctatagtatctttcattgagtatcattaaagaatgaggtattttgcagaagtgaatttccaaataactgaagtataccctttacatttttgtcattcagggatctgatgcatgcatcctacaaaggcatccttgaaatacatttacttttccaaaataaaaatacttttatttctgattagaacattgataaatggtcaatgtaaaaacaaaatctagtcaatatttatttatttatttatttgagacagagtctcattctgtcgcccaggcagtgggggcaatctcagcccactgcaacctctgcctcccaggttcaaatgattctcctgcctcagcctcctgagtagctggggcaacaggcgtccaccaccacacccggctaatttttgtatttttagtagagacagggtttcgccacattggccaggctggtctcaatctcctgacctcaagtcatccacccaccttggcctcccaaagtgctgggattataggcatgagccaccacgcccagccccagtcaatatttagatatctctcctttctgagatttattttttcttacagcatttatcactacttgacttttgcaatttttttttttttgagatggagtcttgctctgtcacccaggctagaatgcagtggcgcaatctcagctcactgcaacctccacctccccagttcaagtgattctcctgcctcagccccccaagtagctgggattacaggtgcacaccaccatacccagctaatttttgtgttttcagtagagacggggtgtcaccatgttggccaggctgatcttgaactcttgacctcaagtgatcctcctgcctcagcctcccaaagttccaggattacaggcatgagccactgcgcctggctcactacttgattttatacattcctttgtttgcttattgtccatctccctcaagagaatatgagccccatgaaagaagagacagtgcccctcttcactgctgtatcaccagcacgtagattagtacctgaaacataatgggacttcaataaatatgtgctaactaaatgaagaaagtagaaatcactcttaattccaccatccagggattagccactgttaagattctggtatcatttctttctttttttttcttttttaaagagcaaccctattaactgatctggtatgatttctaacaaaagttttttctcttacatacacattctcatgtgtatatataaatttatacaacattttaatagaaataggactatcgtcaattgtttgtagcctcttttttcacttaactcatcacagacatgatgtcattaagcaaacaattatgtgtttttaatggagatatgataatatatttgaccaattctgtattgatatttaggttggttccagtttttcaatcacataaacaaccttgtgataagcatccttagccatacatcttagtacagttgtctgtacctttcctcccctttgaatatattcttagaactggaatttctgggttaaaaggtatgcattttttttattatactttaagttctagggtacatgtgcacaatgtgcaggtttgttacatacgtatacatgcgccatgttggtgtgctgcacccattaactcgtcatttacattaggtatatctcctaatgctatccctccccccatcccacaacaggccccggtgtgtgatgttccccttcgtgggtccaagtgttcttattgttcagttcccacctatgagtgagaacatgcggtgtttggtttttttgtccttgcgatagtttgctgagaatgatggtttccagcttcatccatgtccctgcaaaggacatgaactcatcaaaaggtatgtatattttaaggctttttttgagacggggtctcactctgtcacccagactggagtgcagagcttcaattatggctcactgcagcctcaagtgatcctcctacctcagcctcacgagtagctgggactacaggtatgcaccaccacacccggctaatttaaaaattttttgtagggacagggtcttactatattgcccaggctgcctattttaaggcttttgataaatattgccaacttgtcttttggaaactctgtagggattggtgttagtttatactaccatcagcagtatatcatagttcgttaactcaaaactattttgatattaatgattttgaaaaaaaagactttctaaaacacattaagtatttttagtgctttattgcttttctaagcagaatacctgtacctgatttaattataacacacatacacacacacacacactcatatatatatatgacatgacatgtgctcgacctgttattgctcactgtccttgagttgagagtagtgttcttccttctaccactgcctccatggggcagagaggtcctttccagagctgagaatgtcagtaagagatatatgttccttggcatcttgacttcctaattggaatttactatatgtttccccacacgaaacagtgttatagcactattaatatatagtccaactgtgctattgtctaaactcctaagaaatggacctttgaacctagccatcatttataaagttgttcttatgagaaaacatgtttcatcttcaaaattgagaaacaactgttcaagaaacccatttttaaattgaaggtacacattcaaaaagtatatattgagggcttattgtatgtgtgaagataaatgtgctaggccgtcaatgggtaattcttttcttgatgatgcaatgttaaggtacccctgccccctagtcatcattttggtcaggtcaggacaaccagttgcaattgtaacccagggagaaaatattactggagtgtgtttgctaggcaggggaccacgtacaagggtttctgcagaactttggaggccaggattgaaggaatagctgctcagaagaggtagaagagaaaaacatacaggaaatggtaaggaagtgggaaagttggaaagattaatgtgtttcttttagattaaggggagaagagggtactgtttgtcttctcgagatgagtgaggatggacattcaggctgacattctgccatcaaaatgccttgtgtaggaatattagtctttgcatataacttaacaaagctgacctgccattgttgtgtttttgcttgaggacagtgccacactgctgctgccatgtacccaaagaattgcttgaacccatccccttcattacttcaactctaatgactattacttttcattaatttaggctgtattcttttcagacaacgtaaggtaggggaaaagagcctactttttggaatctcagaggcctgagttagagtcagattctatcattcattaacttatttgtattaggcaaaggagctctcactatgtcttcgaacttgaatcttctctagaaggagaaaagttttatgtgattattaggattaaagtgtttaaaatgtctggagtatgataggaacgaaataaattttaatttgtttcttttctttttctttttttttttttttgagacagggtctcattatgttgcccaggctggtcttgaactcccgggctcaagcaatcctcccgctttggcctcccaaatttctgtgattacaggcatgagccactgtgctcagctaaatcttaatttcttttattctcctctcctccacctcattttccacccactaccagaatcatcttctattttaaaaatctgcgtctgaaagaataacattataaaagtagtatattgaggttaaacgtggccacctggccatatgtttagctctcgtccttcacaaaactccattaatgtgacagtgaaaagattttaaaaaggttacacctgcaaggaaaagaaaacaggagagctaaatcagcagagggatgaatttaatatatttttggaagataagaagcacatgaagagggagaaccttccagcagaggaggatattaatgagaagtgagctctttaatctcacattacccatgataggctcagaatttgaaggtaagttgtttatcctgaaaggtgaagaagagacccagggctgaaaataagggaaatgttttaaaaactgaacaggaagggattggacctcttagtttttctcaggagaccaggagtatagtctcagtactaagtgaatctgaaaggctctgagctcctggacagtggggtagagtggaggatactaaagcattgggttgagaacagggaaattcagtggaagtctgcatactgcgtggtcagccccttccccacaccttgctcccaaatatagcagcaaatataccttgctttgcagataggagattggagaattcttttcttggaaaatgaatgatcccagagaaaagaattccagatggtaacatgatagggttccgcaatgaaaaagatagctagctgccattcactcaatactgaaatgcatagtggttaaaggcatgggctctagagttaggcttcctgagtttgaactcagacttaactacttaccagctatatgaccttgggcaagttacttaacctatttgttcctcagtattcccatctttaggatggggaaaattatgtttacctcaagattgttgtaaaggttaaatgagttaacaaagcactgctgatggtaagctctggtaaatactagctgaggaaggaggaagtacccagggacttccttagctgtcaaaggcagctctcgactttagatcatgccccaatggtgaccagcagccttttctacataggtggtacatggggtctgaacaggggctttgaccccacagaagacacctttccccagttcctctctctcattcttaactctgtcttttaggaacattctttttttttttttttttttttacctttttttttattttttattttttattgatcattcttgggtgtttctcgcagagggggatttggcagggtcataggacaatagtggagggaaggtcagcagataagcaagtgaacaaaggtctctggttttcctaggcagaggaccctgtggccttcctcagtgtttgtgtccctgggtacttgagattagggagtggtgatgattgttaacgagcatgctgccttcaagcatctgtttaacaaagcacatcttgcaccgcccttaatccattcaactctgagtggacacagcacatgtttcagagagcacagggttgggggtaaggtcaccgatgagcaggatcccaaggcagaagaatttttcttagtacggaacaaaatgaaaagtctcccatgtctacttctttctacacagacacggcaaccatccgatttctcaatcttttccccacctttcctccctttctattccacaaaaccgccattgtcatcccggcccgttctcaatgagctgttgggtacacctcccagagggggtggtggccgggcagaggggctcctcacatcccagtaggggcggccgggcagaggcgcccctcacctcccggacggggcggctggccgggcggggggctgacccgcccacctccctcccggacggggtggctggccaggcagaggggctcctcacttcccagtaggggcggctgggcagaggcacccctcacctcccggacggggcggctggccgggtggggggctgaccccccccacctccctcctggacggggcggctggccgggcggggggctgaccccccccacctccctcccggacggggcggctggccgggcagaggggctcctcacttcccagtaggggcggccgggcagaggcgcccctcacctcccggaccgggcggctggctgggcggggggctgacccccccacctccctcccggacggggcggctggctgagcggggggctgacccccccacctccctcctggacggggcggctggcctggcgggggctgacccccacctccctcccggatggggtggctgccgggcggagacgctcctcacttcccagacggggtggctgctgggcggaggggctcctcacttctcagatggggcagttgccgggcggagggtctcctcacttctcagatggggcggccgggcagagacgctcctcacctcccagacggggtcgcggccgggcagaggcgctcctcacatcccagacggggcggcggggcagaggtgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagagcggctcctcacgtcccagacgatgggcggccgggcagagacactcctcacttcccagacggggtggcggccgggcagaggctgcaatctcggcactttgggaggccaaggcaggcggctgggaggtggaggttgtagcgagccgcgatcacgccactgcactccagcctgggcaccattgagcactgagtgaaccagactccgtctgcaaacccggcacctcgggaggccgaggctggcagatcactcgcggttaggagctggagaccagcccggccaacacagcgaaaccccgtctccacgaaaaaagtatgaaaaccagtcaggtgtggcagcgcgcgcctgcaatcgcaggcactcggcaggctgaggcaggagaatcaggcagggaggttgcagtgagccgagatggcagcagtacagtccagcttcggctcggcattagagggagaccgtggaaagagagggagagggggaccgtggggagagggagagggagagggagagggagagagcaggaacattcttaagactgtctccaactgcagcattgaactcttactgttcattttttcaataaatgtttattaggtgcctactctgtgcaagtactgctcaagctgctggaatgacagcagtgaaccaggtctgtcataatagctaacatttactgaatgcttactgtgtgctttacatgtattaagttgttgaattctcgaaacaaccctctgaaacagatgatgttatgatctctgttttacagataaggaaactgaggcacagagattaaatagcttgccaaggccacacagctagcaagcagcagagataggaatcaaatccagacagtcttgctcttgagtctgtttaaaaaaaactgtagagacaggggtcttgctgtgttacccaggctggactggaacttgagtctgtttttaaccattatgcctccctgttctcatggagcttatgttctggaagtgggagactgacagtaaataagtaaacaaagaaaatagagaccaagtagcaataggtggtaccaattgagtatcccttatcagaaatgcttaggaccggaagtgtttcggatttcggaatttttggattttggaatattagcatatatgtaatgagatatcttggggatgggactcaggtttaaacatgacattcatttatgtttcatctataacttgtacacatagcctgaagttaattttattaatattttaaataattttgtgcatgaaacaaagtttgtgtacaatataccattagaaagcaaaggtgtcactatctcagccacccatgtggacaatctgtgatcgacctaaccattgttcctgactctgaatttatatgctactggtaagcaatcattttcttgcacttattcacataactgtaaattttaatcaattaaaaaacatgacataccattaatacagtgaaaaaacaaggtgttcagggtagcaagcagtacagtagcatcaccagagttccttttttagctgttaaaccacagcaacaaacaacagcaagttttcagtctctacttatgatactgtgttttgattaaaagattactatatactatattttatgtttttaggtgaaaagaaacattagaagtaggtcctgtagggatgaggaggcattctgctgtatggctttttaaaatgtcttttctaggccaggcgtgatggctcatgtctgtagtcccagcactttgggaggccgaggcaggaggattgcttgagctcacgaggttgagaccagcctgggcaacatagcaagacctcgtctctcctaaacatttaaaaaaaaattagctgggcgtggtggcacacacctgtagtcccagctacttgggatgctgaggtgggaggattgattgagcccagaaatttgaggctgcagtgagctatgttaacaccactgtactctagcctgggtgatagagcaagaccctgtatcgaaaaaaaaccctgaagtttcctctacagtcttctgcctcattaacaatggttttttcttagaagtctctctttgatattttggacagatatgatgtcttgttctgttatgaatgcacgcaggtacattgcagctgaagggagctgggagggcctttttttcccccttagggatgctgaataaactgttgtgtgcctgcattttgattgcaacccatcacatgaggtcggggtggaatttctcaactcgtggcatcatgttagcactctaaaagtttcagattttggagcatttgaggttttagattttcaaattaggaatgctcaacctgtctgataacatataaaacaagggattgtgatacagagggactggcagagggtagcattagttggggtggtcaatgtttatgagcaccaagtgagataagttatagttttttttttttttttaaacagccttactctgttgcacaggctggagtgtagtggtgtgatctagtgtcagcccccagagtagctgggactgcaggtgtgcaccaccacacctggcttttttttgtgtgtgtgtcttttgtaaagatggcattttaccatgttgcccaggctggtcttgaactactgggcttgagcaatccccctgcgttggcctcccaaatgcgggattacaggcatgagccaccacgcttggctgagttctttaagaattaattacttagagtattgctgtctctgcagatttgcaaaatgccctttctatgatttgatttataatgctactcccacacgttttaatattactaataaaaagcaggaatagttcatgtgcactggtgtcttactgtgtatgagggactatactaagcaatttatatagattgtttcattttatgctcatagcaatgctataacaattcttttctttttcagtcatggaaaactaaagcttaaggagacaagtgacaggcccagggctttaaatttagcaagtggcagagccaggatttgaacagaggtagcctgattccagaaccactgctgttaaatacttaactattttattgatgaagtgatatgtgcaaggtaattctttttataaaaaatagctgacttttatagagatttaaaatattgtaagcattactgggtcttcacagtaacagtgaagcttacctatattttggaggcttcaagacaggacataaacaatacattttgagtaaagaagcttctagggttgtatgattttatcaccccaaattagcaattttgttcatatgaactaagatgcgtaagattctttagcacaaagccagagccaggatttgacaccaggccagttgacttaagatgtagagctgttacccattccactgcagagtaaatgataacatgtagcttatctttgttcaaggtactgtgggaagccaatctagtgaaattacattttaacagtccccaaggaatgtttgttaaataatttttagttttttaaaacttctaaatttctcaaaacaaaagctgagtgaagacagttttattttacagacttggagacagtatggagcagtggcccagagtgagagttcttgggtcagattgtctggtggcttacgctaattttcacttcttgatttaactgattcaagtattaatataattttgaacaggcaaccttgccctccaagtcttagttcccttaattgtgaaagaagctaatatagtatcttcctcataggataagtatgaggactaaatgagacaacctctctacaaagtgcaaggcatggtgccttttggccagccatctcttctcttggaaatggacccctcattcatcattcatgaatccaaagtgaagttttggctccattgccttggttttatcagtgcctgaagtattcttctgacaaatagtgtgcatgaacttagagtatagactttcctgacatatttttgttgctcactttcaagttttaaaaacttacagtaaaatacacataccataaaatttaccatttaaaccatgtttaactataccagttctatggcattaagtatagccatactgttgtgcaaccatcactaccatccacctccagaactttcttcatcttcccaaactgaaactctatacccattaaacaacactagtggcagtttttgcttattattcttagctttgtgaccaaggctgctagttaggagaaatgttactctgtttgtacaaagaaagactttgaaagaaatgtgattagaaatctatattatcccaaaagcataatccataaatgaaaaaatggatatactggacttaattaaaatgaaagcttttgctctgtgaaagaaagtgaaaagacaagccataaactaggagaagatattttaaatcaaatttttgtttaagagatgcagtctgtgttctccaggctggacttgaactcctggcctcaagccatcctcttaccacagcctcctgaatagctgggactacaagtatgtgccactgtgcccagctgcaaatcacatttttgacaaagacttgtatccataataaacttttaaaagcctccaaatttaacaatgaggaaacaaccaaataacaaaatgggtaaaagatgtgaataggcacttcacctagaagatatgaaaatagcaaataaaggaaatgcagattaggcagatgaaaattaaaaccaaaataacaattataacaaatgtaccactctggtatgtgatgttgctaacgagggaggttgtatgtatatggtggtaggaggtatttgtgaaatctctgtactttctgcccaattttgttgtgatcctaaacatcatctataaataaaattaaagtgagataccactgtacacttaaagcggaaataccagttgttggcaagtgtgcagagcaactggaacttttatacgtttctgatgggaatacaaaatgatactgccactttggaaaacagtttgccagcagtttcttatgaaattaaacctgtatctccaatatgactcagcaatcctacttctagatatctctccaagagaaatgaaaacctgtgtttacacaaaaacctgtatatcaatgtttatagtagcattgttcagcattagtcactaaaaattggaaacaacccagttctttcaactggtgaaaaagatgaatagattgttgtatttttataccatggaatatactccttgattcgtgcaataacagattaatcttaaaatgcattttgctaggtgaaagacaccagatacaaaaggctatgtatcatttcatttatccacttatatgaataatcattccatttatataaaaatctgaaaaagcaaaactatagggaggaaaacagtggatgccagggtttgggggtatagggaagtattggttataaaataaaggcatggcatgagggattttggaggtgatgggatggttctctctctctctctctctctcacacacacacacacacacacacatacacacacacacacaccccactacccctctctctctcgccaattgtcaccaaattgatgggcatgttgtcagtgttaatatttggtctggtgtactaattaccacccctcccaaaatctatattatcagcttggtagcatatatagtacaatttcattaaagaaaataaatgatgatttattaactaatatgtcacatgaaaagtcatagaatgtgtattttagtttaaaaatatgggtatggatatacacacacacatttatttatcgtaagcgtcttactttactggaatttgctggttataccagataaactttttccactgcttgagctttcagtagaccattgtgcaagttaatgataaatttcgtgagcataacacctacttaagtttctcagaatctgttacagaaaagcatttatcttgcggttcaggcagcctgggatggaaggtaaatgctttctttttataagtatcctgaaatttcaagtgtaatagggaacaagatattaacataaattttcaaaaggcctcattcagttctagttccttttttttctttacaaacttaaatctcttcataaccatcagatgccataccacccttgtgaaacagtctgctagaactagacatgtctcaggattcttagaggactggggtaaccaaagtgggatttgaacttgtttgaggaatatacatgggtagtgagctgaaccttttaattcctagaatttatgggtttaacactacaagggttgtcaccctgtttatttctgtaaataattaaggcatgtttattgtagaaaacttcacaatgcacagcacagattataagagtactaccaggattattactcctaagataactgtttatttagttttccaaactttgctacgtaggtatatacatgtgtgtctgtccatgtctccttttaaaaacaacaaaaaaacctcattttaatattcaatatattattgactgtctttgtatgtgagaaaatttaaatataatagttgtgtattctactgaatatatggaatattatttattttaccaattcccattttattagtcttttaacttatatccacttattttggctgggcgtggtggctcacacctgtaatcctagcactttgggaggccgaggcaagtggacaacttcagtccaggagttcgagatcagcctggccaacatggcaaaaccctgtctctactaaaaatacaaagaattagctgggtgtggtggtgtgtgcttgtaatcccagctactcaggaggctgaggcacgagaattacttgaacttgggaggcggaagttgcagtgaactgagattgcaccactgcactccagcctgggtgacagagcaagacactgtctcaaaaaaaaaaaaagtacatatatccacttatttttgctctgatgaatattcctatattagtatctttgagtatctttccattatccctccatttatttccttaggatatattcctgaaagcagtatggccgggtcagagagtggcactttttaaaaacttattttttattatcaaagtagtatatatgctcatagtaatgagaagacacaaggtgcaaaaaggtacaaggtaaacagaaaatgctctgacttaacagttcccctctcagaggaactgtaaaataaacagatatacatttacattaatttatacattctatagaaaattcatgtgtgttagatgatatatttgttttcttgaaacatccactctaattacagagtttactaaggttacagagttaatatagagaggtattagagagtttaataaggttggcagttaaatatatcaaaattatgcagttatacaattatatcacatatacaccaacaataatcatctagacaatataatgaaaaaagctcttattcgtatatatcttcttattaagtttattccttagtatttttttttgttttttgggggggaccccccaaaaacaaaaaaatactaaggaataaatttaagaaatgtgcagtaagattcaatattgtaaaaagaggttaactctatttaagttagtctataaatttaagagattttgatggagggaggatctgacacaatgatgttaaggttcatatgaaagagtaaatatttgaaaacacacagagaaattctgaaaaagaaggatgacaagggggatgtgccttattagacaaaaaaatgcattaaaatgtacaacaattttaaaaagtaacattgtacctaatatattgtacacttaaatatgtgttaagagggtaactctcatggtaagtgtttttactccaataaataaaattttaaagaatttcttcatcccccctccaaaagtactggcaccaaaatagaataacaaatcaatgcaagaaaacatccagaaagagacccccaaataaaaatttagtatactgtatatttaatagtggtagcttttcaggtagatgaggaaagagtggcttacttaacaaatggcattgggacaatcagttaatgattttgaagaaaaaaagttagtttcttatgttatatacttaaactaaaataaattctagatgagttaaggatgtaaatgtaaagtacaaaaggtactagaagagagtgtaagttgaggtaaggaaggccttccaaagcctgacaccaaaggcatggtacttaaaaattaaaaaaccccacaaacagataaaagataaacaagaaacttaaaaaagactaacaatatgtgacaggtaaatgatgaatatctttaatatgcaaagatctcttacctatctgtaacaaaaaaggtaaacacccaaaataaaaatgcacaatggaagtaaacaggcagttcacaaatgaagaatacaaatggtcaaaaaatctcacaaagttattggagataaaaaacagatgatcatttttcacataacagattgacaaagcttaaaaagaattttcatagtacctgataaaagtgtggctagacactttcctatactgctagtgtaagtgtgaaatgatatctttccagagggtaatttacagtatgtatcacaagccttaagaagtactatttatatttagaacatgtggaaaaataaaaaataaataagtactatttatatatgttgttagtgggtatataaattgatacagtttttctggagggcagtttggaactatttatcaaagtttagaatgtacatgccctttgtcctagcaataacacttccaggaattttatctaaaagatatgctcatgaagatgtatatacaaggatattcattgaagcagggtttataatagcacaaaactgaaaacaacctaaatgttaatcaaaaaggaactaattaaataaaatatagcatatccacataagggaatattacaaccattttataaaatggtacgtttatctatcttctttggggatagttcagttttgttttttattgtggaggtctatatgtccttaaaatttttttttctttttaataattagagatgaggtctcactatgttgcccaggctggtcttgaactcctggcctcaagtgatccttggcttctcaaagtgctgcgattacaggcatgagtcactgcacctggcaggaggtttatatgtcttgatacaaggtgtaaaagatatgttaaatggaaaatgcaaggtgcaaaatagtacatatagtatgatcccatgtgtgtaaagaagaaaaaatagggaagatgggcattacagaggctttaaaatgcactgggaataataaagttttcatttttatctttagagtatagttcatgagtgaattcttttccattttttttcccagttatcttaaaagctctgttgattgtggatctgagaactaacatcacatgttataaaatccaaatagaaaatatatttaaattattagacaatttaaagcttatgagaacataagaataaaattactgcattcctttgcttattaattaagtatatcacactaacagaatttatttctgtgggaacaatgttaactcataggacccagatggaaatgatatgccagggtagagattcagatctttgagccttttgagtagatttttctcagaaaaagaaagatgttctctcaggtttactatttttaggcagattgagatgaccatattgtcttagttatccaggcagtctgacctctaagacctctaacgttattttgcccaatgcagattgattggtatttgttgttgttggattgagtctaaaaaagaatattttctcaactccaaaccatcatattatcttctaatatcaaaatcttcatttaacatactaacctctgtaattgctcatccatggggttttaatgtaacttacccatgtcttgttcctaatttgataaattttctatattactagttttggagtagaagatttaattcaaatgttacaaattcctttgtcctaaatctatccccaaagtcagaacaggacatgctgttttcctcaaccagtttaggaactccttttttttttgcggggggggtaggggagcggacagcatctagctctgttacccaggctggagtgcagtggggcgagcatggcttactgcagccttgaccgggtcccaagtgatcctcctgtctcagcctcctgtgtagctgggaccacagtcacgtgccactatgactggctaattttttttattttttgtagagacgagggtctcattttgttgtccaggctggtcttgaacacctgtgctcaagcagtcctctcaccttggcctcccaaagtgttgggattacaggcatgagccaccgcatccagccctctttctctgaaagtattattttcttttcacaaatggatttttctagcttttgttttttgtttatttatttattttttgagacacagtcttgctctgtcacccaggctggagagcagtggcatgatctcggctgactgcaaacaccacctcccagtttcaagcgattcttgattctcgtgcctcagtctcctgagtagctgggattacaggcaagcaccaccacacctggcaactttttgtatttttttagtagcaacggggtttcaccatggccaggctggtctcgaactcctgacctcaggtgatccacctgtgttggggcctcccaaagtgctgggattacaggcatgagtcaatgtgccctgcctttctaagcttttaaactaattatagtgagacttgttggtgctgctttttaaaaattatccttttatgattgaagaaaactgtctgattttctttttgattctcttataaatttaagattaatcttacagatttgaaaattaaagaatcacattctgctaattattttagtgcccagcactaaaagaattccttttttggtatgttttctgtcagccctctcttactgttgttttcttcacttccttaattgcagtttcctctttgttatctttaacctttgctcatttctgcctttaaacaggaactgtatatgacctgcttaatcttgggtttgggaaaaagctatctacaaatgtccaaagctatagaagacaataaatgcatccaattcagacaaagaaaatgtttggctaatttcagcattttcttaattattttcctgaataataaagtaatacatgcaaaaaataaaaataagaaattaaaaaaataaaaaatacatgcttgttttaatgaaactaaagtaatatagaattacataaagtaaaaagatagtcactccctcaaagggtaatcactattaatagcttgtattcttctagaccctttactagtcacagatatgcttccatgtcagtatatgcagatttagcttcttgttcttaactgctgtatagtattctatagtatggatgcaccataatttatttatctattccctaattgataggcatttagagagtctccaaattttaactattttagatatgcttatacctataactttatacatctgtgtaagtatttttgtagctagattcttttaagtaaaattgctgggtcaagttaggtacacatcatatgttgataagtattgcaaatttgcctttcaaaaaaggccgtagtgatttacacttcattaacagtatgataaaatatttttctatacccttgaccatgcttaatagatacataagtcttttaaatttttgccaacattataagaaaaaaacacgatgtcattgttttagtttgtatttaaatttctcaaatttgtgtttttaactagtttagttgaacatcttgtaacaactacattatatgtcaaataaaaaagtttgtaaattagagcatatgctataaaccttcagcaagaaaaaagtgtacacagaagaaagtttgtaattgtttatccctctttttctgcatatgtttgggataaagtaacataatatatgaactgatcatcttttcaggtgcctataaagaactcccaactggtagactttagcatctgttgggatgataggccaagtgatatttttaatttaaaatttttttagagacagggtctctagctcaggctggagtgcagtgacatgatcatagctcaccgtaacctcgaactcctgggctcaggtgatccttcctcagcctctggagtagttgggactacaggtgcactaccacgctcagataattttttttaaaaagtttatttaaagacgggacctttctgtgttgcccaggctgatcttgaatgccaatcctctagtgatcctcctgtgcccggccccaagtggctcttttctaccctgctctctcacttgttgtctggctgaacaggctcaagtctgccagtgaaagtgacttagctttgtggacagttgtgtcattcctcagtatggtatgtatgtatgtatgtatgtatgtgtgtatttatttatttatttatttatttatttatttgtgatggagtcttgctcttgttgcccaggctggagtgcactggcacaatcttggctcactgcaacctctgcctcccaggttcaagcaattctcttgcctctgcctcccaagtagctgggattacaggcgcctgccaccacacccagctaatttttgtatttttaattgaaatggagtttcaccatgttggccaggctggtcttgaattcctgacctcaggtgatctgcctgcctcagcctcagcctcccaaagtgctgggactacaggcataagccaccacgcctggccgaggatgttatttaatgttttgttttgttttgttttattgagataagatctgactctgtcacccaggctggagtgcagtggtgacattttggctcactgcaaccactgcctgcctggctcaggtgatcctcccacctcagcctcctgaatagctgggaccacagtcattcactaccacacccaactaacttttttgtattttttgtagaggcggtgtttcgccatgttgccccggctggtctcaaattcccagactcaagcgatctgcccactttggcctcccaaagtgctgggtttacaggtgtgagccactatgcctggcctggcaattatctttgactttataaatctttcttatattttagataactgatatagctcactactatttaatgtttatctgccttgataactctttatgttgtgtttataggccagagtccctgtagacacatgtactaattgaccagaattacacaataaaattgcagagctacatagtagcagaatagtaatttgccaaattattttaataggtcaatactgaaaggataatattatttgctgacttttattaagacctatattaagattctatagtgttatatttctaaggttacaagtttttttcaagaataaaaatatatgtttaattatgagttttactgttcatccaaaggtgtaacataaaataaatttacaggtgggataagatggattgagttacaattttttaacctcaggatctttgatggctagttcctacccctaaggtcatcttatgtgttcatatgcggtaatgcttttttcattagattttgcatttcaatcacagacatatttgtcaaaaaagatgaggtaggctggacactgtgactcacacctgtaatcacagcactttgggagacctaagtgtgaggactgcttgagtccaggaatttgatgccagcctgggcaacatagtgagaccccatctctacaaacaaatccaaaacttagcaaggtgttggtggcacgtgtctgtaatcccagctactcaggaggctgaggcaggagaatcacttgaacccgggaggcagatcgcagtgagccgagattgcgccattgcactccagcctgggtgacagggcgagactctgtctcaaaaaaaaaaaaaaaaaattccatttccttttttatatccattctaaaaataagcatatgatgagccaagaacatccactaatgaccagttgttacatccttttatcttgatccctttgaactcattccaagttattgtactaacctattaagctgattgttcatgaaatagaaatcaaagccaattatttcacatttaaagtatatataacaaccagttcttgccagaaaatcagaagagagggcaaagtcaagaaaaattataaaaatacattacaaatgaaataaaataacaaggaaatgactgacaatgaaatgtatctttccatttattcatagttaattttgattcttcaattcttcattgaaatttctgaaatataaaaaataagtgtattaccacttcacatccactaggatggctattactaaaaaaaaaaaaaaaaaaaaacctcagaaaatatcaagtgttggcgagaaactggaactcttgtgcattgttgataaaatgtaaaatggtccagtcatggtggaaaacagtatggtggttcctaaaaatattaaatatagaattaccacatgatctagcagctccacttctggacgtatacccaaaacaatttgaagtagggatttcaacagatatttgtataccagtgttcattgcagcattattcatagtagcccaaaggtggtagcagcccaaatgtccatcaacagatgaatgaataaacacaatgtggtatgaatatgtatatatgatataatagaacattagctttaaaaaggaattaaattctgacacatgatactacatgggtgaactttgaatgtgttatgctaaatgaaataagccagccacaataggacaaatattatatgagtttacttatgtggagtacctagagtagttaaaatcatagagatataaagtagtaccgtggttaccagggtctgaaggggagggagaatagggagttattttttaataggtacaaaatttgaatttgggaagatgaaaaagttctgaagacagatggtggcgatggttgcacaacaatatgcatgtacttaattccactaaattttacatataaaaatggttaaaatggtaaattttatgttattgtgtattttaccacatttttttttttttgagacagagtcttgctcttgtagcccagactggagggcaatggcacaatcttggctcactgcaacctccgtctcccgggttcaagtgattctcctgcctcagcctcctgagtagctgggattacaggcgcccatcaccacacctggctaatttttgtatttttagtagagacgggtttcgccatgttggccaggctggtctcgaactcctgacctcgtgatctgtccgcctcggcctcccaaaatgctgggattacaggcatgagccaccatgcctggccaatttttttttttttttttttgcgacagagtttcgctcttgttgcccaagctggagtgcaatggtgcgatctcagctcactgcaacctctgtctcctgggttcaagcgattctcctgcctcagcctcctgagtagctgggattacaggtgtgtgccaccacacccagctaattttttgtatttttagtagaaacggggttttaccatgttagccaggctggtttggaactcctgacctcaggtgatcgccctcttcagcctcccagagtgctgggattacaggcgtgagccaccatgcctggccattttaccacaatttaaaaatatttatttatttatttatttatttatttatttatttatttattcattcattcattcattcattcgttcattcattcattcattcaagacggagtcttgctctgtcacccaggctggagtgcagttgcacgatctcgactcactgcaagctccacctcccaggttcatgccattcttctgcctcagcctcctgtaatggctggaactacaggcgcccatcactacgccccgctaatgtttttgtatttttagtagacggggtttcaccgtgttagccaggaaggtctcgatctcctgacctcgtgatccgcctgccttggcctcccaaagtgctgggattacaggcgtgagccaccgcgcctggctaaaaagtcttttaaaaaagtgtctgcctttctcagaaaatagtcattttgctatagcccatacatattttgagagaaaagacaaatgttgtataaaactgtgtgtgaggaaaatcatctctgacttccactgagtattctgaatggcagcaacttaaagaatagcagcaaaacctaatggacatatccatttataataggacattgcagccatggctttatagggcaaacactggggaaaatgcaatgatgggaagaacaaagtggacgtcggtagttttttcttctttgttctgtgatatggtccagactctttcctcacagacaatggaaacatggtagaaactctctaccatggtcggtcagttgaagaagggaatcgtaaaaattatgtaaatatagcctagtcatttttttaaacctaaaacatgttcatttattctccaatatttatttgtatttattttatttttatttttattctggagacggagtcttgctttgtcgcccaggctggagtacagtggtgtgatcttggctcactgcaacctccgcctcccgggttcaagcaattcttctgcctcagcctcccgagtagctgggaccacagacgcatgccgccacactcagctcattgtttgtattttaatagagacagggttcaccgtgttgcccagactggtttcgaactcctgagctcaggcagtctgccaccttggcctcccaaaatgctaggattacaggcgtgagccactgcgcccggccttattctccaatatttatatgtagggccacaaccttttctttgcatgtgggtcctttggaattcttcctttccttccctgtataaaccacacccataatgcttcattccagatttctatctcctagtttggttttattaaaatagagaacaaatttaagagatgagagttcttttaggtttttattattaccccccaatctcttaaagtcgcttcacgtacagctattttagcagtaactttgctactcaccttattgaacattcctaatgcattcaactttgttttcatagaaagaacaactctcctttttgctgttatttaatcaacgtacataatatttaattaaatcacttggccatgagaagttcagtggacataaacagcttgagggcaaacacagctgaatttctatatgccaacaattctactggtgggaacaaggagtgtgcatctaagtactaagcatgctatgggcatctgaatattttagtgatagaaaagagaccatcagttaacccattggaggttggttaagataaatttttgcagggtaaaatttgctttttcttaatgtatcctaacatttttcttgtatgaaaatagagatctacatcattgtttttaagggacacatggtatttattatacatgcattaggctgggttcttacttgaagacaacataaagcagttctgactcgcttaaccagaaacggaatttattggttaggctatttggattgtttatagagacaacagaagtcaatcagagtcaaccaggcttggaaaataggtaggaacacaatgagactaaaacaggccaaggacatgccccaggaagtctagtgaggacctcttcactggcactggctttctcaggacttttgccagggccacttctggcatcttgactgtattgctgcctgtgctgagaattatcttcatctgtccttgtgtattcatgtcactttctcatgattcaaaatcctgggcagaagtgtctgactagccaagtctagaatcatttagaagcatctcagcttcaaggggacagggaaaaggaatatctgtctcctcccttctcccttcctcccacaacacacatgctttggctttaataatgggagccagggttgtactgtttatttctaagacgcttgcggtgggggcattttcttggcatgggatgtgtgtttgaatgctgggtagccaaaaatatgacaagtgttacactgtgatgcactagagtttatttaattaatatcctattataaaaaatttagatcgtttccagttttgttctgttttaagccacatagtaatggacacatgtgagcaatctactgggggaatgaggtatcttagctgttttaattaattattttaatttttaattttagctgttttaatttagattttaaaagttattagtgaggtgcagtaacttcatgtgtattggcattttggttttcttattttgtcaattgtctggcatatatattttttgagatataatttaacataccataaattcattaataaaaaaatgtcgtccaggcgcagtggctcacgcctgtaatcccagcattttgggaggccgaggcaggcagatcacaaggtcaggagatcgagaccatcctggccaacatggtgaaaccctgtctctactaaaaatacaaaaattagcccggtgtggaggcgcatacatatagtcccagctacttgggaggctgaggcaggagaatcacttgaacccgagaggtggaggttgcagtgagccaagatcacgccactgcactccagcctggtaacagagtgagactctgtctcaaaaaagaaaaaaattaaaaaaaatttaaaaaagtcaaattcagcgatttctagtatgttcacagacttgtgcaactatcatcactatctaattacagaatatttttattaatacaaaaagaaattccatgtatatgtttttgcagtttgtttacatggtggtttttgccacacaaaattttaaaatttcatttaattacattttaatctcttttcctttacagtttctgttttggcttatgcttagaaatgctttccccacccaatgttttgttgttgttaggtaatgcttatttttatattttcctagtattttttactttttatttttacatcttgttctttaacttggaattaatttatagattgtaagatggtttctaaaaatgttcacaattattaaatggttagcgtattatcccagcactacttactgattttctcagtgatgtgaattgctgcccttgttatatactgaattcttatatacacacatatgtacgtttctggaactttctgttctgttgcaaggatctttctattctgacatcagcacaagacctttttttttttttttgagatggagtctcgctctgtcacccaggctggagtgccatggtgcaatcttggctcactgcaccctctgcctcccaggttcaagtgattctcctgcctcagccttccaagtagcttggactacaagcatgcaccaccatgcccagctaatttttgtatttttttagtagagacgggtttcgccatgttggccaggctggtctcaaactcctgacctcaggtgatccgcctgccttggcctcccgaagtgctgggattataggcgtgagtcactgtgcctggccaatactttttttaatagacaattttttagagtaattttaggtccacagcaaaattgaacagaaggtacagtatgtagccttttcagattggcttctttcacttagtaatgcacatataagtttcctccaagtttttttatgaatagctcatctttaatgtgtgtgctgaataatatttgattgccttgctgcaccacagtttatttatccattcacctactaaagggtatcttggttgcttccaagtgtcagcaattatgaataaagttgctgtaaacatctgtgtgcagttttggtgtagacataagttttcaactgttgtgggcaaataccaaggagtgcaattgctggattgtatggtaaattatatttagttttgtaagtaactgcccaactgtcttccaaagtggctgtactattttgcatttccactagcattaaatgagcattcctattgctccacatcctctttagcatttggtgttgtcagtgttctggattttggccattctactaataatagatatgtagtagtgtctcatcattgttttaatttgcatttccctgatgacgtatgatgtggggcatcttttcatatgcttatatattatctgtatatcttctttggtgaattgtcttttaaggtccttagcccataacatcaggttgttttcttagcacaagactttttaataattaaaacttttaaagactctttaatgtctggttgggtaattagcatttagcatcattattttttagtaatgacttttataaaattaatggtatacttgaaatgtttggccaaactgagttgtccttttcagcctcaccaaacttttattgttttcttgtagtttattcttaacaagttatgataaatataaaataagtgttttttctttttccttttttttttttttgatagtcttgctctgttgtccaggctggagtgcagtggcatgaacttggctcattgcaacctctgcctcctgggctcaagccgtcctcccacctaagcctcctgagtagctgggactacaggagtgtgccaccgtggtcagctaatttttgcattttttgtggagacacagtttcactatgtttcccaggctggtctcgaactcctgggctcaagcaatccgcccatctcgacctcccaaagtgctgggattacaggcgtgagccaccatgtctagcctgttttttcaacttattctacataagtggttaaatactgacagttattttcgttttcataggcatttaatgttttcgcatttgttggttttggcactattttgtcttagaagtaaatttgtcttagaagaaagcaataacattacaggcagttcttgatttagacatagattgtgtctgacaagttgaatcagatgatttaaaaataaattttcttaatatttttatattcgggggtacatgtgcttgtttgttacatgggtattacatgtgtaatcaggtgattgttttgatgagggagaggaggcattccaatcaccaaatagccttcatagactcaaagattcctgcaccaagaccatatttaacacataacattgttgaaaagtagctgactcatttgtaatttcaagtagttgaattctacttccccctaccttcctgagataatgatagctgccttgcaagaaaagttccacacacactaaaaacatgtttctaccttttgtctattattgacatggcagcaattgcttagcccctgttggaaaggcacatatatacttgaggcatatttctcacttttggggaacctgtctctacctgtgtttattgcagggtattggtatttttcaagcattctctccacaccactctcacctttggctggttttactttatgacttttgcacacattgccctgttaagttaatccttttgaggttattgttagctttggactccagcctgaattggctgtatgaacatagacaagtctcagctttagcttccttaattttaaaaggaggttatgattctatttacgtagcaggattggtgtgagacacatgcagtgctataggaatctgaagcatctgtattgttatcataggacaacttatttgtagagatgctatgactactctaggagtcacaaaaatgaccagtgaagtacattgccttttaatttgaatgttctgttcttttttgaccttattactgtgtttaagtattactacctaatcttttaggaatggtcaaataaaaaaaactgttatttattttattttttttcctgagatggagtctcactctgtcacccaggctggggtgcagtggcgtgatttcagctcactgcaacctctgcctcccgggttcaagcgattcttctgcctctgcctcactctccgagtagctggattgcaggcgtgtgccaccatgcccggctaatttttgtatttttagtagagacgggatttcaccatattggccaggctagtctcgaactcctgacctcattatctgcccaccttggcctcccaaagttctaggattacaggcgtgagcaactgtgcctggcaaacatacacctgcctacttcagttgtttcatctggaatcttagtcctctgtttatataatactggttgtttgatgaaagaaattagacacttagtattttggaaacaagttaagtaataagattaattttcattttaaaggtttatacaatttaaaagaaaaggatgaattatataaaataatagagaagctaatgctttccccttttgttttcattttagaatgtggtagcaattttaaataaaagtgaatgggtaggaaaaaaattaattgatctggaaatactatatagataccttgaaggcaactagttgattgttatttgcatagctagaaatcatctatttatttaataaaataagcacgtttttatagccttggtataataaaatgggttatttgggctttttatatatatgaatttatcattggtcttacttattgaattatttcagtttcagtaacttttctcttaatttctacgtactttgtattttttttctttttcatttcccattaaaatgagttggctttatgagatgaaataatttaggcctacaatgagtataggtagtcctatgacatacctgtgtatttactacccagcctaagaagttaaacattaaatatatagttgcatttcccctttgtgctcctctcaagtcactcctctcccctctctcccctcaatctgttgaatttggagtttatcatgtctgtgcacatttttatatttttactatcacaactatatatgtgtgcatacaaaaacaatgtataacattgttttatgtttttaaacctttgtatcctttttttggacataacatcaacattttattttattttttattcataagcattgttttcttttgtcttgcatattttaaaatgtattagatggtatcaaactatcactttgtcatttgcatttttcttagaacattgttttcttagaacaatgtttcttagaacatttttcttagaacattgttttcttagaacatgcatttatttatcaacatatattgatacataaaaatacttctagttcatttgtttttaaaattattttgtggcacattataattattcatatttatggggtacaatttgatgttttgatacatctacatgttgtacaatgatcaaatcagggtatttagcatatctatcacctcatacatttatcagtgctttgtgatgagaacattcaaaagcctctcatccagctattttgtaatgtacaataccttactgttaacaatcctcaacctactgtgcaataaaaacaccagaacttattccttctatctaaatgtgaccttgtagccatttaccagactctttccatccttccctccccagtctctggtaaccactgttctactctatgacatcaaccattttttttttttttttgaaattccacatgagcaagatcatgtggtatttgtctttctgtgtctggcttacttcacttaacatgatgtcttccaggtccatccatgttgtcacagatggcagaattttattcttttttatggctgaatagtattccatgtatatatatacaccacattttgtttatgcatttatccattgtcggacatggattgattccatattttggctattgcaaatactgctgcaataaacatggcaatgcagataatctcttcaacataccaatttcatttcctttgaataaatacccagtagtgggattgctggatcatatggtagttcaattttcaattttttgaggaatcaccatactgtttcccatagtggctatactaatttacaatcccaccaactgtgtataagggttcccttttctccatatcatcaccacccctcttttcttttgttattttgataataactggagtgagttggtatctccttgtggttttcatttgcattttcctggtgatcagtggtatggattgcatctgtgtcctggccaaatctcatgttgaaatgtaatccccagtgttggaggtggagcctagtgggaagtgtttggaacatggaggcatatccctcattaatggctttgcactatccccttggtgatgagtgagttcacatgagatctggttgtttaaaagtgtgtggcacctcccattctgtctctcttgctcccacatcaccttccaccatgaacaaaagctccttgaggcttcactggaagctgagcagatactgacaccatacttgtacagcctgcagaactgtgagtcaattaaaccttttttctttatcaattacccagtctcctttctttctttctttctttctttctttctttctttctttctttctttctttctttctttctctttctttcttttttttttttttaactgacacagggtcttgctctttcacctagtctggagtgcagtggcccagtcacagctcactacagccttgacctcctgggcttacgtgatcctcccacctcagcccccaggtagctgggaatacaggtgtgtgccactacacctggctaatttttgtattttttgtagagactgagttttgccatgttgcccaggcttgtctcaaactccagggctcaagcattctgcctgctttggcatcccaaagtggtgggattacaggtgtgagccactgtgcctggccaggtatttctttatagcaatataagagcagcctaacacaattagtgatgttgagtgttttttcatgtgcttgttgggtatttgtatgtcttcttttgagaaatgtctattaaagtcttttggtcatttttaaaaaaatttattattatcatactttaagttttagggtacatgtgcacaacgtgcaggtttgttacatatgtatacatgtgccatgttggtgtgctgcacccattaactcgtcattggaaacaattaacaaagtaaagagacaatctacagaatgggagaaaatatttacaaactatacatttatcaaggggttaatatccagaatatataaagaacttaatgaccacaaaataacctgactaaaaaatgaccaaatgacgagtcttattttgtggttgttaagttctttatatattctggatattaaccccttgataaatgtatagtttgtaaatattttctcccattctgtagattgtctctttactttgttaattgtttcctttgctgtgtaaaagcttttcagttttatgtaatctcatttgtctacttttgcttttgttgtctgtgcttttgaggtccactcaaaacttccttgctaagcccagtgctgtaaagcatttcctgcatgtttttttttagtagtttcatagtttcagattttatatttaagcatttaatccattttgagtagatttttgtatatgatgagaggtaggggtctagtctcatttttctgcatgtggctattcagttttctcagcaccacttattgaagagagcagtgtgtgtttgttatggtttggatgtttgtcctttccaaatctcatgttgaaatgtgattcccagtgttggaggtgggacttgtgggaggcgattggatcataggggaagatccttcatgacgggtttggcaccatctccttggtgataagcaagatatggtggggggttttttttgtttgtttttgtttgtttgttagtttgtttttcaccatctcttacaggaaggagaaatctggttgtttaaaagattctggtacctccccctgtctctcttgctcattctcttgccatgtgacatgctggcataccttcgctttctgccataattgtaagcttcctgaggccctcacaagaagcaaatgccagcatcatgcttctgtatagcctgtacaaccatgagcccaaataaattctcttttctttataaattgcccagtctcaggtatttccttatagtgatgcaaaaatggactaacagtgttcttagcacctttttttgaaaatcagatggctgtaggtgcatgaatttattttagggctctattctgttccattgtgtatgtgcctgtttttataccaatactatgctgctttgattactatagccttgtagtatattttcaagtcaggtagtgtgatgcctccagccttgttctttttgcttcagattgctttggctatctggggacttttgtcattccatatgaattttagggtagttttttcctatgtgaagactgtcattgatatttttatagggattgcattaagtctatagattgctttgggtagtatggccattttaacaatattaattcttccaatccatgaacatgggatagcttttcatttgtttatgtcttcttcaatttctttcatcaatgttttatagttttttttttttttttttttggagacagagtctcactctgtcacccaggctggaatgcaatggcatgatctcagctcactgcaacctctgcctccagggttcaagtgattctcctgcctcagcctcccaagtagctaggattacaggtgtgcaccatcacactcagctaattttgtatttttagtagcgatagggtttctccatgttggccaggctggtctcgaactcctgacctcgggtgatctgctcccctcagcctcccaaggtgctgggattacaggtgtgagccaacgcacccagccagtgctttatagcttttagtgtagagatctttcacctccttggttaagtttattcctaagtatcttttttttatgtagcaattgtaaatggaatttttttttcaggtggtttgctattagcatatagaaacactactgattttaataagttgattttgtatcctgtgacttactgaatttattttttagttctgttttttagtagattctttagggttttctgtatataagatcatgccacctgcaaacagggacaatctgactttcttctgaaacttttttttctaaactatgttaatgggatttatccctgttgctacttgcagctctacttcaagctttctcattctcagtgctatagacatttggggccagatcattctttgttgtgaggggctttcttgtccattacaggataattggcagtatccatggcctctatgcactagatgccagtagtactcccttgctgcactctgagttgtgacaaccaaaagtgtctccagacattttgaaatgtcctattggtggtgacatcaccccttctctcagtgagaatcacatttctagttcattcattttaacttctatattatgtttcattataaatataccacaaccaattttttcatttccttgttgatggacatctagattatttccaaagttttaactattagcaacattgttgcaatgagcatttttgttcttgtttccttgtgcacatgtgtgagactctgtctaaggtactatgcttaggagagaaaatgttgagttttaatatatgcatattttcaactctaccggctatcatgaagcagtttccataattgtactaatttatactctaaccaacggaacaagagagatcctgtttctccatatcctcaccgacacttggtattgtcagattttgagatttttatctacctgatggaggtacattatattccttgattaccacaaggatcacaaattgtgcagatagagttgtatccaaaaaaggattaaggctgggcgtggtggctcatgcctgtaatcccagcactttgggaggttgaggcgggtggaccacttgaggtcaggagttcgagatcagcctggccaacatggtgaaaccccatatctactaaaaatacaaaaattacctggggcctggtggcatgtgcttttagtcccagctactcaggaggctgaggcaggagaatcacttgaacctgggaggtggaggttgcagtgagctgagactgctccactgcactcccgcctgagcgacagagcaagattctgtctcaagaaacaaaaacaaaagcaacagcaaaacaaaacaaaacaaaaccccaaaaaagaattaaatcttactgcatgattattgagaatacaggagcctttcccaaattataagtgctgattattttaggggaattttagaatgatgtttgagcttctgtgaccagctttaagaagtggttttgaacaatcagacttcatatgtgccatgttttctactcaatttctgtagtttctatttccaaaccagagatgatcatctagtcataatattgttcttcatcttagaaaatgatattactgatggtgattaccatctctacttagggaatggctcaaaatatattaataacttgaagttatttccctcagtgttgttggatgcttttgttctcagagtcactcatcactaacagctggatgccaaatttgtctctttgatactgtcgtttcccagaagcctacatgttttttccatactatatgaaactgtttatgatcttactctgttttctgagtcattttgctaaatgcagtaggatgttacaaaagatattcctggttttgtacctacctttaagatttaaaatgaaaacgatggacataacatatataacaaagtcaattagagttgtgtgtatatgtaataaagtagtgagagtgagatggaattcctccaaggtttcatgtgtaaagtccaatttaagtagagttttgaaaaaaaaacaatgcaggtgaattacgaaagcgaaagaaatatgtattcagaattgatatgacttaaattaagatgtagtgggaaaagtggcttaattagtataatttttgtttgtgctcacacattgtggactcctcaatacttacttcctgggtgaattatccagtgcctttctgcctgactgatctctctcagttcctcagtaagcctgagagttagtccagtgctttggtctgggacataccccatgataaaactgtatttcagtcttacattcctaaacaggtaaactagccttcacctaccaaaggtattgtattctaaaagtttgttgccaattctgtttgttgaatttgatgttttcccataaaacgatttagtcaactttggtaatcttgcaagatcagccctcaaaagccccatttgacccataagatacaggagcaagtctgagttctgtgttctggaggtagacagccaaagctataagaagaataaggaagagtttccttttttaggctcaggactatccttagataaaattttgataggatctgtttgttttagacattcttctacttccatttttatacccttgtactgcttcccactgactcctcctgggctcctaataccttcatgcttgccttaagtactccatcctggactcgccacctgaactcatcctatttgtcctttgctcccaaacttgcctttcctgtcctatctgggcttttgttctcttgtagtaactgaccttatgtaggtattaagagatataattccaactatcacccccctgattatcaaaaaagagtttatattttaaaaagaagatacactggatgttaagacaactgaccttcaaaaagtcacttcatgggggaaaagagatatggaaggagctattctagattaaatgagacaaaagagacataaaaccaaatgcaatgtgtgaaccttgtgagggtcctgaatagtaaaattggacttcttcagacttgaaaacttgtacacaaaaggacactatcaagagaatggaggatttgggtacaagcggttgaaagatggtttggctgctctggtcggattctgccgtcccagtgaggctggaaaatagggtctagaggcaggaacataaggctgattcacacttcagctatgacaggaaatatcctctcatagagcataggccaagtaaatgattttgtaactttacttcatcctctccttttacatagggtgtactccaagtagagggtatttaaactcaaaaaaactctgtaagagggccttttgagcccctgtgctcaggcctgctcccatactgtggagtgtactttcattttcaacaaatccctccattccttccttgctttgtttgtgcgttttgtccaattctttgtttaagacgccaagaacctggacaccctccactgttaacaccagcccttccctgtggctgaccctgaggtgttatgagtttcttcacagccctacttcctctctcttctccctcattttcagacccttcttcagcatcttccctgggcattgctgtgagtttaggccggcccgttttgagcaggagcagcagcggaacagtagacctgctggaggaagtggggctgcagatcagagacacagcattttcgtcaaccaaacttcttgaagccatatctacagtatcagctcaagtggaagagcttgccgtcaaatgtacggaaaatgcacgtttccttaaaacatgacgggacctcttgaaagaatgctgtgattcttggaaacctgacaattgatttggcatacttagctctttgatagtgactgtgtaataattcatacttcctcatatatgatcatttcacatgtgccacatatataggataatatctagcagttctctatatcttcagaatgaagtttttcttggttttcttgacctttgtaaaagcagaatactgattctatttttgatgttgatcagtacttgtttattcttacactttctgcccttcaaactttcataaaatcctttacaaaatttaattttatcagtagatagttaatattaattgtgccacagtgctaccagtagcaaactaagtggaccattatttgttttgcagtaagatgccaagcatggcagaattagaagttgagcttcatcttatggaccaagggagataactttaaggttccagctccattaggctgagttctctaggcaaatgattgtcttacttacttcgatatccccagcacctaaaacagtgtcacatagcattcactaaatgtttattgaaaagaagagttgattaacataatacaaagctattttttcttcctgtatttagcaggaagactataattgtttctctaaaaatgtatgaatcaggactttgttgacttgaaggaaaatgttatctttttcacagagattttaactttgatgatagcttttaaaaacatgataaatacttttgtcctcaaatgattattttaaaaagtcttttttttttgagacagagtctcattctgtctcccaggctggagtgcagtggtgcgatcttggctcactgcaatctctgcctcctgggttcaagtgattctcctgcctcagcctccctagtagctgggattacaggcgtgtgccaccatacccggctaattttttgtatttttagtagagacaaggtttcaccatattgaccaggctggtctcgaactcctgacctcaagtgatccacccgcctcggcctcccaaagtgctgggattacaggcgtgagccactgcacccagctaagaagtctttatttcagaaaatgaaagactgtctagaaagaacgaattttttttcctatttatttctatggttactgcttttacacttaatattttttgttttcggtatttttatatgtttgattgctgtctttaaagtgccttatcagatttatggctctgtactatgaattttggagctttacaagttatttacataactctaagttactttgcttccaatacatcaaatttaaataacatgattgtttttatattatttgaccttagtgacaatgtcctattttatttgttctgtatcttatgtcgctttttggtagtttgtattatgtgtgaatgattaagccaactaattctgtaccatatataacttctggatatctttgatatgacatcttaattctttgtagatatggtgatgtgtacagaatgatattctgaagctccacaatggtgcattgaaaggctgcagatggatggccaaagaatagttttgtttagcatattaggtctagttctggacttttttttttatactttaagttctggggtacatgtgcagaacatgcagttttgttacataggtatacacgtgccatggtggtttgctgcacccatcaacccatcacctacattaggtatttctcctaatgttatccctcgcctaatccccaccccccgacaggccccagtgtgtgatgcttccctccttatgtctgtgtgttctcattgttcaaatcccacttacgagtgagaacatgcagtgtttggttttctgttcatgtgatagtttgctgagaattattgtttccagcttcatccatgtccctgcaaaggacatgaactcatccttttttatggctgcggagtattccatggtgtatatgtgccacattttctttatccagtctgttattgatggacatttaggttggttccaagtctttgctattgtgaatagtgcctcaataaacatacatgtgcatgtgtctttatagtagaatgatttataatccttcgggtatatatcctgtaatgggattactgggtcaaatggtatttctagttctagatccttgaggaatcatcacactgtcttccacaatggttgaactaatttacactcccgccaacaatgtaaaagcactggacttttttttttttaagttaaaagatcacacacagggtgtgatttctataccaaagatatgcttatttcagtatgaggaaaaatatttttcttacatgtcctgaaaattgcaattttaaaaatgtacaaaataaatttttattaaaagcaaattttatttcaaaaaaaaagagtgaaagacaaccaactggataggagaaagtatttgaaagtcatatatctgataagggattaatatccaagaatataaagaactcttacaactcaacaacaacaacaaaataaccttattaaaaattgggtagagtgcttgaatagacatttcttcgaagatatacaaatacccaataagcacatgaaaagatgcttgacatcatcagtaatcagagaaatgtgaatcaaaaccacaatgagataccacttcacacctgctaggatgggtagaataaaaaagataataggtatcggaggtggaacaattggggcccttatatactgctcatgggagtataaatggtacagtcactttggaaaacagtctggcagatcctcaaacaattaaacatagagttattatatgacccagcaagtctactcttaggtattaccaaagagaaatgaaaacacaaaagtttgtacatgaatgtttatagcagcattattcataatagccaaaagatggaaacaacccaaatgttcatcaactgacaaatagataaattatggtgtatctatgcagtggaatattattcagccataaaagggaatgatgtactgatatgtgctgtaacatggatgaacactgaaaacatgctacatgaaagaagtcagtcacaaaagaccacatattacatgatttcattcatctgaaatgtccagaagaggaaaatctatacaagcaaagtagattagtggttgcccaggacagaaggcttaggaggtgatgactgataggtaaggggtatgttttgttgttgttgttgttgtttttaggtgatgaaaatgttctgaaattgcctgtggtgatggttgcacatgtctgtgaatatgctaacaactattgaattctacactttaaatgtgcgaattatataatacgtgaactacatctcaagaatgttttaaaactggtgttgggaaaacaggacatccacatgtaaaacaatgtatgtcagatccttaccatacaccatgtacaacaattaactcaaaatggattaaagacctaaatataagagccaaaactacaaaaactcttagaagaaaacatagcagtaaatattcgtaagtttgaatgtggcaatggtttcttagatatgacacaaaaaacacaaaagaaaaaagataaattggacttcacaaattaaaagcttttgtgattcaatggacaccatcaagaaagtgaaaagaatggaataccgatacattttacacatcaatgtaccttgaaaacattatgctaagtgaaagaatccagacacacaaggacacatattgaatgaatcaatttatatgaaatggccgtataggcaaatccgtagagataggaaataaaattagtgtttgccaggggctgtgagtagagaggaaatggggagtgttgctaatggacatgggatttctttttggagtaatgaaaatgttttgcaactacatagtcattatggttgcacatccttgtgaatgtactaaaaagtactgaactggataccttaaaaggctgaatttttttcatttcttctaaaaaaaaccaggatagatgtgcagaacgtgcaggtttgttacgtaggtacatgtgtgctatggtggtttgctgcatctattgacccatcctttaagtttcctcccctcacccctcaccccccagcaggctccggtgtgtgatgttcccctccctgtgtccatgtgttctcattgttcaactcccatttatgaacaagaacatgcagcatttggttctctgttcctgtgttagtctgctgaggatgatggtttccagcttcattcatatccctgcaaaggacatgatctcattcctttgtatggctgcatagtattccatggtgtatatgtaccacattttctttctccagtctatcattgatgggcatttgggttggttccaagtctttgctattgtaaatagtgctgcagtaaacatacgtgtgcatgtgtctttatagtagaatgatttatattcctctgggtatgtacccagtaatggggttgctgggtcaaatggtatttctggttctagatcctcgaggaatcgccatactgtcttccacaatagttgaactaattcacattcccaccaacagtgtaaaagcgttcctatttccccacagcctcaccagcatctattgtttcctgagtttttaataattgctattctgactggtgtgagatggtatctcattgtggttttgatttgcatttctctgatgatctgtgatgttgagctttttttcatatgtttgttggccgcataaatgtcttcttttgagaaatgtctattcatatcctttgcccactttttgatggggttgtttttttcttgtaaattgtttaagttccttgtagattctggatattagacctttgtcagatgggtagattgcaaaatgttttctcccattctgtaggttaaaaggctgaattttatagcatgtgaattatatcccaatttaaaaaagaatgcatatgtcttagttcaggcttccataacataataccatagactgggtggtctaattgttcaaagctccacagaaattagttggagaagttacaagagtccattaatcatcttgctttgttagtagcagcgggcatggttcagcattttctgcttaagtttctctgagctcaccaaaactaaaatgatgttgtaatactttttttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcactctcttctgcactgaggtgaggcagatgtcaaactcatagccagcatctcgtagcgcctgcccgccgcgcttcgcctcctcgtggcccgccgggctcagatcggcgtcgtaccagcagctgaagcggttctccaggttccatgtgctctcgccgtgccggatcagcaccagtttgtaggcggccatggcggtgggctgcaatactttttataccatttgaagtaaaaggtacaaaaggttatacgctgaaaattctttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctattggcgggaggccttaggtctttgctggtttttgacatgaggcctcagttcctcaccatatgaacctctccataaggctgcttgtatgtcttcatacttggtaggtggcttcccccagattgcgtgattcaggagagaggacaacaaggaaaacacaatgcttttttctcctcttgcaatgttttttatgacctagtcttggaagtcacaccttgtcgcttctaccgtagtctattcattagaaacaagtcattaggccaggtgtggtggctcatgcctgtaatcccagcactttgggagggcgaggcgggtggatcacttgaggtcaggtgttcgagaccagcctagtcaacatggtgaaaccttgtctctacttaaaatacaaaaaattagccgggtgtggtggcatgcgcccgtaatctcaggtactggggaggctgatgcaggagaatcacttcaacccgggaggcggaagttgcagtgaactgagatcgtgccacagcactccagcctgcgagacagaattgagtctcaaaaacaaaaacaaaaacaaaaaccaaaacaacaacaacaacaaaaaacaagaaacaagtcattaagttcaggccacaccgaaggggaaaggattaaattccacctcttgaaggaaggagtagcaaagaatttgtgggcgtattttaaaaccaccacaggaaggcagacaataagcaataaacagaataaatcagcaagttatggagtatgttagaaggtggtacgttctatgaaaacaaaagaaaaagcagaggtaaggggaatcagagtatgtttgtgtggaagggatgtaggttgcagttttaaatagggtggtcagcatagtcctcattaaggttagatttgaacaaagacttggagacaaagaagttagccaagcagttatctggaagaagaaagtcccaaagcaagagaatagctaaaataaggccttgaagtaggagtcatccttgcatgcgtaacagccaggaggccagtatgactggcacagagaagggtttggtgagtggtagaagaggaggccaggtaaacttgagggggacaggcatgggaaatcatgtgggaccttgttggctgttgtaaggatttgaggcatttttgattagttcttaattcgtacttacaaatgttaaatgagattatgtatgggaaacattagtaatcaggaaagcactctatgaaagctagttacttgtattaaagtattgaaatttttatttttagttagcatatccatagaaacaactttcctttacttcatctaaggtgataagaattttttttctaagcaggaagaatgcttaccatattttattactagcacattttaattttttaaacatgacacttgagcatatataaaatgtagcatatttttaattggggaggtgggggaaaagttgaggaaagattatttgcatggctgaaattaatgaatttattgtttctaacaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaagttactctttggaaactgaagtcaaatgccattgaagagaattctactagaaattacttctaacaatgagatagaagcagacacactgacacatttggcaataaaaactattgtacttcttatcttgaagctaaataagttttctttgacccattaattcctctcataaagaaaaaagatatattttcaatttaaaaacatctgaacatggaatcttgatattgtggttgtatatttatagatttatattttataagtatatgagtatttatatactgtttattactctgaatctcatactgaactaaaatgtatgttttcaggggatgggttagggttttctttttcttttataacatggtgattattttgcaattaaaacttgaagggaaaatgtctagagaattactagtatactttggtttttatttttagtttttttttcagacagggtcttgctctgtcacccaggctgcattgcagtggcaaaatcacagctcactgcagcctagatttcccaggctcaagcaatcctcccatctcggcctcccaagtacctaggaccacaggcgtgcaccaccatgctagctaattttttttttttaagatggagttttgctcttgctgcccaggctggagtgcagtggcacgatctcagctcaccacaacctccacctcccggttcaagcaattctcctgcctcagccttccgagtagctgggattacaggcatgcgccatcactcccagctaattttgtatttttagtagagacagggtttctccatgttggtcaggctggtcttgaactcctgacctcaggtgatctgcccacctcagccttccaaactgttgggattacaggcatgagccactgtgcccggctgcatgccagctaattttttaatttattttttgtagcgatgggggtctcactatgttgtccaggctgatctcaaactcctggactcaagtgatcctcccacctgggcctcccagagtgcggggattacaggtgtgagccaccatgcccagccaaaattactagtacaccttgtatgatatgcctaaggaagactctattattggttttttgtttgtttgtttttcagactctagggctttaagttgaagactctattgttgtttaacattacttgagcatcaacagcattctagatatactgtggttaaagatgtagttcaggttataaaaaagccttctgaatactgcatgaagtacctgtggttatcataagaaacttcatgcatatatggcagggattggaaaatggtgatctgcaggccaaacccagtttgccaactgctttcatatggctcataagctaagaatgccttttacatttttacaccattgaaaaaaattaaaaaaatatttaggaacttatgaaaagcacatgaaattcaaatttttgtgtctgtaagtaaagttttagtaatatacagttttattagaacacagccacactcattcatttacgtattgtgtacagcccttttttcactacaagagagttgaatagttgtgacagagcccatacgtggtgtcctcattggtaagtgatacactgccaaatgatttaccacagtggaaataccattttatcttcccaccagcagtgtttgtgttccactttgaaagtgttccattttctccacattccctccaacaatttgtattgtcagtcttttaaattatagacattctaatgggtgtgtaatattacatcactaattctcatttccttaatggctaatgatattgagcatcttttcatgtgtttattaggcatttgtataccttctttggtgaaatgtgtgttaaaccctttggccaaatttttagttgggttttttgttttgttgttattgaatttcttctttttcaaaattgttttggttagtctaggcccttttactttccatataaattttagaatcagtttataagtttctacaaaaatatctgctgggattttcgttgagattgtgttgattctacagatccatttggacagaagtaacatcttaccaatattgagttttccaatccatgcacatagtatatgtctatttatgttggtattctttgatttcttttatcaggaatcaatagttttcagcatgcagtttctgtacatattttgttagatttatatttaagtactttatgtttttgaatgctgttataaatggtactgtttttaaattttaaatttaagtttaatttcaggtgttcattatgaggtttttatatgttgactttgtatcctggaacgtagccaaactgacttatcaaacctattagcttttttgtacatttcttgggattttctatgtaattatgtcatcaaggtatatagtttttttttttttttaagatagtctcactctgtgacccaggctggagtacagtggcacaatgttggctcactgcaacgtccacctcctgggttcaagcaattctcatgcctcagtcacccaagtagctgggattacaggcacatgccaccacacctggctaatttttgtatttttagtagagttggggtttcgccgtgttggccagggtggtcttgaactccagaccttgagtgatccgtccacctcggcctcttaaagtgctgggattgcaggtgtgagccactgcacctggccacatagttttatttattcctttgtagtctgtatatcttttttttttcccttgtattatcaaaccttcattacaattttgattgggagtggtgagagtgaacgatggttgggggaaacattcagtcatttacagttagcattgtgttagttgtagagttttgtaaatactatttatcagattaattaagttatttctattactagtttgctgagggtttttttaaacatcatgaatggatgttgaattttgtcaagtgctttttctgcatatagagatgatcatatggtttttctcctttagtctgttaagatggtgaattacactgattgattttcaaatgttgagccagccatgcattcccagggtaagcctcacttggtccaagaagacttactttccattaaaaatttcaaacatacacaaaggtggagaaactatttttttttattatactttaagttttagggtacatgtgcacattgtgcaggttagttacatatgtatacatgtgccgtgctggtgcgctgcaccactaactcgtcatctagcaactattaatagtacaagaatctaccctatacccatcacctagaaaaatccttgctatttatttgcatgccattctcatcagttgaattttataatgtgttttgctgatgattctaagagttggtccaggccttcctgcctattgtattctgttaaggtagatgtctctgactagtggattggaacttcctagtatatctccataccagttgccatttctaagccttttggccaccccctgccaccacccctgcccgcccctttcccttgtcactcttcgcaattctcagcactaattgtagtgtatataatttcagtactctttcccatgctttatttagtttgtttttgaacatatttttttctcatttctctccaacttgtatctcaggatccaaagaattaacaatatctcatgccaaaagcttgaggattcctactgtattgacaataacatacagaagctttgcttaaatattatgcttactttttttttttttttttttttttttttagatggaatctcactctgtcgcccaggctggagtgcagtggtgccatctcagctcactgcaacctctggctcctgggttcaagcaattatcatgactcagcctcccaagtagctgggactacaggtgcacgtcaccattcctgggtaattttttgtacttttagtagaaacggggtttcaccatgttggccaggctggcctggaactcctgacctcaggtgatccgcccgcctcggcctcccacagtattgggattacaggcatgagccaccacgcccagcctgaattgcttacccttaaacatgtttatttttactgccaggccttaatgagtcagtaatggatatgtcattttagctgagttgtattctcatttgtgtaatatacttatcattttaatgttatcttatcattaaaacaaccttatattggtggtaattctatttgctggaggttctctgtaattttgcttttatgcaatgttcattacagtaatggcgggaagttaatgccactttggaatttgatcagcttgcatcactaccagaatggttttcctatgactagttgagatccacatgcaatacattttttgacatactaccaggagcagatgttaatatcataatgaaagctttgtccaactggacatcagatttagcacaaaattcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatctgaggtggggctggtgttgagggccagaacagaagctgaaccttactaattatatagtagtgtctgtgctaattgcagtaaagctgttttaaccatttggaaactagttcatgtaattttttgccaaatgacttaggtacttattgtccactgacagctaaagtattttccaaaaccctcaactctctgtctagcaaactattgtaggtgaatatttgtctctgccaacatatccatgtataactataaaactagattctgctttgatgtttgcaaatacattcttgcttcccaaaacagcctgtttgcatcacactcatatgtaagatggctatttccgctgcatcttcccaaagttcaccactgcttaataaggtctgtttaaggtcaaacaaatgcaattgaattttgattacactgaaaatgaagaatagcagcaatataatgtgaaagcactttgtgttgtcaacagtgatttatacaaattccagtgacagatactcaagactactttccagggcacattcataatttgattgctaaaaataaaagaaaacacacttgttctgcctttttcagctctgcttctcctctttcagtcaaaagcccttatgttagtaacctttattcttttttaaaaaaatattttactaagtgtgaagtgttctggggccagagagagattttctgtgaagttaatgaagcttaagtttcagagctcctcatttgcagtgaccttcttctaagactctggaaggagtatcagcaatgtgtttatatggtcatgtgtttttgtacaatttgaaaaattaaaaaaaaatttaaccacaacccttcaaggccattgtccatttctacttcaatgactcttctgttagacctcccctttgtgttagtgtgatattggaatggccatgagctttttggggatgtgactaaggggaggttgagttggggatatgtttagtttggggttagtaggctatttggctataggtggttctttgtcacttctgtgtatagtggagtttttgctaggaattctgatatagggatggcttcttggaacacccctactactcatggggccaactcactaagcatcatgacatgaagatgcagggctcagtgtaaaactggtaaatgaatgttaccagttcaaagaatatgtaagattagtcacttcacaagtaaatttgaaatgccctgaaatcttacagctcatatatgaaagaaactcaacagttttctcaaatttgacagtagctttaaaaatgtatcaatgcctagttgttatgttgaaaggaacttttctaaactatcattaattttaaaaatttttatctagagaaaagactgaactatttttattttctttatatacaagtgattttataaagtcgtcaaatgaagcactaaagaatatacagccaaaaacataggaaaagaaactatcagagaggtatatcaggcattattaataaaaatgttattgttatggatttttatgatatttgttagctttaaaaatttataacttgtgatttaaatttttttaaattttattttgagacggaatcttgctctgtcatctgtactggaatgcgatggtgcgatctcggctcactgcaaccttcgcctcctgggttcaagtgattctcctgtctcagcctcccgagtagctggcattacaggcacgtggcatcatgcccggctaatttttgtatttttagtagagacagggtttcaccatgttggccaggctagtttcaaactcctgacctcagatgatccgccccccttcaccttccaaagtgctgggattacaggtgtgagccactgcacccggccatataacttatgatttttgttatgcgctcagaatattttcttttgtacaaaattttgtgtttatggttttttattcctttttttaaagaaggcccttcaaattgtttaagtttcagacaccacaaagtgtgaattcacctctttctagacatcatatagaaagctgtctttgcccaaacataatttatagtcagaatgtagttcaacatgatcatacataaatattgattactttttaaagaatgttaaagcttaaaatttctgcaaataattaatgggaactaggcttaatacctgggtgacagaataatctgtacaacaaacccctatgacacaagtttacctatatcacaaacctgcacatatacccctgaacttaaaagaaaagttaaaaaagaaatgtacacaaaaaagaatatttctgaatcataacttctaggattataattaagcctcaggtgcagttaatttagaaatcagatttggggagaagagtgtttcaactaagtcaaggagctcttggtagtgtttggaatgaagtaatataattgtgatattaaattgagtaaagttgttttattggaaaatgcaacagcagaacagattaattaacagaattcaaaaagagtgaatagtcaggaaatctctaattttggaataaatagaatatgactatttgcctttgcaactttagaatttaaatgcattttgggaattgtgtcctaagttatacagtaaataaatgtaattttcttgtttgtactgccagtgttaagactgtagactttaaagggattaacctgaagtttaatttaatcaccctggtggtctgttcaaaggaaaagtaaaataggcagataatgtgaagatctttctccggggttgtttggcctttttgaaagtggaagtataaaaacaaatttaattagatataagtactgaatgattccaaaggttaatgccttattaacaaattagtttgtccctgaaacttacaacactaactttttgagtgcttttcctttttaattagataaaggctatagtccattctcttaatagagactatcctttagaaaaatgaccacctcacggatcacgaggtcaggagttcgagaccagcctgaccaacatggtgaaaccctgtctgtacttgaaatacaaaaattagttgggcgtggtgtcgcgcacctgtaatcccagctactcaagaggccaaggcagaattgcttgaaccctggaggtggaggttgcagtgagccgagttcatgccactgcactccagcctgggcaacagagcgagactccaactcaaaaagtaaataaataaaataaaataaaaatgaccacatcaatgctagcagttactaaattcctcctttggatcaataaatacattccttactccccttacaattaattggtgtttttattattgaaaaagtaacacatacacagagtaaaattcctctcccaaggaaaaccagttgtcctatgtatatgtatccttccagaaagactattaatataaaacttttttttaaattattttttgagatggagtctcgctcttgtcacccaggctggagtgcagtggtgcgatctcggctcactgcaacctccgccacccgggttcaactgattctcctgcctcagcctcctgagtagctgggattacaggtgcctgtcaccatgcctggctaatttttgtacttttagtagagacgagttttgccatgttggccaggctggtctcgaactcctgaactcaggtgatccgcctgcctcggccttccaaagtgctgggcttacaggcatgagccaccgtgcccagccaaagctatttacatgtacataagtatatatacttgatgtgtgtgtgtccactttttctaaaaatggaagcatactatgcacatcattctgcaccttgcttttttttaaattagcaaatatatcttagatattgttccacatcaatatacagagccccatctaatatttttctttctatatgggactctttttttggcttcttagctttttctggcaaatgacagtgcattgaatattctgtttttcaaactggtgctctgtcaccaatactatattagagtaacataggcatttttattattataaattagtaggtaataatcatttatccatgaagatgtcgagtcagcttcaaagaggattaggtttctgatttagctgaactctattctgaggaccaaaggaaggtcaaatccaagataaaaaatttagcagtgaaggaatggtgtaaagagggactttcactatttcttttgtatatttttgtgtttaaatttttatagcgaacaatcatacatttgtcatataatgtttgaagcaaagtgaaaatacattagaaatggccaggcatagtggttcatgctgtaatcccagtactttgggaggccaaggtgggaggattgcttgagaccaggagtttgagaacagcttgggcaacatagcaagaccttgtcttttaaaaagaaagagagaaagagagagagagaatgagaatatattagaaatgagaattctgacaaagtactcagtttaaagatggtttagttcatgaaaaacaatgctacaatgtaataaaaactaacagaatgtctgcatctttttcatcttaaaacatttgatttttgaatttttagattgattttggactattatttagtgtctaaggattgtctttttctagtttataatctgatataatagttttaaagtgataacctttatttaggttactcaaataggataaatgttcatggagcttgatggcttcctcttacaatattttaattttcaatattctatattgaagcatcaaatagagtgttaccctattaatgtaaatacattatatttttcagcaaaccataatggaatttgtattgagactgtatgtattataagtgatgatctttttgtatattataaataatttttagttgattcaaaaatatattatgggtggtgaatcaaacatattagaaattcaggataattgattaatcatgtcacttttctgacttcagtctccacatctgtaaaataacagaatcctttcaagctgtgaaaaatctcttataacctttatgttgagttgttatatgaaaatgtaagaaagtaagctttaaactgtctgaagattcccacactgagcagcatgctaacctgaatttattatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaacaaacaattaaaatttggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctcaaaggccccctgccaatattattaccttgggaattagcatttcagcacatgaatttttgagggacctttccctatcaaataagaaagaatacagaagagaaaacatgtactgatgacaacctaagaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccacaaaaattaaaagaatcgatctttacaatctctgtgacagtcagcactctacaccaccattaatactatgaaggccacagagtacgtttggtatattttccttttttctctcccactactgccttcatcaaaatacagtgaatagtcctccatcttcagtctttcctatgagctatatttataatttgtaggctgttacatttattttcagaggaacttttttttttttccgagacggagtttcactctcttgtccaggctggagtgcagtggcacgacctccgcctcccgggttcaagcgattcttgtgcctcagcctcttgagtagctgggattacaggcgcccgccaccatgcccagataatttttacatttttagtagagacggggtttcaccatgttggccaggctggtctcgaactcctggccttaagtgatacacccacctcggcctcccaaagtgctgggattacaggcatgagccaccactccggcccagaggaacgattgatataatggaaaaatagttcctctgaaaataaaaataacaacattggttcctaataaaagattaagagaaaaagacaagctgtcgaaatattggagcaatgtggggaatgaggaaggtggggtagggcagagaagggaagttatttttggagcaggggttggggttagaggacatatgaaaggagagcagcacagacccggaatcagactgccgccagcactttccagctctatggagtctgcctggttttgctcatcactgtatctctagcagctagcatagtgccgggcacataatggacattcaataaatatttgttgaatacataagtacctttttttttttttgaggcgaagtcttgttttgccgcccagcctggagtgcagtggtgcaatgtcggctcactgcaacctccacctcccgaggttcttcaagtgattcttcaagtggttcttcaagtggttcttcaagtgattctcctgcctcagcctcccgagtagctgggattacaggcacccaccaccacggccagctaatttttgtatttttggtagagacgggttttcctgcattggctaggctggcctcaaactgtgacctcaagtgatccgcacacctcagcctcccaaagtgctgggattacaggtgtgagccaccacgcccagccaataagtaccattttgacttcctgcccaaagatttagcacccagagctgtactgtgaatttgtttcctttgagaccttaggtttgaaaagtctctttgctatctaacattcagaggcaaagttgagtgctgttaccccaaagagggatacttttgtttgtgctgagtgtggttggtcagcttttaaaacagaaatagaatttactaaaggaagtgttttctcatctgcagcatgcaaatagcgtagggtactttgacttctcttttgtgtagtattttatgcatagttttcttatgccttttataaataaaagataggctaaagcagttagaaagtatagcaaaccatccagtgacaaagtgatttttttttttgagacagtgtcactctgtcacccaggctggagtgcagtggcacgactttggctcactgcagccttgaccttcaggctcaggcaatcctcccacctcagccccttgagcagctgggactacaggagtgtgtcaccatgcctgggtaatttttgtattttttgtggagacagggttccaccatgttgcccagactggtctggaattcctgagctcaagctatctgcccaaccacctcagcatcccaaagtgctaggattacaggcgtgtgccacctggcctgaggaagtgatttttgcttttaaaatgagaacaatttctgattggctatgttggtaaattgacatttttggggggggtgggtgcgggggaaccaggtcttgtttaagatgtaccggatacaacgtatttaaagggcaagaatcctttacgttggtactttatcagaaaaagtatagtagtacctagagcaataccacccaagaatggtctgtgatgatggaaatactgtgtatccgccctgtctggtaggactaaccacattggccaatgaacacttgaaatgtggctagtgcaaccgaggaactgaatttttaatcttatttaatagttttttttgttttaaaaaataatcatctagtaaaatagactttttttgggtatatagttctatgaaatttttttttagttttgtgaatgttaacacatgtatagatttgtttaacaccaacacaaccaggacatagcgcagccctgttacccctaaaaaactccctcttgctaccattttccctacctctaacccctggaaaccactgttctgttctccatcttcccctttagttggaaagtttaaattatttacagtcattttcttaaccctaaaatcacctcaggggagggaaattaaagtttaaaagaggccttctttaaaaacacaaggacacaaaagccttcatttgatggtggctactcttatattgcatgtctttcaatactatatgtctcaactatacgtggtttgactattctgcatttttttttcatggaaaatgttatatagtattatccaaaaccaaatataatttatttccccacttctgttttggatcatttatgctagtgatttcctccatccctaagaaccagctagccaactagaattatcagagtcttagaaactttccatgccatgggtacatttcacattttcacccaaatacacagtcatcaattatcaagctaaaggaagaaataaaaatatgttcattaaaataagtgaaagatttaactattgtagacaatttaaagagagattttctatgctgaattacttttaattataattttgagtttttattttatagagcaaagcttttcactagaaattaataacacctatatttaactgcttttttgaatattaatatcctatggccatctcaaaaatcaataggtccagcactgaatttatcatctctcctttccctccactttaacctcttaatttcctcctgatttcctcctctctttctgatatcagttaatgacgccaccatctatctatccactggcccaagccagatacctttaagtcatcctagtcgtctcctttatcctatacatcttgttaggaggccctaccctcctgaatgtatcttggagctgcctcttttatctttgcccccagtattcatgtcttaattcagaccctctattgcactacttttgcaattgcagtagcctcctagctgatagtcctccctcctgtatcactccaccctactacactatcatcttccacactgcctccagaatgatccttctctaaaatgaaaatctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaaattaagaaaatatgatgacaagaatgagagagaaacaattatttgtggttattgatttagaaaacagaatgttttctgaagtagcccaggaataactgaattaattatatttctttttattaactagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcaggtaattatcattttttctttgattaccctaatgttcttttacttccattttgctgcttcttttggcatttatcaatgagaaatgattcataggcactgtaattccacttttgcaaatatgtcctatggaggtagccagcagtatatacaaagatgcataaggatgtttgtataattgcttatgatatttaaaaactggaaacaataactcgtggtgcaacaataaataactcatgatgaaatgctatgaagtcataaaacattatggtattaaagataattaatgccacaggaaggtgtctgaggtattttgttaaatgaaaaaaagctgaaaagctatatatacaatgtgatcaaaattttataaagaaatgtatctgaatttacgccatgtatatattgtttatgtatatgaataagattcctggtaggatatgaaccaaaattttaacagtgattatctttgggtggtaggataaatgtgatttttgtttccattgtgtttcctggttttataagttgtttttacaataagaatgtatgtatgtagctatgtatttatataatgggggaagccagtgctcttttaaaaacaaaagtagttgaaataaataataggattttaactataattttatatttaggcattcaaattaaactgactccagagctgtcccaaagttttcgtatttcctgacagctcttacctttgaactgaaacaaaaaatgtatattcaatggaatttaattatgtgaaattgttcttttgaaccagaattgaacctggccttgaattaaactggaaaatgcccaaatgaaattttttgcttgaaataacaattgaaacgttttacaaccaatttctggacaatataattaatctttgctatcctgattagaatgaaagatatcaaatagtagtattccctttttaggctcactaaatctgagtaaaaaattttactaaacacatgtctaaattgttatggtagattaatgtcagtgagagaggacttagagacataccattattaatttttagttcttaatttttctgttggtgacaaatggtagaaattatagaattctcactttttaaaattgacacatagttcacataccataaaatttgcccatttaaggtacacaacccagtggttgttagtatacttacagagttttccagccatcatcactatataattttagaactttttatcactcccaaaagaaatcacatatccattagcagtcattgcccatttctccttcccctccccaagctcctgataacaactgttctactttctgtctctgaatttgactattctagggacatcatttaagtggaatcatacaacatttgtccttttgtgcctgaattattttatttagcataatgttttcaaggtccatccatgttgtagtatgtattagaacatcattcctttttattgctgaatattattccattgtatggatatatcacatttttgttttttcattcaacagttgatgggaatttggattgtctccactctcttgcctattatgtataacactgctatgaacaatttgagttcaaatttttgtatgaacatatgtttttatttctcctgggtatatatctaggagtggaattgctgggtcacatggcagctaaactttttgagggactgccagactgtttttcaaagtagctgttccattttacattaccatctcaaattctcactctaatgtagaaaatctcaattttttgagatttttaaattagaatctggcctggtacggtagctcacaactgtaatcctagcacttttggaggctgaggcaggcagaccacttgaccccagaagttcgagaccagccttggtaacatgatgaaaccccgtccctacaaaaaatacaaaacatcagctgggcatggtgacacacacctgtagtcccagctactcagcgggctaaggtgggaggattgcttaagcccggaagtcaaggctgcagtgagccgtgatcgtgtcactgtactccagcctgggtaacagaacaagaccctgtctttaaaaaaatagattttagattagaatctaatctaaaaaattagattcttttttttttttttgagacggaatcttgttctgtcacccaggctagagtgcagtggcatgatctcagctcactgcaaccttggcctcccaggttcagacaattctcctgcctcagcctcctgagtagctgggattacaggcgcctgacaccatgcctggctaatttttgtatttttagtagagatggggtttcaccattttggtcaggctggtcttgaactcctgacctcgtgatccaccggcctttgcttcccaaagtgttgggattacaggcgtgagccaccatgcctggcctttagattcttttgctctaaaaaagagatacatagttctctattagaaaattcatacagaacactaaaatgttaaagggactctagtaccaaaagtctgaacgaagtgtaggaaatccataattgctgaaggaaataattatgaaaccagaagaaaaatttaagttggaaataagtgcagttatatcagggagccataaaaatgactaaaattggtttcagcaaaatttcattttacctatcaccacttaattttttttttctttttgagatggagtcttgctctttcacccaggctgaagtgcaatggcatgatctcggctcactgcaacctctgtgccccgggttcaagcaattctcctgcctcagcctcctgagtagctgggattacaggtgcacgccaccatgcccagctaatttttttgtatttttagtagagacagggtttcaccatgttggtcacgctggtcttgaactcctgacctcaggtgatctgcccgcctcggcctcccagaatgctgggattacaggcgtgagccactgtacctggcccacttacatttttttaaatttttgaaaatgacagtgtttgaaattatattgattcacatttcactacttcataatgttggattatttctcagagcttctattaaattaaaatactttgatatgcataatggattatgttgtcaataatgagcaccacataaattagttatatcagtatcaccaaaacaagttacttacattataatattcctatgcctcttacatataggaacacaattataatcatcttacatcacatatggtataaaactgaaatatttttcatgttcaaatgtggtatctgtcattacagtaagcaagggcatcataaactttcagattggattcaaaaacagaatttttttctattcacttgggtttatatttttgcaactcacatttttgcaagtgtggttcacagaccagcagcacctaggaccttgttagaaatcagactctggcccactgcagacccagtaaatcaaattctacattttaattttaatgagctctccaggtaatccatttgcacattaaagtttgagaacactgatctacataatgtgattcattgacctttaaattctaaattaaatctacattaactttgtttacataaacaagtccagaaatttgattgaaggcaataatatcagtcataacaacatttcgatcaacaatggaccacatagacgatggtggtcccgtaagattataatggagcatatatagaaacctcatataaggcatttgatattggcatagcagatcaagtaggagaaatgattgatattcattaatggtgctaggacatttggtgttccatctgaaaaaatatatataaatacaaatataaagagcatctagttttgtgtaagtacactctatgatgttcacacaatgatgaaattgcctaaagcatttttcagaacatatttccatcgtttaagtgactcatgactgtataatattaaatattataatttaaaatagctagcatttttttaggagaaaagccatataaatttatttgatcatagttttacatgacatgggagccttcagaatgaagacccaaagatacaggagaaactgcccatttttgtgcttagatttagcacaatatggatagctaaaatagctagcattttattattattattattattggagacagagttgcactctgttgcccaggctggagtgcaatggcgcaatctcggctcactgtaacctctgcctcccgggttcaagcaattctcctgcatcagcctcctgagttgctaggattacaggcgcatgccaccatgcccggctaatttttgtatttttagtagagacagggtttcgccttgttggccaggctggtcttgaactcctgacctcaggtgatctgcctgcctcagccttccaaaatgctaggattacaggtgtgagccacagtgcccagccaaaaaagctagcattttatgaaggtttatataacaaatgtgagcagagtaaaagcaacttttcaattaccttagctgatcaaactagtaaatggaattcaagagtacttgatcagtctctggcaccatgtatagcatctacctagtccttaggaactatgactgcagcaagttcagtaacttttttttttttgagacacaatctcgctctgttgcccaggccggagtgcagtggcacgatcacagctcactgcagccttaatttccggggcttaagcgatcttcccacctcagcctcctgagtggctgggactataggcgtgtaccaccacacccggctaatttttttctattttttgtagagatggagtctcagtttgttgcctaggctggtctcaaactcctgggctcaagcagtccacccaccttggcctcccaaagtgctgggattacatgtttgagccaccatgcctggcctcagtaacttttaacaatgtcttttacctcaacctactattgttaagggccccgggaatcaattattcaacaaatgattatcaggagccagttatatgccctgcatctgttagggcttataacatacatactaatggccatgatgggtaggtaaaaaaccttggcatagtgaatgtcaccataaaagaattgatagagcttaactacagtgacccatattatcgggacatgaagtgactgcattctgtgattctgctagagattagagtttaagatttcaccagaattgtaactacccattttttaagtgtaagtgtcagtgctgatccaggttctcacagcctacttctgccacccattctcagacagaaggattgacacattttgcctttgtatcatactagtcctaggtgagctataaatcttaaaagaggtagtgagaagccagacgcagtggcttacgcctgtaatcccacgactttgggaggccgaggcaggtggatcacctgaggtcaggagttcgagaccagcctggccaacatggtgaaaccctgtctctattaaatatacaaaaaaaattagccgggcgtggtggtgggcgcctgtaatcccagctactcggaaggctgaggcaggagaaacgcttgaacgtgggaggcgaaggttgcagtgagccgagattgcgccactgcactgcagctgggtgacaagagcgagactccatctcaaaaaaaaaaaaaaaaaaaaagaggtagtgagaaaaatgggagatgccttttatcctgactatctgtattatcgtttccttaaagtaaaaaggcatgatatatgaagtaatcactaaccaattaaagcaatctaaatacttgattaaattccttccattttgtgactttttatttttgtttgtttgtttgttttgcgaaggagtcttgctctgtcgcccaggctggagtgcagtggcacaatcttggctcactgcaacctccgcctcccgggttcaagcgattctcctgtctcagcctcccaagtagctgggataacaggctcacgccaccatgcccggctaatttttgtattttttttagtagagacggggtttcaccatgttggccaggctggtctccatctcctgatcttgtgatccacccgcctcggcctccccaagtgctgggattacaggcgtgagccaccgtgcccagccgtgactttttatttttaactaatttcaagcttacaaaaaaactgcaagaaatagtagagaattcctgtttaccaatttcatgcaggttccacagttaatattttacatcgtttatcattctctcttaatagatagatatacatttatatatatatatacacacacacatacatacatttttttctgaactatttgagagtaagctgcagacatgatgtttatgattattttaaagccatttttagattatttatgtattcttcacactacaccagaggctgaacttcacatcggttttgagtatcagactggaaattctttcttgaaatatttggaatcatttgtagttgttgcctcaagtgcaggaaaatcaattttcctttgaatttatttaaaagtttaagtagtgttgttacagcctgtagaaaaattaaaattaaaattaaaaaattaaaattcattgtgaccttttcacacccttactgtctctgtggaggatgaagaaggctttgctcttttgcttgccacactcacagagctaaaggatacaattttatggatctttatttagaggtcatgctaaggtagctaaaagggactacctcttatgacttattttaatataatactgtatttccagagtgtgaaaattacagatggtattccaggttacctctggtacctaaaataacgaaattgctctggaacaacaggtaaagtgatgaacagaaaaaactttttttttcattgtccaagttcataattaagtctcaatagtaattatgagagaatgaaggaaccttctggttggattaaaatggtggttttattcaaaaccaaagtgattttttttttggctactcagcctcctttttgtttttctttggtttttaaaaaagcataacagcagtactatttggtaaatttcacagtctgtgttctaaataaagttctcacaatctgaatcagtatctttctgaagtgattcaattaagaccagagacaggctaattaaggaacactttactattcaaagtgtcctttgctggaatcatccaaaatccaaacctcagtgtcatgtggtgttcccatgtgacagacttgtacacgtacctcctgaatctaaaataaaagttgaaattatttttttaaagtgtcctttgctatactcagacctaggctggcagcactgccatcaactcagagcttggtggaaatgcagaatctcagaccctaccttagatgtattgagtcagaacctgcattttaacaagctcccccaggtgattgtgtatgcattcagatttaagaggcattaatatacttatttgagaagtctacattattctgtagggaagtggtcaggcttttgttaaagtttcttccaaacttgctcatcttcaacatcctgaaaaccagctcttctgtgcaggggttcctttgtctgctagctaaatagacatgagctggtattttgtccaaggacaagaatgaacaaattagatagactagtggaaatttgctcttttcttccttttctctacaggggaggagaaaatctttggcttttttttttttcaggtgcagggatgtgttagaataatttctcctttcttgggaggtaactaatactgcagtggataaactaaaacaaaatagcagaatttcagagacttcaggggagcttctgggatgatatgagcttccacagtccataaagattctctgaatactccattgtgcaaaatagactttttgctgacttattccttgcctcttcttccactgtccacagacatattaaaatttaaaaatattatatatgtatgttaaaaattcaaacaatatagaagtatagatagaggaaatttattcatctgtctgtcattctattcctgccttaaccctattccccagaagtagccactgttaatagtttggtatgtaacccccccgcccagctttcttatgcatgttctcatctatgcatacactaaaattaaaaaaaaaaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctgcctcagcctcccaagtagatgggactacaggcatgcaccaccacgcccagctaatttttgtatttttagtagagatggggtttcaccatgttggccaggctgatctcaaactcctggcatcaggtgatccacccaccttggcctcccaaagtgccaggattacaggcgtgagccaccacacacggcccataaattttcttctaaagctatgcctaaaactgacaaatagaatatttaagaatttcattattactatacccagaccaagcaccagaccaaaaacaagtttgtttagaattatatttttctctttgcttgtggtaaaaatgttcacaagttacttaatattgtatacaagtgttaattttaggttacacaatcttagaaaatgtataccacagttttttaaattcagtcacactcagatgttttagcttattaatttgcactcatatttatagacttcccagtatagcacagtagatttgttaaccataaagatatgtgatgatggccaggcacggtgactcacacctgtaatcccagcactttgggaggccgaggtgggcggatcgcctgaggtcaggagttcaagaccagccgggccaacatggtgaaaccccatctctactaaaaatacaaaaattagctgggtgtagtggcgcatgcctggagtcccagctacttgggaggctgaggcaggagaatctcttgaacctgagaggcggaggttgcagtgagctgagatcgtgccagccactgcactccagcctgtgcaacagggcaagactccatctccaaaaaaaaaaaaaaaaagatatgtgatgaggtttcatgagatcaaagtcataaatttggtactttggctgccctacccctaggtgtcttaatgatacatatggttagtcacagagctaaataaagaagtatggactagtataagcttatccccaccattgagaaaattactcaaaatgtatgtagtaatcacctcacctcatatattaagggcagaacattattataataaaatgtatggtatacggagtcatcttcagttcaatattaccttgtctgcattctatgatttctgcttcagtttagcctccattatttctaactggaatgcactcaaggctaaagcttctattattctttttttagattaattaaaaaagaaaaggagggaggttgccaagcaaatgaaaatgaaaagaagcattcaaggtttctatttaatttaagaaccaactattttggggcaattcagaaatagctttcttcatgagacaagcaatgcctatgccagttacaattttttttaagtctgttaagctgatttttccaattacttccatattatcccctttacaacctcttagcccagttagaaataactttagcctagctggagtcactacattcattttgtttttaactaagtagcattggtcttctctcaatttagtctgcaacatacatatatatttatatatattttataatatatgttatatataaatatataaatgtatattaatataatatataaatatatatgtaatttatattttgagacaaatcgcactctgttgcccaggctggagtgcagtaggaccatctcagctcactgcagcgtctacctcctgggttcaagcgattttcctgccttagcctccctagtagctgggactacaggtgtatgccaccatgcctggctaatttttgtatttttagtagagacagagtttcaccatgttggccaggctggtcttgaactcctgacctcaagtgatccacccatctgagcctcccaaagtgctaggattacaggcatgggccaccacacctggccctgcgttatatttttaaaaaatgaacagaaagagttcttattatagtttgaagagtttttttaaattatctgcaatttacataagtattgaacttatgtttttgacatttgaaaaatcaaattttcccttctatttctgtttgcccatagattacattcagctgaagcaaaaagattttttcctactttctctatacctttcctatattactgacactttcccattaactgatcacctgaattgtttgataccaacaaagcccaaaatgtaagcactttatatagaaaaattagattatattaggtattttttctttttttcactgtgtatacgtttatctacttttttaatttttaatttttgtgagtatataataggtatatatatttataggttacatgagatgttttgatacaaacatgcaatgcataataatcacatcatggaaaatggggtatccatctcttcaagcatttatccttgtgttataaacaattcaattatattctgttacttttaaatgtacaattaaattatgattgactatagtcacactgttgtgccatcaaatactaggtcctattcattctttttatttgtacccattaaccatccccacttccccttacaacccccactatcctgtttacttatttaaagctattaaattaatatttaatcattttttctttttttatcaaacctcagacttgacctatggactgttgatccccattccctgtcaggtagccatcaaatgccacagaatcctagaaagaacttctatttttgctatgtagaattaattttcttcctggcaatgacagcaatagctggcctagaaaagtggaatggttgttaaaaaaaaaaaggtttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccaggatgtattatttacttaagcaaaacaagttgcagtgtaatacttatggcataatctcatttagtaaaaaatgcaaaactacatgtatgtgtacttacatatgtatataaacacctagagaaaggactagtatatacacatgattaacactgtttatctcaggaagagagcgggattgagggagaagatcaaagagaaacttgcatcttttcaacattgaaatttttacagctagaatgtatttaaatttatttgtataacttaaaaaattaaaacaaaaaatcttgtaccaaaataagttccagtttaagcaaaaattcaaatgtaggctgggtgtggtggctcacgcctgtaatctcagcattttgggaggccgaggtgggaggatcacttgagcccaggagttcacgaccagcccaggcaacaggtgaaaccccgcctctacaaaaagtaaaaatttaggccagtcatggtggctcacgcctgtaatcccagcactttgggaggccgaggtgggtagatcacttgaggtcaggagttcaagaccagcctgaccaacatggtgaaaccccgtgtctactaaaaatacaaaaattagctgggtgtggtggcatgcgcctgtaatcccagctactcgggaggctgaggcatgagaattgtttgaacctgggaggcagaggttgcactgagccaagactgcgccactgcactccagcctgggcgacacagtgagattccatctcaaaaaataaaaaaataaaaataaaaataaaaaatttaaaaagtaaatatttagccaggtgtggtggtgtgcatctgtagtcccagctacttgggaggctgaggtgggaggattgcttgagcctgggaggttgaggctgcagtgagctgtgttcatgccactgcattccagcctaggtgacagagtgagacattgcctgcctcccaaaattgaatgtaaacaatgaaaccatgaaattactagaagaaatatttggagcattttttttcaatattatgaaactttcggacatacagaaaagtcagaagaattgtacagtagatatcctatatacaccagctagattctacaattaatactttactatatttgctttatcatacatcaatccatcaatacatcactgaaataattttagactcacaagtaagtaaaaaaaagtacagaaaatttccatgtagccttcatctagcttttcccaatgataacatctaattcatttataaaacaatattggaggctgggtgcggtggctcatgcctgtaatcccagcactttgggaggctgaggtgggtggatcacctgaagtcaggagttcaagaccaccctcgccaacatggtgaaaccccgtctctactaaaaatacaaaaaattagccgggcgtggtggcacgcgcctgtaatcccagatactcgggaagctgaggcaggagaatcacttgaacccgggaggtggaggttgtagtgagccaagatcacgccattgcactccaacctgggcaacaacagtgaaactccatctcaaaaaaaaaaaaaaaaaaaaaaagaaaaaaaaagaagaaaaaaacaatattggatttggaagcgtttttctaaaatatgatacaaaaccaataaaagaaaagattaatagattgatgaattcagatacctaaacatttcttcttgggatgaagacaccaaatggaaagtcaaaaggcaattaaaataattataattcatatcatagatgaaggttaattttttcatatacgaagaacttttatacatcaataagacaagcgtcagcaccccaaaatttcttttctatgataaaggatatgaactgacagttcacagaaaagcaaaaacaatacctcttaaacatgaaaagatgttcaacttcattcgtaatgagtaaagcaaattaaaatggcactgaaataccattttcacttattggattggtaaagttaacaattttgttaacactatgtttctgatctctcatgtattgctggtggtgtgtacattgatacaagatgccaacagaggaatttggcaatatctgtcaaaggtgaaattgcacatagcctttgcctcagaagttccacttgtaggaatttatccaacagacatttttgcatatgtatgaaatgacatgtatgcaaagatgttcattatagtattgtttacaatagcaaaatatgaggaaaaactaaatttcagtcattagggactaaaattatgatacaatcatatcatgggatactgagtagctattaaaaacaatgaaaaagaatgagtaggtttttatatgtttttaaggattaaaaaataatagcttttttgaaataccataaaactcacctttttaaagtgtacaacccagtggtttttagtatattcacagacttgtgcaactatcactactatctgatttcaaaacattttcatccccattaaaataaaactcattagtagtcattctttagtcctaatctcttacctgtactggttctactctctctaccctaggcaaccactaatctactttgtatttgtatagatttgcctattctggacatttcatataaatggaataatataatatgtggtcctttgtaaccggcttcttttatttaccatagtgtattcatggttgatccatgttgtagcatgtatcattactgcattcctttttattgccaaataatattccaatgtatgaatatactacattttgttgatttagtcatcagttgatggacaattgggttgtttccactttatgaatattgctgctattataaataatgctgctatgaacattcatatacaagtttttgtgtgaacttatgtttttaattcccttggggatatacctagaagtggaattactaagtcatctagtaactctatatttaaccttttaagggactgccagactgttttctaaagcagctgtaccatttcatatccccaccaacattgtattgacgttccaattgttccatatgcatgtcaacacttgctattacctttttattatagctatcccagtggaagtgaactggtatctcattttggtttgatttgcatttccctgatgactaataatgttgagtatcttttcttgtgcttattggcctttcataaatgttctttggagaaacaattcgaatttttaccttttttttttttgagacggagtctcgctctgtcgcccaggctggagtgcagtggcgcgatcttggctcactgcaagccccgcctcccaggttcacaccattctcctgcctcagcctaccgagtagctgggactacaggcgtctgccaccatgcccggctaattttttgtatttgtagtagagatggggttttactgtgttagccaggatggtctcgatctcctgacctcgtgatccgcccacctcggcctcccaaagtgctgggattacaggcgtgagccaccgcgcccgaccatttttgcccatttttaattggattgtttgtctttttattactgagttgtaagaattctttatatattctagatacaagtcccttatctgatatatgattttaaaatattttctcccattctggtattgcctcttcgttggcggtgttgtttagagcacagaagttttctgggtacagcataggtgcatgtgcctgtatttatgaggtatatgagacgttttgatacaggcatgcaatgagtaacaaacacatcatataacatggggtatccatcccctcaagcatttatactttgtgttacagataatccatttatactcttttagttatttttaaatgtatgattaagttattattgactatagtcatcctgttctgctatgaaatactatgtcttattcattctattttttgtactccatgttgttttcttgaataaatgcttcctagattgctgcaagcttttgtttgatttccagatttctggaaaaagatggttcttacaatttctgccagttttctcattgcttttacagaggagagaattttagaggtcttactgcaccatttgcactgatataccttcagcagatattcttgaataaatccttcttaatttgtggtatgccctttggtcaatttccagagtatttcaatggctgttttttgatacttttgtcagttttatcattgctttttgaggaaaggatttgctgagctcctcacgcagtcattctagaagtcatgcccatccattttataatttaacgcccagctaaactataaccccactcaagatatagggaaagatacatttttagacatacaaagtcaaaacacttttgccatccattaatttcactgaaagctatactagtgattatatacttcagcaggatgaaaaaaaaatccagcgggaagcaagactggatacaagaaacaataataaatgtcaaatcctctatcactgagtagtagtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctcttaaaaaaaaaaaaaaaaaaaaggaagaaatatctgattttccttgtattatggaatatccattggatcatagatgatagccccacaggcttgtgcagcaatttgaatacctccctctgcatgtacatctattgaaatacaaacacgattgttttggcttaatctccctttagtgtttatggattagctaaaagccaaagaaagtgactattgatactttaagttattgagatatatatgtgaatttcagcattttttaaaattcaatgattatcattcctatattgcagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaaggtaaagtaagaaagggtgacatttgttaaaatgttgggtggataaatgaccttagtattttttaggccaatcattggaaatacatgcttttatgtagttaaccatttactgaaagacgtattttcattttggcaatattttaagttaaatatcagtttagaagatttaccaaatatggaattaatactgtagatagtacagtatgtctgtttattttaagagagacaaatgagaaatacttatcacttatttacttacattattaattgaaaaattgacatgaccacatggtttaaaataatgatagaaaaaattcacccatattcccttgctataatgtaaatcattttctaattccattctacatacctttctacttaacagagttgcaaatgtagtattcatactactttgtacccttaacactataaagtttttcaccatttttgcagtctagattattatctaatatttctgactaagtctgtcacatcagtttgctttaatttaataaaccattcaggtgtttttcaccattagattgtttctaattttttatttttagataatcctgcattgaacatactcatgtctaatagtcatttccattgagctaatatcttagaagacattacaaaggatgtgtttactgggttaaagggcataaatatttctctggttcatggtacaagttgtaacagtttttgccagcaggggtatgtcagtgaagtatttttactacaacttcaccagcattgcatcccccccacaaattctttctaagttaatagacattaaatggtattacagggtaactttagtttgtgtttcttccattaatggtggggataaacattttttcatcatcggatgtttatatttccttttgaatgatttgcttatatatgtcctttgcctgtgtgtttattgggttcatgtttttcttattaatttatataatttcttcataaattatacctaataatacttttaaaatattttgtgtacttttaggctgggcgcggtggctcatgcctgtaatcccagcgctttgggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatattgttttacggctaaatattctgtgttatctctaaaaaaggatatattctgatataactatactaccgtactgtacctaacaaaatgaacattaattccttaatgtcacctaagacccaattcatattcacatttctcctgttgtctccaaaatgttttaagtctctttgcctgaaatagaattcaaacaagatccatgcatcatagcatttgactatcatatggcttatgttcttttaatctaaaacagcgcctctcttctttctcctcattgtccttccttccctcctccccacaaaacaattgacttgaagaaatagccatcagttgttctgtagaatatcccacaatgtgaatttatcctttgtttccttttggtttcatttaacttgttctataactcctatgttacttgtaaattggaagataaagctaaagacttgattatatttcattcttttgtatttctcatttttatactaataaaattgtttaggcaaagttacataataaagaaatttttagttaaatgaaacccattacattattttttaaaactttcatttttaatttaatgactgttcaaaaaaatagagtgcctactttgtgctagctactgtgctgttcactaacagtaagcaagactgacatactagttcctagtttaaatgttggttctagcttccattggcagtaattatggagccacaagcttgacgtgaactaaagagcttacatggagaggtcagggtaggaagcatattatcatggtgctttttatgttaacttatatccagtgaagaacaagtggatgtggaacttgtacaacgtggagatatcattaaagtagttccaggaggcaaatttccagtggatggtcgtgttattgaaggacattctatggtagatgagtccctcatcacaggtatgttctttcaaaggatcatgaccaaaatgttaagaaaaatagacatgaaagatgaagcactttttgtagaagctatgaataactaaattatgaacagagagaataagttcttttaagactgtattaaatcaatttcctcagatttactttgtggctttagttatgctattagtccattttcacattgctataaagaaatacctgaaactgggtaatttataaagccaagagatttaattgactcacagttctgcatgtctggggaggcctcaggaaacttgtaatcatggtggaggagaaggggaagcaaggaccttcttcacaaggcagcaggagagagaagtgctagcaggggaaataccagatgcttataaaaccataaggtctcatgagaactcactcactatcatgacaacagcataggggaaaccgcccccatgattcaatcacctcccctcctcgacatgtggggattacaatttgagatgagatttgggtggggacacagagccaaaccatatcatcccacccttgacccctcccaaatgtcatgtcttttcacatttcaacaccaatcatgccttcccaacagtcccccaaagtcttatttcagcattaactcaaaagtccacaatctaaagtctcatctgagacaagacaagtcccttccacctatgaggctgtaaaatcaaaaacgagttccttccaagatacagtgggggtgcaggcattggataaatgctcccattccaaatgggagaaattggccaaaacaaagggactacaggccccatgcaagtccaaaatccgttggggcagtcattaaatcttaaagctccaaaatgatttcctttgacttcatgtctcacatccaggtcatgctgatgcaagaagtgggctcccaaggtcttgggcagatccacccctgtggctttgcagggtacagcccctgccactggctgctttcactggctggtgttgagtgtctgtggcttttctaggtatacagtacaagctgttggtggatctctaccattctgtggtctggaggatagtggccctcttctcacagctccactaggcagtgccccattggggactctgtgtgggggctctaaacttatatttcccttctgcactgccctagcagaggttttccatgatggcttctcccctgcagcagacttctgcctgggcatccaggcatttccatacatcctctgaaatctaggcagaggttcccaaacctccgttcttgacttctgtgcacctgcaggcccaacaccacgtggaagctgccaaggcttggggcttgcaccctctgaagcaatggcctgagttgtaccttgaccccttttagccatgactggagctgaagctgctgggatgcaggatacgatgccactgaggctgcaaagagcatcagaggccctggttcccagcccacaaaatcattttttctcctaggcctcagggcctttgatgggaggggctgctgccaagatctctgacatgtcctggagatgttttccccattgtcttggcgattaacatttggctcctcgttacttatgcaaatttctgcagcccgcttgaatttctccccagaaaatgggtttttcttttctattgcattgtcaggctgtgaattttccaagcctttatgctctgcttcctttttaaacataagttccaatttcaaaccatctctttgtgaacacataaaactgaatgctttcagaataatgtaggtcatgtcttgaatgctttgctgcttaaaaaatttcttctgccaggtatcataaatcatctctctcaagctcactattccacagatctctagggtgggggaaaaatgccatccgtctcttttcttgtttctttttttttttttttttttttttttttttgagacggagtctcgctctgtcgcccaggctggagtgcagtggcacaatctcggctcactgcaagctctgcctcccggttcaccccattctcctgcctcagccgctggagtagctgggactacaggcacccgccaccacgcctggctaattttttgtattttttattagagacggggtttcaccatgttagccaggatggtctcaatctcctgacctcgtgatcagccggcctcggcctcccaaagtgctgggattacaggcgtgagccaccgcgcccggccaccacccatctcttttctaaagcatagcatgagggacctttactccagttccccataagttcctcatctccatctgagaccacctcagcttggacttcattgttcacatcactgtcagcattttgatcaaaaccattcaacaagtttggctgggcgcagtggctcatgcctgtaatcccagcactttgggaggctgaggctggtggatcgcttaaggtctggagtttgagaccagcctgaccaacatggtgaaaccccgtctctactaaaaatataaaattagccaggtgtggtggagcatgcctgtaatcctagctacttgggaggctgaggcagaagaatcacttgaactcaagaagcagaggttgcagtgagccgagattgcaccattgcactccagcctgggcaagaagtgcgaaactctgttacaaaaacaaaaaacaaaaaaacctaacaccattcaacagatttctatgaagttccaaactttcccacattttcctgtctttttctgagccctccaaactgttccagcctctgcccattacccagttccaaagtcgcttccgcattttcaagtatctttatagcagtgtcctactccctgtggtaacaacttactcaatttactacattagtcagttttcacactgctctaaagacatacccaacgctgggtaatttatgaaggaaggagatttaattgattcacagttctgcatgactgggaaggcctcaggaaacttaaaatcttggcagaaggtgaagggggcaaggaccttcttcataaggcaacagtagagagaagtgccagcaggggaaatgccagacacttataaaaccatcagatctcgtgaaaactcactcatcacaagaacagcataggggaaatgcccccacatgactcaatcacctccctcccttggcatgtggggattataggtccctccctcaacatgtggggattacaattagagatgaaacttgggtggggacacagagccaaaccgtatcaactattgaagacttttatcactggagattattagctgctagaatgcataaccaaaggaagttgtctcagtttcctgtagacttgatggactttggcaaattttcctgggcaaatacctattctgcccttcctgctgtaaagactggtctaatctgagctatgacacgagtccaggttttccacatcagggtctactctaagggaataggcctggcatagttttagaaattttaggtaactaaggccaatctgaggcagaatcaaaatgatacctttccaatctcaactctctgatagtcctagaagaagctcagtttatgaaccatgtggaaataatttaggactgtgtgtttctttctttctttcttttttgtttttttgttgttgttgttgttgagacaaggtcttaccctgtcacccaagctggagtgcaatggcacaatcttgactcatggcaacctctgcctcccaggctcaaacaatcctcccacctcagcctcccacgtacctgggactacaggcgcatgccaccatgcctggctaacttttgtatttttttgtagagatcgagttttgccatgttgcccagtctcgaactcctgagctcaagccatctgtctgcctcagcctcccaaagtgctaggattacaggcatgagccgctgtgcccaacaagactgtgtgtttctcaataggggtgctattgccagtttggatggggcaattcttagttctcggggactctcttacatactgtagtacaattcagtgcccctgaccctggcactggcacactaaatcgaagtagtagcacccccttccccatcccgtgcagtcattattacaaacgaaaactccctcccacatttctaaatgttccttgagaacaggttaagaaccaatgttctaggactagggtgaaactctaaaagtatctgccaacaagagctaccatacaggtttttccagttcaaggtttatattcctggcattggcctagaactgatataaggaaaaagggaaagcaactttcacctaggcatttgttcagattctattttatatctagatatttttgacaagtaacaaataatgatatgtttcatgatagtgatcatttatgctccttaaatctatctttactctccatacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggtaacttaactccctaggagaaacacaaactattttctttaaagccttctcagtataaatcttcacctagtttttacgttttccaataaaaattttagttgcattaatatggagttcgtttgtttttgttttgagatagggtctcactctgttgcacaggctggagtgcagtggcaccatcatggctcactgcacccttgacctcctaagttcaagcgatccttctgcctcagcctcccgagtagctgggactgtgtgtgggcacatgccaccacacccagctaattaaaaaaatttttttttatagaaacagggtctccctaagttgcccaggatggtctcgaactcctggactcaagctatcatcctgccttagtctctcaaagtgttgggattacaggtgtgagccaccacacctggccattaacatgaagtttgttaaaatatttctatttgtgctaactactaaatatactctgcattcagtatcagaaaagactttgatatgcttcttcttcttattattgttgttatttttaattctaggctcctatccagcagtttgcagacaaactcagtggctattttgttccttttattgtttttgtttccattgccaccctcttggtatggattgtaattggatttctgaattttgaaattgtggaaacctactttcctgtaagtgacttgtaataactcgttactatatgcagaacaatttgtgagtcttttgcattagtaattcattggaaataactttaataattaccaggatctttaaaggtttggagtgggagagtgataagaataatatttgcatttttataaatataaaaaatttccttttggaaaaaaaattttattatgactggtgattttccaaaagcaaataccaaacttttacatgttatgcttagtctcatttctgacatggttttgctttcacagaggactatagatatattgaggaaaacctcaggatttcagctctgtcatttactgtcaatatgatcttagactacttaattgctctctgagcttcagtttcctcaactataaagtgaggttttaataatacccattttgtgtaacttaaggttgttgtgaaggttaaataatatattagaaataatttgtaacttattaaatgctttacaaatataagatattattagtgtctactcatctagttctctgatgctgtctatggtgttgtaaagtggtaaagcagaactggactgtgcctcaaattagatatataaactttaagtcatgtaagttttactatcctcagttctcttatctgtaaaatagggaaaatagtacctaagatacaggattggaattagtataggtgaaagcatctaacatattgacagatgcaggtgacagccaagggtccccctgcgaaacccctgaaggttgaaaactttcaagcctaaaacatcctgaaggttgaaaaaccggactgctggtcccagatgaagcctgccctactcccctacccccgactgattctttctaaataatgtccacctacgcactgggaggatggggtggggcccctggaagttcaccccgtttgtatagggaaggagtctggactgacctgttcctgggtggtacctggggttcagtcggtgaggtggagagcctgttaacaggactcaatctcattttgttgagttgtttttcctttttcctttttggccaataaattcctttcccctcgcccttcaaagtgtctgcagacctaatcttttcctggtcgtgtgacaagaatctgttctttttctataacaacatgtatacatatgtgaagtttatggaagcataagcctagaaatctatgaaagccccttccagctgtgtttctatatagatctataattcttggatgaatatttaagtatttgagaacttaacctaacactgtaaaactgttactgataagagctgcagtgagccatgatggcactaatgtactccagcctgggcaacagagcgagactcctactcaaagtaaataaagtcttactttgttgtatttatttattttattttttattcaggaggtacatgtgcatgtttgtttgtttgtttgtttatttatttatttatttatttatttattgcgacagagtcttgctctgttgcccaggctggagtgcagtggcacgatctcggctcactgcaacttccacctcccaggttcaagtgattctcatgcctcagcctcctgagtagcggggattacaggcttatgtcaccatgcccggctaatttttgtatttttagtagagatggggtttcgccatgttggtcaggctggtctcaaattcctgacctcaggtgatccacctgcctcggcctcccaaagtgctgggataacaggcatgagccactgtgcccggcccgtggatatattgtttattacatgggtatattgggtgatgctggggtttaggcttatagtgaccccatctcccaaacagtgaacatagtactcaataagtagtttttcatcccttgcccccctcccttcttctcaccttttggaggccccactgctcattgatttcatctttatgtccatgtgtagccattgtttagctcctgcttataagtgagaacatgtagtatttgattttctgtccctacgttaactcacttaggataatggcctccagcttcacctatgctactcaaaggacatgatttctttttttatggctgcatagtattccatggtgtatatgtactacatttcctttatccagtccaccattgatgggcacctgggtgactccatgtctttgctattgtgaagagtgctgtgataaacacacacatgcagttgtcttttgataaaacaatttaaaataaatataagaaaatcctttgggtagatatccagtagtgggattgctgggttaaatggtagttatattttaagttcttggagaaatctccagactgttttccgtagaggttgaactgatttacattcccaccaacagtatataagtgttcccttttctctgcatcgttgccaacatctgttattttttgatttttttaattatagccattctgactggtgtgaaggggtatttcattgtggttttaagttgcatttccctgatgattagtgatgttgagtattttttcatgtgtttttttttatcacttgtatgtcttcttttgagaggtgtctatttatgccctttgcccacttttaaatagggttgttttatccttgttgatttaagtttcatatagagtctagatattagtcctttgttggatgcatactttgcaaatattttctcccattctgtaggttctgtgtttattctgttgattgtttcttttgttgtgcagaagctctttcgtttaattaaatctcctttattaatttttggttttgttgcaattgtttttgaggtcttagtcataaattctttccctaggataatgtctagaagagtttttcccaggttttcttggggtttttatagtttgaggttttacatctaagtcttcaatctatcctgagttaatttttttatatggtgagagatatgagtccagtttcattcttctgcatatggctagctagttttcccagcaccatatattgaatagggtgtcctttccccattgtttgtttttgtcaactttgttgaagaccagttggttgtaggtgtgggctttatttctgggttctctattttgttcagttgatctacgtgtctatttttgtatcaataccacgctgttttgattactatagtcttttagtataatttgaagtcgggtaatgtgatgcctctagttttattctttttgcttaggattgcttcggctatttaggttctttttccatatgaaatttaggattgctttttaaattctgtgacagagaacattagtagttttataggaattgtgttgaatctatagattgctttggacagtatggtagataggattagggttagacatggagagaagatcatctcctgccacacccttcccccacacctacagtgctgcggatgcagcagtgctatttcccaccaggggccagctagcgcacacttggacaaagcatatttcatgcttttcatggtggctccacccctactgcaagtgagtcacgtgccgcttgggttttttccaagggcgaggctcaactccctctcccgacagagtggcactgtcccagcaaggagggacagacaaatcactgagttgcctgctttggtctgggggaaaagactaacccaaacccattttagtggtagctatcagaggggcatactcatgggaaccaaaggacaaagtccttatgaaatgaaggtcaggagccctataacaagggcacaaaagagaagctgatcatgttcttgctggcacaggatcaggagtgcgagtgcaccctaatataatctcttcccaccacccctgcatcagggcaggtgcttctacctggcaccaacctacctgctgtctcttactcttgagtgccatctactggtgtgtatcctgaactgcatcataaaatttaaaatctgctaacagaagggcttagttctagcccttaagataagtccacagggacctctgcaccctaaaccctataggagattgttagctctaatggctaatacctcactacaaaaagcagcatctgagaaagctatggcatagaagctatccacaaccaagtaatctgtacagcaccttggacccctgaaagcaccaaaaacaaagctaaatgatcacacacaacatgcaccacagtaaagcacccaagggaaaaaaaagaaggaaagaaaacgtcccttggaaatgatagcaaattcaaaaacaggaagcaaaagttcccttggatgggaaagaatcagtgcaagaactctagcagtacaaaaagtgttttcacaccgccaaacgattgtaatagctctctagcaacggatcctaagcagacagataagtaatttaaaatatggattgcaaggaaacctcaatgagatccaaatgaaagttggaatccaatgtaaagaaaccagaaaaacgattcaggatatgcaagacgaggtagccatattaagaaaaaaaacaaatggaactgctggaactgaaaaattcagtaaagaaatttcaaatccagagaactcctgcaagacactatacaagatgaccatcctcagggcacacaggcattagaatatccaaagtcaatgcaaaagaaaaatatcttaaaggcagctacagaaaagggccaaattacctacagagcaaaacccatcaggctaacagcagacttctcagtggaaatgttacaagctggaagtgattgagagcctatttttagtttccctaaagaaaaaaaaaactggcaaccaggaatttcatatcctgccaaattaagcttcatacatgaagtagaaacaaagtcttcctcagacaagcaaacagtaaggaaattcatcaccaccagaccagagctataagaaatgttcagagaagttctgaacatggaaacaaaagaatgatacttgctaccacaaaaacatatataaatacaaagctcacagaccctataaagcaattacacaattgagactacaaagaaactagcaaacactaccataaggaacaaaaactcatatatcaatattaaacttgaatgtaaatggcctaaatactccacttaaaagacatagagtggcaaattggaataaaaaaacaagatccatccttttgctgtcatcaagagacccatctcaaaggtaataactcataggttgaaggtgaagggatggagaaagatctatcatgcaaatggaaaacaaagagcaggggttgctattcttgtattacataaaacagagtttaaatcaacaatagttttaaaaaaaggcaaagaagggcactacaaaatgataaagatctcaattcaacaagaagatttaactatcttaaatacatatgcacccaacattggagcatccagatttataaaacaaatactgctagacctacaaaaagaggtagactgccatacaataatagtggaggacttcagtaccccactgacagcactagagagatcatcaaggacaaaaattagcaaagaaactctgcacttaaattggattctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaaccctatctctactaaaaaatacaaaaattagccaggcatggtggcacgcacctgtaatcccagctacttgcgagactgagggaagagaattgctcgaacccaggaggtgtaggtttcactgagcctagatcacgccattgaactgccgcctgggcaacaagaacaaaactccgtctcaaaaaaaaaaaaaaaatctctgttcctgatgacatgattctatacctagaaaaccataaagatttctccaaaagactcccagaccagataaactacttcagtaaagtttcagggtataaaatcaacatgcaaaaattattagcatttctatacaccagcaacgtccaactcgagaactaaatcaagaactcaatcccatttacaataatcacacacaaaacatacctaggaatacatttaaccaaggaggtgaaagatctctacagagagaagcataaaacactgatgaaagaaactgaagaagacacaaacaaatggaaaaacattccatgcccatggattggaagcattaatattaaaactaccatactgtccaaagcaatctatagattcaacacaattcctataaaactaatgtcctctgtcacagaattaaaaaagcaatcctaaaattcatatggaaaaagaacctaaatagccaaagccatcctaagcaaaaagaataaaactagaggcatcacattacctgacttcaaattatactgcaaggctatagtaatcaaaagcatggtattgatacaaaaatagacatgtagatcaattgaacaaaatagagaacccagaaataaaaccacacacctacaaccaactgatcttcaacaaagttgaccaaaacaagcaatggggaaaggacaccctattcaatatatgatattattatatgggattacagacatgagccactgtgtccagcccactactgtaatattaaaaagtttctttaagtgattcatgtctgtttagtacacactgaacaaaaggattgttgggaagtttttttggtatttatttatttatttatttatttatttatttatttatttatttttgagacagggtctcgctctgttgcccaggcaggaatgcagtggtgcaatcatggctcactgcagcctcaaacttctgggcttaagcgattctcttaccttagcctcccgagtagctgcaactgcaggcatgcaccaccatccctggctaattttttttttttttttgagaccgagtttcgctcttgtcacccaggctggagtgcaatggcatgatctcggctcactgcaacctctgccttccaggttcaagcaattcttgtgcctcagcctcccaagtagctgggattacaggcatgtgccaccatgcccagctaatttttgcatttttaatagagacggggtttcaccatgttggccaggcaggtctcggactcctgacctcaggtgatccacctgccttggcctcccaaagtgctgggattacaggcgtgagccactgtgcccggccatacctggctaatttttcacaaattttttttgtagagatgaggtcttaccatgttgcccagggtggtctcaaactcctggcctcaaatgatcctcctgccttagcctccaaaagtactgggattacagatgtgagcccgtgcacagaccagcaagtagcttggaatgtgtttccttcaggaatttttctcatgagttcaggatgtcttagatttcttctaaaactaccaattatatttttcccacatgagcaaacactgaacgtcactaagagcttaattagcagatatacttggttcacattgttatgtccaaaaggattttgttgaaatatgactaaggtccctttgcatgccatgtgattctttttcattgtctttcaagaatagtgtgaaaggcagaattatggttttactctacagagattgagaattctgtttattcagtatcaaattttttgaaaattatgtctcacatttgcagctatttctgaaaatttctaataaaaacattcattctcaatatggagcacttatattcagtccatagtttgtaattctggaatctcagtatgtcccaatttcttatattcataaaagaaagaaagtgttttcttacctgtaactaaaaaatatatgtaggtagctaggtaggatatgtcactttttaaattgtggttttatttaaatagtgttaagttttgtgtcttttgttttgtacagctctaaatcaataaccaaaatttatgcctttcttctaaagggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaagacagtccccagaactaaaacctgtaccaccaaactatcaatagcacccctcacatgtgagaaacacatactcctaaattatttctctgtggtccatgagctgagctgcttctaggactatccagagatttgaggtaggaaaggtgttattttggttctgcttcagattggcctttgttacctaagattcctaaaactactccaggcctatttattagagcagaccctaatgtggaaaacctggactcctatcctagctcagactagactagtctttgtggcagaaagacagaataggtgtttgcccaggaaaatttgccaaactccagcagccttctaacctatttgtgtgtgacttgttttcttcactgggaccttcaattgcagtgccgtttctttgcctttgctgccaccagccgacagtttgcagctatgactttaggaatataatcctatctctgatctcatattaggatttccataatcatctcaaagctacttgacttcaactaaaaccatgtttctactagtatgttcttattatgaggatgtaagctatgtacagaggtatatagtaaacatagaacatatcttagaacaaatctggaaactcacctcgccagagaatacaggctagtaatttttatagacattttaaactttgatataatttcaaacttaaaagtcgcaagactagcctggcacagtggctcacgcctgtaatcccagcactttgggaggctgaggcaggcggaccacgaggtcaggagtttgagaccagcctgaccaacatggtgaaaccccgtctctactaaaaatacaaaaattagctgggcgagttggcacacctgtaatcccaactactcaggagactgaggcaggagaatcgcttgagcccggagggcaggggttgcagtgagctgggatcgcgccactgcactccagcttgggcgactgagcaagactccatctcaaaaaaaaaaaaaaatgttgcaagactagtacaaagaactcctatatgccctttactgcagtcgttgggctcttttcctaagaataaggacattctcttatgtaaactgtagtacaactatcaaaatcaataaattaatattgatatgttgttatctgatctgtagtccatgttccagtttcctcagttgtctcaataatgtgctttatagctatttttcccctgtccagaatcatactttgttggtttatttttcttttctttctttctttctttttttttttttttgagatgaagtctcgctctatggcccaggctggagtgcagtggtgcgatctcggctcactgcaacctccacccaccaagttccagcgattctcctgcctcagcctcccgagtagctgggattacaggcatgcaccaccatgcccagctaactttttattattagtagagacggggtttcaccatgttggccaggctggtctcgatctcctgacctcaggtgatccatacacctcagtctctgaaagtgctgggattataggcttgagccaccgcacctggccatttacctttattcttataatcatttccctactgcttagatttcctcatcagatctataattcattatattgaaagcctttcttttttaccttgaggcactagaggcgtctcttaattacctattaacagtcaacccttaaaaattagctctagttgtttaacatatattcacagttatttagcatgaacaaacagttcagcattggcagaggagagctgttgtgtataactaagagtatttcttcttttattttcccgaagaccatcagttttttaagtcaaattaagtcaaaggtcagtttactaagaaactaaatagtcatctctttgtcaaaacagaccttttttcttatttctggaaaggtgatgtggaggatcatcaagtcattgtatcttaatttttttacaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggtacatttttttcctcttgtttattagtgtagtcatctcctgtaggaattccccggatcaaatctagtctggtgtttgactgtgatttgcatatatagttggtatgaggctaaaaagacttgtattttctcatttaattgtatgtaacttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgtgcatctgttaaccgtttttaatgcatatagccacatatacgtatttatcatcttttaaactttatacagaaaggtcatacaatgatcaatctttgttaccttgcttttttattttattaagtgaattttcctgtcaggaaatgcagatctgcctcattgtttttaatggctgtattatactctatagtgtgagtgtttgtttttttttgacttttgcagtatatactcaacatccttatcagtttttgcaagtctgtctctacattaaatgcctatcaatgcaattgctaagtcaaaggatgcatgcagttaaattttgatgaatgctaccaatacccatatgatgaatattaccaatatacatgaggggttataccaatttatacctgcaccaaaagttatgagtgctcatttccccacattcttaccaacgctttatttttattttctcaatttaataggtgaaaaaatatttacttgatggtttgctttgcatttccttaattatgaataaggttgagcatctttttatatatgtattgaccatttgaatttcttttcctctaacctgtttgtatctatgacctatttttccacagagttgtttgtctttttcttattcatttgcatgagttctttatgaattgtctcacattaattttacacttaaaacgtggcagtttctaccattggtgttgccatttatttatttgttctttctcttttacctattacctattactgacctggcttccttacacccaaatcaaacagcagagaggatgaagctataaaaagctaggaaacaatgagggcccccagaacttttcggcttgctaaagatgtagactatagagcagatggagagcctccggtaactaaaggccctatactttgttactctttgccctgtactgagtagaaaacctgacttgactatggagttaaaaatttaatttgtaattatctactggaaagagcagagaatactgataagctttccatgttttctataaattttagagagtgggattaaaacaaagatttttttttattattgtttttgagacagagtctcactctgtcacccaggctggagtgcaatagcgcaatctcaactcactgcaacttccgtctcctgagttcaagtgattctcctacctcagcctccctagtagctgagattacaggtgtgcaccaccacacctggctaaatttttttgcacttttagtagagacagggtttcaccattttggccagcctggtccctctgcccacctcggcttcccagccggcttcttcagctgggattacaggcatgagccactgtgcctggtcaaaacaaagactttgaggctcttctgtaactttgaatgttatgtttgatgctctattcctttgtccttatcaaaatccactgtcaagtaggcaatatgtgacaattttattataaacatttagaattaactaggggtttttatcttgctaatgaatgaccttgcattatcagaacagtagaggaaatccttttgtttctgtttgttaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaagtaagctaattttctttgtagtaccaattatggggcagttatgaacagatggctaactttataaccctgaactgttatagaagaaacaaaaattggcatcataatttcatttcctcaagtcaataccctatgccttctgatcatttaaattagtcaagaatatttcccaactgtggtcattgacaccaccatagggtgatgaggtctagccttagctgatcatccatgatcattcttttgtcactacaactactccaaaccttttctatctttcacaagatcctgtgactctctcctttgtccctctgcaaattatcttattttttatatagaaaattatggttcttgggcatgtgttcttacatatttttgcccagaatcattccttttttcagggaaagcagtatccttcatcttgcctaatgaatcccttcatctagatcccaccctctcttgattcatcagggacctccctctttctgttaggtccccttgctgctttatttttcatctctttctgttttagcttcttttcttaaacatataaacatttcttccatcaaaatcactatattcccatctagattttgtcctttcccatctatattcccatatagattctgtctttttcttttatatccaagttctagaaatggtaatctaggtttgttgaattcacttactccacagtcatgcctcagttcattgcagtctggcttctcccccatccatactactgaatccgttctttctaagttaactgatgaccattgacctcactgctctctccagtggtcacttttcagtcctcatcctgcaagacctcattaagatatttgacaatgttgaccatcccttccttcctaaaggatgattccatgaccctgctttgtctagattctcctctcacctccctggctgttcctttttttttttttttgagaaggagtcttgctctgtcacccaggctggagtgcagtggtgcaatctcagctcactgcaacctctgcctcctgggttcaagcaattctcctgcctcagcccccaggaagctgggattacaggtgtgcgcagccatgcctggctaattttttgtatttttagtagagatggggtttcaccatgttagccaggatggtctcaaactcctgacctcaagtgatccacccacctcagcctctcaaagtgctgggattacaggtgtgagccactgcacccctggctgttccttttaattgtcctttggttcctcatttctcttgctttcaaatgtcgtatgtcgtcagggttttgttctttgtctttttctcattttataatacatactctctctgtacaatcttattcatgctcatcacttagtctaccacccacagacttccactaccgctctaaaatccatatctttagctaagtcctgtttccttggctccatgccgatctatctatctgcccccaaaacatgatctacccacctaagtgttccaacacctccctcccgatttgtgcctgagtgattttgctaacatggaaatctagtcgtgtcactctctaaccagtaccttttattacagtgttttataagctgtttttgagccatagacctttggaggaatatgatgaaagctatgggcccacccctcagaaaatttttgtttcaagagatgcacatgtatcctgaaacccatccacgggtctctgttaaggatcccagctttaatgggtctctctctcctatgggacaaagtccagtctctctggactttgttttagatctgttccccatgatatgtctcctgcctccctgcatcactcatcttctttttccactaccgcatatgtactccatgttccatccctacctaactacttacagttcttccttacggtgtgtcatttccttattagatcatttcatttaccattttctctatgtaatgttcttgttcacaaatggcatctatctcgtgaacttacgcttatctttcaagacccagcttatatctctctcttcagtgacaccctcattgactgacatatattgacagaggtatttgctcttcttcctgaatcataactgtacttaatctctgttactgtactaggacagtgtatgataattatatatttacctgcctgtttctactagtctgtgacttctttattatttgtctatgaacttctagtatcaagcacagtgacaaataggaaattcatttgacagcttttattgagcacctactgtgtgtcatgcactgttcaaggcactaaagaatcggcagtaaacaagataaactaagttcttatttcatggagcttacattcttggtggaagaacacaagagagtgagcaaataagaaaatacaataattccaatggagatagtgctgtggaggaaaattaagtggggcaaggggcataggggtgctgggagtagtgggttctgtttcatatagggtgatcagggtaggcctcactgagaaggtagtgtttgaacgaagatctgaggggatgagagaaaaagctatgtggatttctgtggcaaacacgttctaggcaggagaaatagtaagtaccaaagcctttagtcaggagtgtgcttgacttgtttgaggaatggcaaggagaacagtgtggcaagcgcagagtaaatggatgggcaaggggtataagacaaggtcagagaggtggtttgggactagatatgtaaggacaaaaccaatatgacagttttgagtagaggagggacaaaatctgacttaacattttaaaagtaaaccgggcgcggtgactcacgcctgtaatcccagcactttgggaggctgaggcgggtggatcacttcaggtcaggagttcgagaccagcctggccaacatggtgaaaccctgtgtctactaaaaatacagaaattagtcgggcgtggtagcaggcacctgtaatcccagctactcgggaggctgaggcaggagagaatcttgcggggattcggggcaagggcagaagcagggagatgagttggtggacattgtcataatcgaggtgaaacataatggtagcttggaccagtatagcagaggttgtaagaaatgatagaattctagatgtgtcttaaaaggagagtcacagatttttctcatgggttggatatatatggcgtatgagacaaacaggagtcaagaattatgccaaggtttgtggcctaagcagttagaaggatggagttatcatttaaataagatgggggatcccacaggagggacggtattgggaaaaagatcaggagttcagttttgtacatgttaagtttgagtacctattagagatatcccaagtggtgatatcatataaatggaaatatgaagtaagcagttggctacataagtttggaattccaggaaacagactgaatcagagagatggatttgggagtcctctgcttatagatctgtggtgtctaggaaaatagccactaattatatgtgactctttaaattagttaatttacatttaatttaatttaaaattcatctttcagtcatactagccacatttcagtgctcaatagccacatctgtgtgttagtggctattgtattaaacatagcagatatagaacatttctaatatcacagaaagttctcttggactgcagtggtatagatggtatttaaagccatgagactggataagaaccccaaggagtgagagtagataaagggaaagagagagttaagtactgaatcctgcagcactataaattaagaagttagggagatgaggagggatgggcaaagaaggccaagaagtggccaattaggaggtaacccctaagaatgtggtatcctagaagccaaatgaagaacgtatttccaggagggagtgaacagctgtgttaaattctgctaataggacaagtaagatgaggaatgagaattaactattaggattattaaagtaaaggtcactggctgtaataattcactggagtattagagtcaaaagcataaagcttttgactaccccaataaatggggtaggttcacaagaacatgggaagatatgaattggagacagccaatagagatacttttggaaagttttgctatgtacagaagcagataaatgtggtagctagagaggtgggtgagatcaagaaaggttttttttttttttttttttttttttaagataggacaatgtacagcagagaaaagttgtgcaggagtgggcggggagaattgttgggttggagagatgttctagaataggcaaaggagcgggggtgtctagtgcacaagtagaaaggttggccttaaattaggagcagaatcagtttataataacagaagggaagctagatacacagacacaggaggcacaggtagttgagtggatgcggcaatgagagctgtggaagttcttttctgattgcttctattttctttctgaagtaggaagcagagtcatcatatggtattaggatggggcaggagaagttggagatttgaagggagatgagaaggtatgaaatagccacctagaagaaatggagaatgaatggactagggaaatatagttaagttgccagatagcactaagagcccacttaaagaaaatgagatgtcagcatgattgtacatgttcatctagccacattcagctactgatgcacagtaagtatttttaaatttgattgaatttttatggaaggtcaaagggaaagcctcaccaagaaagtaatatttgaactggctcttgaagaatgtgattgagtttgctgtctggagaggagggataaggacatttcagatgaaggcagcaatgtgtgcaaaggcccagaggcatggaagaacagagtatgttcttagaaaatttgaacatcactgttggaggctatgttctaggagcaatacaatgtagtgactgtgcaaggttagacaggaagaacttgcttcatggggttttataaagattaattgaacttactaaatgttatttctgtgcctactttcagatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatggtaaggttttccataagtatgctataactcaatgttttgttattgttttattaatttatttatttttgagagacctctgaactatgagggttattcaaaagcatcttgaatgcaaaatgaaaatgtcaacaacacatgattattactgattaatttaaaattctctcgcatttgcctgcctttgttactttcttccctagcctatgttttaaatgaaggctaatcaaggattttttaaaacctaaaaatagcaacagtaaaataatagcaaagtaaaataatattcgtaatcccatcatcctaacacaatgtcaggttttttttgtttgtttctttgttttgtttttgttcttgtttttgttttttttgagacggagtttctctcttgttgcccaaactggagtgcaatgatgtgattcggctcactgcaacctccgcctcctgggttcaagcgattctcctgcctcagcctcccaagtagctgggattacaggcgcgcaccaccatgcccggctaattgtttgtatttttagtggaaatggggtttcaccatcttggccaggctggtcttgaactcctgacctcaggtgatccacccacttcggcctcccaaagtgctgggattacaggcgtgagccaccatgcccagcccacaacgtcagttttaattttgtatattccattcctagttttcttgaaatgtgtgtgtgtttgcagaattacagtattagtacatataccattttttactgggtacattttatcgtaagtaaattttacctcaataaagttaaaatcacttgtacacatactattttattatgctttattttacttaatgctttctaatgttgctatataattttactataatactgcataatttatcaatcttacacactataatcattcccctcttgttggaaatttaggctattcctaatatttcactattgtaaatgacactacaataaatatctttgaggttgtatgtgctttattttgttatttcttagggtaaatttctagttgtgagattaattccactctacatttataatgtctgctaagtatgaaggcagtcttttactatggcctttttaggtctgggaagaagcagagaataccattttacttttgttttgtaaatagaataaaataataagatttatggtaatatttttcccactataaagtgcccattttgtctctctctgcccccccccccttaccttaaaaagaaaaaaagtattaatcttcagtttcatttgcctataaattagataaagtgtttgaggctgttggcaaatacctttctgaggaacaaaaagggtcttctaatatccagtaaggtctctctttttattttcctgtgattactttattagtaacccctacctcactctgaaattttcataaccaaatatggaggcttgttacagagtttgtagtataaagtctgtgtgggcttagagatattttaagttaagccatgccctgaacaactttacttgagaaaattcatttcattctgaaatttcaagtcaaaatgttattctcctttcagtatattccaagttcttttattttgtgctgcccctatattagatgagctgtgtggcttgatagccattgcagacacagtgaagcctgaagcagaactggctatccatattctgaaatctatgggcttagaagtagttctgatgactggagacaacagtaaaacagctagatctattgcttctcaggtaattgataggggtatgtgataacttctaattattgatatacattttatatcttgccttcaaatgctaagaaatttacattacctactattttcattatcactgagtagtcctatctggttccttcaagaaaatttaccatgctttgctggaaagactttgggctttgtgtgttgctgttatacgtaaaaaggtatttgcttagttcatgggatgcttgcgtgacactgtacaccaatttctgttgatgtgccctttgaaatgttgctcatattctttaccagtgctgccaacctaagctgggctctcctgatctcatgcctgaaacacagcaatagctccacacacatccctctctagtccatcctaaataccaccaccaatggaactattttcctaatgcaccactttgacataccatttttctgctcctgactcccacatctgccttatctctaaaatttttcaatctttttaactttggaatgccttctcccctcttctaataaataatgcaagtaatcttttaatacattcttttgtttcttttttttttcttgggacggagtttcgctcttgttgcccaggctgaagtgcagtggcgcgatctcggctcatcgcaacctccacctcctgggttcaagcgattctcttgcctcagcctcccgagtagctaggattacatgcatacaccaccacgcccggctaattttgtatttttagtagagacagggtttctccatgttggtcaagctggtcgtgaacttcggacctcaggtgatccgcccgcctcggcctcccaaagtgctgggattacacgtgtgagccaccgcacccggcctattaacaccttcttatgtaaaaaatacagaaggatataaagtaaaaatgtcctcttttccccatgctccccattcagtcctactgcccctcacactgccactttttcatatgcatatatgtgcatatacagagtacatatacagtataattctggtcttttcaacatcagatcattttgaacagattgttcagtagtttgctttttttacgtaacagtatactttggagcttcatccatatctgaacataaagttattttggccgggtttgttggctcacgcctgtaatcccagcactttgggaggctgaagtgggcagatcacatgaggtcgggagtttgagaccagcctggccagcatggtgaaaccttgtctctactaaaaatacaaaaattagccgggtgtggtggcgcatgcctgtaatcccagctactcaggaggctgaggcaggagaatcgcttgaaccaggaggcggaggttgcagtgagccgagatggtaccattgcactccagcctgggtgacagagcaagactctgtctcaaaaaaaaaaaaaaaaaaaagttacaaagttactttattctttctatactgaattccatggtatggatgtatcataatttatttaaccatttccctaatgatggacatttgggtggttttgaaaattttctttttgcaaacaaggcaataataaacatctttggacatgtatctttctgtacatgtgcaagcctgtccaagatagagctagacatggaattgctagaccaaatgatgctcacattttgatagatgctgccagatgccctccaaaaagagttacaatttacacaccagccactggtgtataagagagctcatttctccacatccttgctatcactagatattatcagtcttttaaaatgtggacatcttgtgggtgaaaactgatggcttgttattgctcagttatgtttcacgtactcattattttttaaatgaattgagtttattttcatcacataggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataagggtaagtgccatggcttgacctttgaggagtatgagactgccctatgtggtcaatgataatgtcataaagtatattgagcataacaattctgtcttaagttccatgctatcagccattaagagtttaagaatatggagtgggattatgggaagtcatgctaatttaccccctgactttctcaacccagctcataagcaagtgagaattataagtttctgaagtgaagaagaagatttaagaatggattcggaataaaatgatcttcaacaaatagttgctgagattattttaagtagatttaatcatagtaccagcatacacccctaaaagtgttttcagaaccctgaggaaaatttttgaaaaacaccttcggaagctgagtctaagttttagcattatctgagatttgtaattaattcacatattaccctaaggtagacgtaatcttcaacatacacagtatcaaatgtaaaagttactggttaagttagagtctcttactaatatcacaaatatttctgttcttagaatgatcttctggatgtagtggcaagtattgacttatcaagagagacagtcaagaggattcggataaattttgtctttgctctaatttataatctggttggaattcccatagctgctggtatgtgactcttaactagtactgctttttccactaaagttattagagacctaacatattggaagcctgtcttcttactattagttttgagcttagtttttgtttgtagcctactggtatggtgagaggtaatgttaaaatcaatcattttaattttcagtaatgtttgttatagcttaagaatatataagcattctgacagatttatttttttccctccaacttttttttttttttttttgagacagagtctcactctgttgcccaggctggagtgcagtcatacaatctcggctcactgcagcctccatctcctgggttcaagcagttctcctgcctcagcctcctgagtaactgggactataggtgcccgccacaacgcccaactaatttttgtatttttagtatagacggggttctccatgttggccaggctggtctcgaactcctgacttcaggtaatccacccacctcggcctcccaaagtgttgggattacagctgtgagccaccactcccagccttcaactttgtattttgaaaaatttcaaacttgacacctgtaatcccagcactttgggaggctgaggtgggcggatcacctgaggttgggagttcaagaccagcctgaccaacatggagaaaccccgtctctactaaaaatacaaaattagccgggcgtggtggcacatgcatgtaatcccagctactcgggagacggaggcagtagactcgcttgaacccaagaggtggaggttgtggtgagccaagatcgcgccatcgcacttcagcctgggcaacaagagcgaaactccgtctccaaaaaaaaaaaaaaaaaaaattcatacctccaaaaacattgaaaaaaatggtacaataaaaatctgtatgcctttcacctaaactcaccaactgatggtattttgccacattgcttcatctctttctgcatatatttgcacagagatatgtatttgtttgcttattaatttttttctaaatagatttacctttaatctgactacccaaacccaacactgtttgcaagattaattcatggagcaaatgatttttaaagaattatacaagtattttcctctagtcttttttttactctacatcagtttttgtcttgttacatagttgtgattgtagcttatggagaattttctgctcttcacttaatattctattatagtcagctggtattttttttaggttgagagaccagatgacagagagagtgaacaaagcaatataactgagaaaaaagaatttagagttatttaataagcatctgagaatctcctaaacttagggacctggtaggagttagtaatgatgacataaaagaaataagtattgttttcttcttgttctctctggtttgagggccaaggaaagacaagaaatgacatgagaacaattacaaaactgtttatcagcaaggacacacaaatactgagagaacaaagaacaaaagaacaatctaagtccagtaagattaattcatggagcaagtgatttttaaataattatacaagtaatatatgatcaccatagaaaaagtagaaaaatataaagaagcacataaaaagttaaaagtatgagtctatttcatcctcatcatgtgagcaaacattcttatgtctgtgaaaaccaagtgtggatgagtttgtagaacatgaactcccatacgctattggttggattttgaatcactacagccactttggagaacagctgaggaatatccacgtaaagttgaagatgtgcccatgttatgacccagtagtttcacccctaggtatataccccacagaaactctcaaacatggacacggggagacatgtacaagaatgttaacagcaacactctgttagtgaaaaaaatggcaacaacaaaaatctctaccaccaagaggataaatgctgaagaagtatcaaacaaagaaatgatttgtatgtatgttagaaacacattaataatctgtttagtattatctactctaactaatccatacttgtttcttaggagtttttatgcccattggtttggttttgcagccctggatgggatctgcagcaatggctgcttcatctgtttctgtagtactttcttctctcttccttaaactgtaagtatgatagcttgctcacatttgtattttgtattcctgttatcatctagtcattcttggtaggttttattcttgtattgatcaatgataagcccaaaccattcttaatgagaattattattagcggccgggcgtggtggctcacacctgtaatcccagcactttgggaggccgaggtgggcagatcacctgaggtcagtaatttgagaccagtctggccaatatggtgaaaccctatgtctactagaaatacaaaaattagctgggcatggtggtagacacctgtaatctcagctactcgggaggctgaggcaggagaatcacttgaacctgggaggtggaggttgcagtgagctgagatcgtgccactgcactccagcctaggcaacagagtgagattccatctcaaaaaaagaaaagaattattattagctaacagtaataattagctatgtaattgttacttcgtgtactttatgcatagcaaccacaagcactgagtgggataaaatatagtgcactaattctgagaagtagggtttctgatgatataactccacacaattcgtttcaagctattttcctaccagtgatcacctttatacatttcataccaaaactaagtgtggatgagcaaatcttctttcttttctgcatgtagcgagcatctcatttacttttggttatttgaaactagcatacttttgcatatgtccagttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttg

SEQ ID NO: 4750 - DNA, 134863 bp, human
ttgttgctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtttcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtggcatcttatctttgacacttttcttcgttgtagacgttgagattatcttaagcacaaacacttatcgtttcacaattcagcgtttgtccaggatctgatctttattttaatcacagactctttatctacaatagtatggctttgtattgagaatatgtgcagaacattgaattagatgatactgaggttattaatttttttttttttttgccgggtgcgggggggtggtggggagggggtgatgcacaagaaataagacagagttcctggcctcaaaagagtttacttacagtaggctgggcgcagtgtctgacacacctgtaataccaacactttgggaggccgaggagggtggatcacctgaggtcaggagatcgagaccagcctggccatcatggcgaaaccctgtctttactaaaaatacaaaaattagctgggcgtggtggcgggcgcctgtaatcccagctagtcgggagactgaggcaagaggatcgcttgaacctgggaggcggatgttgcagtgagccgagatcgtgccactgcactccagcctgggctacaagagcgaaactgtctccaaaaaagaagaaagaaaaataaacagtttacatacaattgagtccgaattgagtcagttgaattcagctatgaagacaacggtttctagcagccccactgactgaattactaggttgcttatcacatccttttcaatggttatttttgaactggcattttattatatttaacattttctggtgtctaaggtcatgacatgagagagttttttttgtacttgaggatctcaatgtagtaggaaagaaagatacacgattacctaaacatttaaaaaatctcactaacgttatatattagaaacaggaggtgttatgagagtgcagggaagggagcatgtgaactgggctttgaaaaatagataggatttagctttgcaggaatggaggaagaggaagacatctatctggactgatagatagaagaaataatgtgagcaaagccatgggggtctggaaagttgcccgacatccagtaacacactgtaagtcaatattcctatttctaacagccacatcttccaagatgtcactgattaaaattagaaaaaatatagaatacaaaactagtcagctcacaaacatatccaactgccctccagccaataagaaagcttatatagagaaaaaaatacatggaaatgacaaaagcaatgttaatgtatgaggcttaattctgatgtaaactcaaatctaaaagagaaaaaatgtaaaactcgctatactttaattctgattgagtgttgtgccttaaatataatttggaatcatttttaaaattgttgggaatgaataacattttctgaagtgagcaactgttccaggttttccccaaggaatctctgcttttccttttttcctctaaattgatttctctctattgatcttcttaacttgataggaactattctattccgatcacagccttagaaagatcttgatgcctgccctcaagataaggttaaacactaatccctccaaaggataggttaacatctctgttctctaaagcagaaggttgattttctttgaaaaatgcttgcagaagcagtaaaatttgcttacaaaacaagagagagagagaaaagagtgcaaaaataaccccagctaacacaccacaaccttcacttctgtgagggcgctaaaggaaatacattttaaaaaaataaattccttgttataactccttttatctatatatttaaaagctcttggcaaactttattaatcaagactttggacatcctgatgagtgaaaataatcttcatttgccagttgggaaagtaaattgcaaggagagatttttgtctgaactcatagaagcactagcatagatgagaatagtatttgggagttttgtctcaaaattccttctattcatctttgttaaagggcagttcaggttttagcgttttgtttttagacaacgatatttcttaggatatagctcaacatggggccggggcaagggggaggctgggggacagatgagtgataggcaatggttaggcagagtattttagttcactctaccatcccagcaatcatgtttttccctcttaaatctcagtcttcaggttgatttaatgtgatattacttgcttacttaacttgctgagatagtttggcaggaaaaatatcaaaattcctttagaatgtgtttcattaaagtaaaagggtcctgtgtttctgattttataaaatgttcttactttttccagcactgtttgcaaattgaagtgatttcctaatctttttgtgcccaaatgtatgagatattggtagactacatcagttttcacagatacctctttccttgaaggaaatgagggtaaaataccccattttgagtcagttatgtgtactttgtaccatattttctgttcacatttaaaattatacagctatgtctcaaggatgaaaaaagagttttacttatttttactattaatctctagtgtagaagtccagtttttcagacctataatcaggagtgcatttttaacaatttaccagttgaaataaatgggttatttcacattgtagggatattgttttagactggccattaaccttattttattttatttttattttaaaagatgttattgttattatttatctatgtatttatttctagaggcagggcctcgctctgtggcccaggctagggtgccatggcacaatcatagctcactgcagccttaatctcctgggctcaaatgatcctctggcctctcaagtagctggaaccacaggcgcatgccaccatgcctagctacttatttattaattaattattattttttaaataatattatttttaagagatggggtcttgctctgtcacccaggctggagtgcagtggcgccatcataactcactgcagtctcgatctcccaggctcaagcgatcctcctacctcagcctcctgagtagctgggactataggtgtgtgccaccactcccagctaatttttaaactttttgtagagacagcatcgtgctgtgcagtggtgctatctcggctcactgcaacctccgcctcctgggttctagtgattctcttgcttcagtctcccaagtagcggggattacaggtgcgcgccaccacacttggttagtttttgtatttttggtagagaaggggttttgccatgttggtcaggctggtatcgaactcctgactgacctcaagtgatccaccctcctcagcctcccaaagtgctgggattacaggcatgagccactgtgccaggccttaaaacacctagtgttaaaaatggtgtcttaattgtattctcagattctcctagaaagaaaagatatactaaatgtatatttagatatactaaaacacctaatgtttatttttgtttatttatttttgagatggagtctggctctgtcacctaggctggagtgaaatggtctatgtttgttttttcatcttgacagtaatatctttgaacattttctggagtattagatattattctcttgatgcttcaaggtatcttaacttcaccattgtattgcgatatattgttttggagagacagtataatataggattaagagtggaggctaggtggggcacagttgctcacgcctgtaatcccagcactttgggaggccgtggcaggcggattgcttgagcccaggcgttcgagaccagcctgggcaacatagggaaaccctgtctctacaaaaaatacaaaaattagctgagtgtgttggcacgtgcctgtagtcccagctactcaggaggctgaggtggaaggatcgcttgagcctggaaggttgaggctgcagtgagctgagatcacaccactgcactccaccctggatgagagagtgacagagtgagaccctgtcttgtccggaaaaaaaaaaaaagcctgtcttgtctggctcagtccaggtgctagactgtctaggtgggatcccagcccctctgcttactacttgtatgaccctgcgcagatttcatactcctctgtgcctcagttccttcaaatttctaaaatggggacaataacagtacctgtctcacaggattgttaatgatctaatacatgtacggtgtctggcagatagtaaacatacaataaaatgtagttacctttaatattttaatatattatttactgtaaaagtaattttaacatcctatataataaaattataaattacagttttgctgtactataaatttagtagactacaggatcaatatactaatcaatcaatacttgcaagcaatatttaaattctttaaaaaaattttttttggagacagggtcttgctccgtagcccaggctggagttgcaatggcacgatctcggctcactgcaacctctgcctccagggttcaagcgattctcatgcctcagccccccgagtagatggggttacaggcgtgtgccaccacacccggctaatttatttatttttagtagagatggggtttcgccatgttggccagcctggtctcaaactcctggcctcaggtgatctgtccgcttcagcctcccaaagtgctgggattacaggtttgagctaccgctcccggccctgccaccacgcccggcacaatacttaatttctaacttacaccatagaaaattggccggtgcggtggctcacgcctgtaatctcagcactttgggaggctgaggtgggtagattgcttgaattcaggagttccagaccagcctgggcaacaaggtgaaaccccatctctacaaaaattacaaaaaatagccaggtgtggtggcatgcgcctatagtcccagctactggggaggctaaagtgggggaattgcttgagcctgggaggttgaggctgcaatgagctgagatcatgccactgcagtccagcctgggtgacagagtgagaccctgtctcaaaaaaaaaaaaaaaaagaaaaaaaaagagaaagaaaatggaaaactcagattgagagggtcccccagtagcctatagtacacctacatatgctaacatggcatcttaaagctcattattacagctggcaaatcaaatcactgtgatgtgctcatcctatttccctatcaagaaaactcataacaatctgcttctgtaattagtgagccacagactctaggccatcgagattttccacattccctaattgtcaaatgctgaaccatacttgtactgaataagttgtgatacagtgtaagcaagggaaaaggccttatgtatgtctaacctactctgcaaatagctgcattcttacaaagttgtgtgtaaattgaatttttacaaagcatgtcagcactttgattagtacatttttattgtgtgcttattgcatattcagtgtttcctgtgagctatacaaagaagcataaggcatatgttccaatgtctagcaagagaaagaagtttaataccaagcagagagaaattaggtactactaaactatgaaactgattccagggtattcggaatttaaaaagaaagtggctaggagtatttgacatgatttttcatgaaggaggtgggacttcagttcatttacttactcaacagtgatttattgagtagccaccatgttcactggtggtatgatagtgaacagagcagatatggtcctgtttctgtggagtttacagactagtgaagtaatagaacttaaatatgtgcaagaaaacattctaggtgaggggaccagttctaaacaaagtcatagaaataaatgataagagcatggactatatggcaatcagtgaagggacttgcttgattgtagtagagattttatgttggggaggagcactgcaagtgatagatgcagaccatcttttgaatgctttgaagaactatttaagtctgtctaaaagtcctttggatacactgttctggagagggtttggggctttggggtcatactgccttggtttgatctcatctctactctaatttgtttaagtttagaattttatagtaagttttctcagtgacacaactctataggcaacaaactgatatttacagagtggttggggtcagtaacccttgtatcagttaagcaatgtacacatgaagtgccagtaggaagtccaaggaaaggttgggagaaataaaaggaggttagtaaaggaaagagaaataaatacattctgtgatagttggtagaatgtcatcagaaatgtcttcaagcaaaacaatacatttgcctgtcttttgtttctagttgcgtttaatggtagtgtgttttccttgtctaaatatgagaaagagaaactaaactgcagctacttgacgtgggcatctgagagctaccaatggttggcttaggttatgttctacatttgaagcatctggtcagttttagattgtcttctatatttgaagcatctggctagaccacttgtgtcccagttttctattttacctaaactcaacttggtcagaagcttatgtagtaagtattgtttgtaacctgtgttagtactctcttaacatggcttaaagcatgaatggattgtcaaatgaatacctgttatgacctgtattttttcttgttacctttggatttaatgtaagtataataatgctctaagaacatttgacagtattgttcaggcacttttttttttttttttttgagacagggtctggctttattgcctaggctggagtgcagtggcacgatcacagctcactgcagcctcaacctcctgggctcaagcaatcctcctacttcagcattccaagtagataggaccacaggcatgtgccaccatgcctggctaatttttaaaattttttttttgtagagacgggatcttactttgttgcccaggctggtcttgaactcctgggttcaagtgattctcctgcctcagcctccccaaagtgctaggagtacacaggcatgagccatcatgcatagctgcttattcaggtgcttttaagaaattttttccaccagaaaagtagaaatgatcataccagactacctttgtctcctcccaatcttttattatggtgatgtccaaccttgttataaggaggagcttcttttaatctcagagtcatgagatcagggcagatactgacagtatagttcctgagaagtagttgctggctgtgctgttcttcctttcccaatgggaatcttagctgagacatgtagcagagagaagacattatggggagccagcatggagctttataggaggtgaggtgtctagatctaccagtagatcccgatttgcaggtttgagactcctaccttatttcatccatggctgttgcattgtacaaatctagtgggcagcagccacagtctgtaaaaattatgacatggaattacacaatgtggcagccctggaaactacccaaaccacttctatttctagtcctgtattcccttcaatacctactacatccagcagccgtgatagtcccaacacgtttatcatttgactctctttgcctcccacttgaaggctcccctttaatccaacagataaaaattacatctttgtctaaggatttcaaggtgttgcataaattttcttattctatttaagtatactcatcaagaaaatgataataactgcctcgtctaattcataggtttttatcagtatcaagtggaataatgtatgcaaaaacttcataaattaaagaatactacacaaatataatattcttttcagatatattatgttgtggaaagaatactgaattccaatcagatgtctggcatctcagttctttctgctattaacaaactgtgactttggacaaattactttgtgctctggggactttgtttccttacctataagaggaaacttataatgccactcctatctacccagacacctaagagctactttttcctcacctccacattcagtcaccaaatttgttgtctagttcttaaaatttcttaagttggtcctgccctctctatctccattcagttcctaatcacttcccttttgggcagcagcctgttaaaaaaaattgtggtaaaatatgcataatataatattgactattttaacctttttttttgagacgaagtctcactctgtcacccaggatgcagtgcaatggtgtgatctctgctcactgcagcctccgcctcccaggctcaagcaattctcctgcctcagccccctgagtagctaagattacaggcacacgccacccctggctaatttttgtatttttagtggagacggggtttcaccatgttggccaggctggtgtcaagctcctgacctcaaatgatccacccgccttggcctcccaaagtgctgggattacaggcgtgagccactgtgtccggccccattttaaccatttttaaaggtacaagtcagtggcattgagtgcattctcagtgttgtacaatcatcactgttatgcatttccagatttttttcatcatcccaaactgaaactctgtacccattaaataatagcttctcattctgccttctctcaccccctggtaacctcattctactttctgtctctatgaatttacctattctaggtactttttgaaaaataatttcaacatttatttttgattcagagggtacatttgcaggtttgttacctggctatattgcatgatgctgaggttggggtacaattgatcctggcaatcaggtacagagcagagtgcacaatagtttttcaacccttgccccactccctccccacccagtagtccgcagtatctattgttgccatctttatgtctatgagtacccattttttttttttttgagacggaatctcgctctgtcgcccaggctggagtgcagtggtgtgatctcggctcactgcaagctctgcctctcgggttcatgccattctcctgtctcagcctcccgagtagctgggactacaggtgcccgccaccacgcctggctaattttttttgtatttttagtagagactgggtttcaacatgttagccaggatggtcttgatctcctgacctcgtgatccgcccacctcggcctcccaaagtgctgggattacaggcgtgagccaccgcgcccggctgagtacccattgtttagctaccacttataagtgagaacgtgtggtatttggttttctggtctgcgttagtttgcttaggataatggcctccagctgattccatgttgctgcaaaggacatgattttggtctttttttaatggctgcatagtattccatggtgtatatgtaccacattttctttatccaatccaccattgatgggcacctaggttgattctatgtctttattattgtgaatagtgctgcattaaacatagaagtgcatgtctctttttggtaggacaatttattttcttttggatatatactcagtaatgggattactgggtcgaattgagttctaagttctttgagaaatctctgtactgctttccaccacggctgaactaatttacattcccaccaacagtacctaagcatttctaggtacttttaataaatggaataatacaatatttgcccttttgtgtctggcttattttacctagcataatgtctcaaaatttcatccatgttgtagtatatgtgagaatttctttcctttttatggctgaataatattccattgttgggtaataacgttttaactggtcctcctaactccaggctttgccctatcaaatttgtccttcgtgatctgaccttacttacctttacaatctccttgttgttaccattcatgccatatgcctcagccataccagtggtggtccttaaatatggcatgctgtttgacaactctgtaactttattcatggctcttttgtctgaaatttatttccattcttctggagaactcctactcaatcttcaaggccgtttacctaacaatagtggatgggtgaaattatgatacgttcatatagtggacttctagtcagccttttaaaattatggcatatatattagtggttaaaagcacaggctctggaccaggcttactgggatcgaatttcaaatctgtcacttactaactatgtgaccttgggaaagttccttaccctctctgtatctcaattttttcatctatgaaacagggatagtaattgtatctatcccatcaggttgctgtgaacatttaattacttagaagtattagctaggccaggtgcagtgcctcacgcctgtaatcccagcactttgggagtcccaggcggatggatcacttgaagtcaggagtttgacaccagcctggccaacatggtgaaaccctgtctctactaaaaaatagataaaaattagccaggcttggtggtgggcacctgtaatcctaactacttgggagactgaggcaggagaatcacttgaacccaggaggcggagggtgtggtgagctgagatcacgctactgcactctagtctgggcaacagagctagattctgcctcaaaaaaataaaaataaaaataaaaatattagctattatgttttatttatttgttagtttttaaatttttcgtagagatggggtctcgctatgttgctcaggctgatcttgaactcctggcctcaagaagtcctcctgctttggcctctcaaagtgctgggattacaggcgtgagtcactgtgctcggtcaaaagtattagctattgttatatattaatatttactgtcatagaaaaatgtttattatatagtgttaaatgaaaagaaacatgctgtaaaatagaatagtatatcatttttgttaaaaatgtgtgtgttcttgggtgtggtggctcacgcctgtaatcccaacactttgggaggaccaggcaggagggttgcttgaggctgggagtttgagaccagcctgggcaatatagggagacctcatctctacaaaaaataaaaaattagctgggcatgtggtgcatgccttgagtcccagctactcaggaggctgaggtgagaggattgcttgagcctaggaagtcgaggccacagtgagctattactgtgccattgcactccagcctgggcaacagagtgagatcctgtctcaaaaaaatgtgtgtttatatgtagacacacatataataccctcctagacttacatacacacaccccaccccaccccacatacacaaccctcaacatgttagccttcattatttctcagtgatagaccaattggttgtttattttttatatttgcttatctgtatttcctgtttttctccatttgacatttatttcttacatttggggagcatgaaaaaagacacagttaaagcatctcttctgtgaagccttccctgatttcccttccttcgtcctttagggcaccagaataccttgcatccctgaactccttaaagcctgtattatattcatttacattttaatccccaactgggactagtgcagagcctaaaagatacatgaacttagccatattagtaaggtgaaaatggaattatgtgcaagcactttacacatgttatctcatatacagcactcagcagtctcatgagtaagagttatctgtgtttttcagatgaggaaactgagcatcagaagagaccaaacaatttgctgaaggtatacaacagtaagcaacagaatttggattcaaatccaagtctgtctgatgccaaaggtggtcttttcaatgtatattgaatgactgaatgatctaatgaatatatctgctgtctcagatgacataatttatgaaagacttattggtaaacaaatatgctatatgaatgtaaagatatgttgttgttattttctgctatattttcatctgcaccctagattctgactaggcaaatgagctttccttctccccatgcacaattttttccctctgttagtataaattggcaattttggctctccatttgtctttttatactgcccatgctctttccactctttaggaacctgactcataattatgatattaagcttttcagattaatctagccatgtccatcagatttactgttgtgtgtacatgttgagaaaactaattagaaagtatctggccagatacaatttgtttcagtgatgccaaagtatggtaattcctagtttaatgtgtttacctttttctttttttttctttctttctttttttttttttgagacagagtctgtttacctttttttgtgtgctgatatgtccacatttaatttcctacattcatattcataccgctttcaaaagaaggtgttgtcaatgataaaacattagacagaaatagtttttagacagaggatgttaataagttcagcctatgtcttatttaggtttatgtttttgtgtgtatgtgtgcacagccttcatcatttaagtttatgttttgtgtgtatgtgtatgcagccttcatcaaaagaaaaaaggcagatagtcaagaggtgttttaataatttatatcacagctacaacagaatatactaaaccaaaatttagaatttgattatagcttgactccctacaattttttcagaattaaaaagatgaatcccctttaaagcaaactaactgaagggaagcatctactttgtgaaaattgcctgtctaaaatggggtgggaaataactcccttttaagtaccgcacttttttttattctaccagaacctggtttctaaagatttcaacctatttttatagtctcagttttgtgagatgacaaagttcatcttagtgatttctaactaagaaagcacaaccacagaaacgaggaatggattctggaaagggaaacttcctgcaaattatgatgaatttacagaaatagtaaatatttaaattccataaatagttaatattgttgttgataattatttgtcttgatttctgttcaagaagtatacatttgaattagcacacagtttattttattcctagcaatttagtatatttttcatagccatcaatatttgggattctgcttgcttatgattacaaatcacttgaaacctgccagttgaaaattctcaagggtgtgaaatgatatgggccttcagtgaattcattcccctttatctgtataaaatacctggctaaacagttgtctttgacaattttaaattactgtttcctttcttaaaaactcctttccagaagctgatctcccgtacatttccagtacataatttttcatccttatctgtcctgacagtgattcagctttgaataagagagaatgttaccagagtttcacctttattggcctaagtctttgtttattttttgagacagagtcttgctctgtcgcctaggctggagtgcagtggcatgatctcggctcactgcaacttctgcctcccgggttcaagtgattctcctgcctcagcctcccgagtagctgggactgcaggaacgcgccaccacgcccagcttatttttgtattttgggtagagacggggtttcgccatgttggccaggctggtctcgaactcctgacctcaggtgatccacccacctcggcctcccaaagtgctggaattacaggcatgagccactacgcccagccagcctaaatctttaaaacaggacatgaaaggaattgaagggttgggtatgggtggggttgtagatctagactatatttatggaatgtttgcttccttcgtgctgaaaattgttctttggaccttgggatgaaaagagaaaatatatgaaaaataagaatgttatgaaaagtctaagtattctgaaaaatacattagtatactactttataatcataccatataaatatttcagctataaaaattaatgcaaaataaattttctcccaatatgttaactgctttaaaaaaaagtattggcaagattgattatattctttcctaagaggaaagataactttgcataatcaccaagatggtttaccaacatacaccacgtatactgagtattacagtcttcaccaacatgagtcaaatgctagcgtgtatagggttggtagtataaacctacctggtacctttttggttttgctgactaaatggtgctaatgaagccagggttatagacttcatctctgtgggagtcacttgttctttggagtcattaggtatgccactaactctgctccacagttttccgaatgcagtttgttcattaagaaagggaggctagtacagagtaaaaatagctcagcaaaaagccatcatcagtacccatgcccttagcctcctgatagggggaggagggtctttaatgtccaggctttcaaactcacatatacatttttattattaatcagtggaggctgcacttagaaatttatttctttggacttctgcaatattctgcttataaagtgtttctgtggtttcaactgtagatccctttttgcctttatctccagactcttttgtctcaaaactttatggtctcagagaactaaggaaagacttggctcactatatgcatttgcagaaagtaataaggctttttttttttttaacgccataaagtgatctcagcaaagtgacaaatctacagtttcagaactgaaactaaacaactctttcgtggtttattagactcttctatattaagtagagcagttttaggtgagcctctgggaatctcatgaaactgagcttccagtgtggctcatagtcgtttgtaatctatacaaatctatagtatctttcattgagtatcattaaagaatgaggtattttgcagaagtgaatttccaaataactgaagtataccctttacatttttgtcattcagggatctgatgcatgcatcctacaaaggcatccttgaaatacatttacttttccaaaataaaaatacttttatttctgattagaacattgataaatggtcaatgtaaaaacaaaatctagtcaatatttatttatttatttatttgagacagagtctcattctgtcgcccaggcagtgggggcaatctcagcccactgcaacctctgcctcccaggttcaaatgattctcctgcctcagcctcctgagtagctggggcaacaggcgtccaccaccacacccggctaatttttgtatttttagtagagacagggtttcgccacattggccaggctggtctcaatctcctgacctcaagtcatccacccaccttggcctcccaaagtgctgggattataggcatgagccaccacgcccagccccagtcaatatttagatatctctcctttctgagatttattttttcttacagcatttatcactacttgacttttgcaatttttttttttttgagatggagtcttgctctgtcacccaggctagaatgcagtggcgcaatctcagctcactgcaacctccacctccccagttcaagtgattctcctgcctcagccccccaagtagctgggattacaggtgcacaccaccatacccagctaatttttgtgttttcagtagagacggggtgtcaccatgttggccaggctgatcttgaactcttgacctcaagtgatcctcctgcctcagcctcccaaagttccaggattacaggcatgagccactgcgcctggctcactacttgattttatacattcctttgtttgcttattgtccatctccctcaagagaatatgagccccatgaaagaagagacagtgcccctcttcactgctgtatcaccagcacgtagattagtacctgaaacataatgggacttcaataaatatgtgctaactaaatgaagaaagtagaaatcactcttaattccaccatccagggattagccactgttaagattctggtatcatttctttctttttttttcttttttaaagagcaaccctattaactgatctggtatgatttctaacaaaagttttttctcttacatacacattctcatgtgtatatataaatttatacaacattttaatagaaataggactatcgtcaattgtttgtagcctcttttttcacttaactcatcacagacatgatgtcattaagcaaacaattatgtgtttttaatggagatatgataatatatttgaccaattctgtattgatatttaggttggttccagtttttcaatcacataaacaaccttgtgataagcatccttagccatacatcttagtacagttgtctgtacctttcctcccctttgaatatattcttagaactggaatttctgggttaaaaggtatgcattttttttattatactttaagttctagggtacatgtgcacaatgtgcaggtttgttacatacgtatacatgcgccatgttggtgtgctgcacccattaactcgtcatttacattaggtatatctcctaatgctatccctccccccatcccacaacaggccccggtgtgtgatgttccccttcgtgggtccaagtgttcttattgttcagttcccacctatgagtgagaacatgcggtgtttggtttttttgtccttgcgatagtttgctgagaatgatggtttccagcttcatccatgtccctgcaaaggacatgaactcatcaaaaggtatgtatattttaaggctttttttgagacggggtctcactctgtcacccagactggagtgcagagcttcaattatggctcactgcagcctcaagtgatcctcctacctcagcctcacgagtagctgggactacaggtatgcaccaccacacccggctaatttaaaaattttttgtagggacagggtcttactatattgcccaggctgcctattttaaggcttttgataaatattgccaacttgtcttttggaaactctgtagggattggtgttagtttatactaccatcagcagtatatcatagttcgttaactcaaaactattttgatattaatgattttgaaaaaaaagactttctaaaacacattaagtatttttagtgctttattgcttttctaagcagaatacctgtacctgatttaattataacacacatacacacacacacacactcatatatatatatgacatgacatgtgctcgacctgttattgctcactgtccttgagttgagagtagtgttcttccttctaccactgcctccatggggcagagaggtcctttccagagctgagaatgtcagtaagagatatatgttccttggcatcttgacttcctaattggaatttactatatgtttccccacacgaaacagtgttatagcactattaatatatagtccaactgtgctattgtctaaactcctaagaaatggacctttgaacctagccatcatttataaagttgttcttatgagaaaacatgtttcatcttcaaaattgagaaacaactgttcaagaaacccatttttaaattgaaggtacacattcaaaaagtatatattgagggcttattgtatgtgtgaagataaatgtgctaggccgtcaatgggtaattcttttcttgatgatgcaatgttaaggtacccctgccccctagtcatcattttggtcaggtcaggacaaccagttgcaattgtaacccagggagaaaatattactggagtgtgtttgctaggcaggggaccacgtacaagggtttctgcagaactttggaggccaggattgaaggaatagctgctcagaagaggtagaagagaaaaacatacaggaaatggtaaggaagtgggaaagttggaaagattaatgtgtttcttttagattaaggggagaagagggtactgtttgtcttctcgagatgagtgaggatggacattcaggctgacattctgccatcaaaatgccttgtgtaggaatattagtctttgcatataacttaacaaagctgacctgccattgttgtgtttttgcttgaggacagtgccacactgctgctgccatgtacccaaagaattgcttgaacccatccccttcattacttcaactctaatgactattacttttcattaatttaggctgtattcttttcagacaacgtaaggtaggggaaaagagcctactttttggaatctcagaggcctgagttagagtcagattctatcattcattaacttatttgtattaggcaaaggagctctcactatgtcttcgaacttgaatcttctctagaaggagaaaagttttatgtgattattaggattaaagtgtttaaaatgtctggagtatgataggaacgaaataaattttaatttgtttcttttctttttctttttttttttttttgagacagggtctcattatgttgcccaggctggtcttgaactcccgggctcaagcaatcctcccgctttggcctcccaaatttctgtgattacaggcatgagccactgtgctcagctaaatcttaatttcttttattctcctctcctccacctcattttccacccactaccagaatcatcttctattttaaaaatctgcgtctgaaagaataacattataaaagtagtatattgaggttaaacgtggccacctggccatatgtttagctctcgtccttcacaaaactccattaatgtgacagtgaaaagattttaaaaaggttacacctgcaaggaaaagaaaacaggagagctaaatcagcagagggatgaatttaatatatttttggaagataagaagcacatgaagagggagaaccttccagcagaggaggatattaatgagaagtgagctctttaatctcacattacccatgataggctcagaatttgaaggtaagttgtttatcctgaaaggtgaagaagagacccagggctgaaaataagggaaatgttttaaaaactgaacaggaagggattggacctcttagtttttctcaggagaccaggagtatagtctcagtactaagtgaatctgaaaggctctgagctcctggacagtggggtagagtggaggatactaaagcattgggttgagaacagggaaattcagtggaagtctgcatactgcgtggtcagccccttccccacaccttgctcccaaatatagcagcaaatataccttgctttgcagataggagattggagaattcttttcttggaaaatgaatgatcccagagaaaagaattccagatggtaacatgatagggttccgcaatgaaaaagatagctagctgccattcactcaatactgaaatgcatagtggttaaaggcatgggctctagagttaggcttcctgagtttgaactcagacttaactacttaccagctatatgaccttgggcaagttacttaacctatttgttcctcagtattcccatctttaggatggggaaaattatgtttacctcaagattgttgtaaaggttaaatgagttaacaaagcactgctgatggtaagctctggtaaatactagctgaggaaggaggaagtacccagggacttccttagctgtcaaaggcagctctcgactttagatcatgccccaatggtgaccagcagccttttctacataggtggtacatggggtctgaacaggggctttgaccccacagaagacacctttccccagttcctctctctcattcttaactctgtcttttaggaacattctttttttttttttttttttttacctttttttttattttttattttttattgatcattcttgggtgtttctcgcagagggggatttggcagggtcataggacaatagtggagggaaggtcagcagataagcaagtgaacaaaggtctctggttttcctaggcagaggaccctgtggccttcctcagtgtttgtgtccctgggtacttgagattagggagtggtgatgattgttaacgagcatgctgccttcaagcatctgtttaacaaagcacatcttgcaccgcccttaatccattcaactctgagtggacacagcacatgtttcagagagcacagggttgggggtaaggtcaccgatgagcaggatcccaaggcagaagaatttttcttagtacggaacaaaatgaaaagtctcccatgtctacttctttctacacagacacggcaaccatccgatttctcaatcttttccccacctttcctccctttctattccacaaaaccgccattgtcatcccggcccgttctcaatgagctgttgggtacacctcccagagggggtggtggccgggcagaggggctcctcacatcccagtaggggcggccgggcagaggcgcccctcacctcccggacggggcggctggccgggcggggggctgacccgcccacctccctcccggacggggtggctggccaggcagaggggctcctcacttcccagtaggggcggctgggcagaggcacccctcacctcccggacggggcggctggccgggtggggggctgaccccccccacctccctcctggacggggcggctggccgggcggggggctgaccccccccacctccctcccggacggggcggctggccgggcagaggggctcctcacttcccagtaggggcggccgggcagaggcgcccctcacctcccggaccgggcggctggctgggcggggggctgacccccccacctccctcccggacggggcggctggctgagcggggggctgacccccccacctccctcctggacggggcggctggcctggcgggggctgacccccacctccctcccggatggggtggctgccgggcggagacgctcctcacttcccagacggggtggctgctgggcggaggggctcctcacttctcagatggggcagttgccgggcggagggtctcctcacttctcagatggggcggccgggcagagacgctcctcacctcccagacggggtcgcggccgggcagaggcgctcctcacatcccagacggggcggcggggcagaggtgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagagcggctcctcacgtcccagacgatgggcggccgggcagagacactcctcacttcccagacggggtggcggccgggcagaggctgcaatctcggcactttgggaggccaaggcaggcggctgggaggtggaggttgtagcgagccgcgatcacgccactgcactccagcctgggcaccattgagcactgagtgaaccagactccgtctgcaaacccggcacctcgggaggccgaggctggcagatcactcgcggttaggagctggagaccagcccggccaacacagcgaaaccccgtctccacgaaaaaagtatgaaaaccagtcaggtgtggcagcgcgcgcctgcaatcgcaggcactcggcaggctgaggcaggagaatcaggcagggaggttgcagtgagccgagatggcagcagtacagtccagcttcggctcggcattagagggagaccgtggaaagagagggagagggggaccgtggggagagggagagggagagggagagggagagagcaggaacattcttaagactgtctccaactgcagcattgaactcttactgttcattttttcaataaatgtttattaggtgcctactctgtgcaagtactgctcaagctgctggaatgacagcagtgaaccaggtctgtcataatagctaacatttactgaatgcttactgtgtgctttacatgtattaagttgttgaattctcgaaacaaccctctgaaacagatgatgttatgatctctgttttacagataaggaaactgaggcacagagattaaatagcttgccaaggccacacagctagcaagcagcagagataggaatcaaatccagacagtcttgctcttgagtctgtttaaaaaaaactgtagagacaggggtcttgctgtgttacccaggctggactggaacttgagtctgtttttaaccattatgcctccctgttctcatggagcttatgttctggaagtgggagactgacagtaaataagtaaacaaagaaaatagagaccaagtagcaataggtggtaccaattgagtatcccttatcagaaatgcttaggaccggaagtgtttcggatttcggaatttttggattttggaatattagcatatatgtaatgagatatcttggggatgggactcaggtttaaacatgacattcatttatgtttcatctataacttgtacacatagcctgaagttaattttattaatattttaaataattttgtgcatgaaacaaagtttgtgtacaatataccattagaaagcaaaggtgtcactatctcagccacccatgtggacaatctgtgatcgacctaaccattgttcctgactctgaatttatatgctactggtaagcaatcattttcttgcacttattcacataactgtaaattttaatcaattaaaaaacatgacataccattaatacagtgaaaaaacaaggtgttcagggtagcaagcagtacagtagcatcaccagagttccttttttagctgttaaaccacagcaacaaacaacagcaagttttcagtctctacttatgatactgtgttttgattaaaagattactatatactatattttatgtttttaggtgaaaagaaacattagaagtaggtcctgtagggatgaggaggcattctgctgtatggctttttaaaatgtcttttctaggccaggcgtgatggctcatgtctgtagtcccagcactttgggaggccgaggcaggaggattgcttgagctcacgaggttgagaccagcctgggcaacatagcaagacctcgtctctcctaaacatttaaaaaaaaattagctgggcgtggtggcacacacctgtagtcccagctacttgggatgctgaggtgggaggattgattgagcccagaaatttgaggctgcagtgagctatgttaacaccactgtactctagcctgggtgatagagcaagaccctgtatcgaaaaaaaaccctgaagtttcctctacagtcttctgcctcattaacaatggttttttcttagaagtctctctttgatattttggacagatatgatgtcttgttctgttatgaatgcacgcaggtacattgcagctgaagggagctgggagggcctttttttcccccttagggatgctgaataaactgttgtgtgcctgcattttgattgcaacccatcacatgaggtcggggtggaatttctcaactcgtggcatcatgttagcactctaaaagtttcagattttggagcatttgaggttttagattttcaaattaggaatgctcaacctgtctgataacatataaaacaagggattgtgatacagagggactggcagagggtagcattagttggggtggtcaatgtttatgagcaccaagtgagataagttatagttttttttttttttttaaacagccttactctgttgcacaggctggagtgtagtggtgtgatctagtgtcagcccccagagtagctgggactgcaggtgtgcaccaccacacctggcttttttttgtgtgtgtgtcttttgtaaagatggcattttaccatgttgcccaggctggtcttgaactactgggcttgagcaatccccctgcgttggcctcccaaatgcgggattacaggcatgagccaccacgcttggctgagttctttaagaattaattacttagagtattgctgtctctgcagatttgcaaaatgccctttctatgatttgatttataatgctactcccacacgttttaatattactaataaaaagcaggaatagttcatgtgcactggtgtcttactgtgtatgagggactatactaagcaatttatatagattgtttcattttatgctcatagcaatgctataacaattcttttctttttcagtcatggaaaactaaagcttaaggagacaagtgacaggcccagggctttaaatttagcaagtggcagagccaggatttgaacagaggtagcctgattccagaaccactgctgttaaatacttaactattttattgatgaagtgatatgtgcaaggtaattctttttataaaaaatagctgacttttatagagatttaaaatattgtaagcattactgggtcttcacagtaacagtgaagcttacctatattttggaggcttcaagacaggacataaacaatacattttgagtaaagaagcttctagggttgtatgattttatcaccccaaattagcaattttgttcatatgaactaagatgcgtaagattctttagcacaaagccagagccaggatttgacaccaggccagttgacttaagatgtagagctgttacccattccactgcagagtaaatgataacatgtagcttatctttgttcaaggtactgtgggaagccaatctagtgaaattacattttaacagtccccaaggaatgtttgttaaataatttttagttttttaaaacttctaaatttctcaaaacaaaagctgagtgaagacagttttattttacagacttggagacagtatggagcagtggcccagagtgagagttcttgggtcagattgtctggtggcttacgctaattttcacttcttgatttaactgattcaagtattaatataattttgaacaggcaaccttgccctccaagtcttagttcccttaattgtgaaagaagctaatatagtatcttcctcataggataagtatgaggactaaatgagacaacctctctacaaagtgcaaggcatggtgccttttggccagccatctcttctcttggaaatggacccctcattcatcattcatgaatccaaagtgaagttttggctccattgccttggttttatcagtgcctgaagtattcttctgacaaatagtgtgcatgaacttagagtatagactttcctgacatatttttgttgctcactttcaagttttaaaaacttacagtaaaatacacataccataaaatttaccatttaaaccatgtttaactataccagttctatggcattaagtatagccatactgttgtgcaaccatcactaccatccacctccagaactttcttcatcttcccaaactgaaactctatacccattaaacaacactagtggcagtttttgcttattattcttagctttgtgaccaaggctgctagttaggagaaatgttactctgtttgtacaaagaaagactttgaaagaaatgtgattagaaatctatattatcccaaaagcataatccataaatgaaaaaatggatatactggacttaattaaaatgaaagcttttgctctgtgaaagaaagtgaaaagacaagccataaactaggagaagatattttaaatcaaatttttgtttaagagatgcagtctgtgttctccaggctggacttgaactcctggcctcaagccatcctcttaccacagcctcctgaatagctgggactacaagtatgtgccactgtgcccagctgcaaatcacatttttgacaaagacttgtatccataataaacttttaaaagcctccaaatttaacaatgaggaaacaaccaaataacaaaatgggtaaaagatgtgaataggcacttcacctagaagatatgaaaatagcaaataaaggaaatgcagattaggcagatgaaaattaaaaccaaaataacaattataacaaatgtaccactctggtatgtgatgttgctaacgagggaggttgtatgtatatggtggtaggaggtatttgtgaaatctctgtactttctgcccaattttgttgtgatcctaaacatcatctataaataaaattaaagtgagataccactgtacacttaaagcggaaataccagttgttggcaagtgtgcagagcaactggaacttttatacgtttctgatgggaatacaaaatgatactgccactttggaaaacagtttgccagcagtttcttatgaaattaaacctgtatctccaatatgactcagcaatcctacttctagatatctctccaagagaaatgaaaacctgtgtttacacaaaaacctgtatatcaatgtttatagtagcattgttcagcattagtcactaaaaattggaaacaacccagttctttcaactggtgaaaaagatgaatagattgttgtatttttataccatggaatatactccttgattcgtgcaataacagattaatcttaaaatgcattttgctaggtgaaagacaccagatacaaaaggctatgtatcatttcatttatccacttatatgaataatcattccatttatataaaaatctgaaaaagcaaaactatagggaggaaaacagtggatgccagggtttgggggtatagggaagtattggttataaaataaaggcatggcatgagggattttggaggtgatgggatggttctctctctctctctctctctcacacacacacacacacacacacatacacacacacacacaccccactacccctctctctctcgccaattgtcaccaaattgatgggcatgttgtcagtgttaatatttggtctggtgtactaattaccacccctcccaaaatctatattatcagcttggtagcatatatagtacaatttcattaaagaaaataaatgatgatttattaactaatatgtcacatgaaaagtcatagaatgtgtattttagtttaaaaatatgggtatggatatacacacacacatttatttatcgtaagcgtcttactttactggaatttgctggttataccagataaactttttccactgcttgagctttcagtagaccattgtgcaagttaatgataaatttcgtgagcataacacctacttaagtttctcagaatctgttacagaaaagcatttatcttgcggttcaggcagcctgggatggaaggtaaatgctttctttttataagtatcctgaaatttcaagtgtaatagggaacaagatattaacataaattttcaaaaggcctcattcagttctagttccttttttttctttacaaacttaaatctcttcataaccatcagatgccataccacccttgtgaaacagtctgctagaactagacatgtctcaggattcttagaggactggggtaaccaaagtgggatttgaacttgtttgaggaatatacatgggtagtgagctgaaccttttaattcctagaatttatgggtttaacactacaagggttgtcaccctgtttatttctgtaaataattaaggcatgtttattgtagaaaacttcacaatgcacagcacagattataagagtactaccaggattattactcctaagataactgtttatttagttttccaaactttgctacgtaggtatatacatgtgtgtctgtccatgtctccttttaaaaacaacaaaaaaacctcattttaatattcaatatattattgactgtctttgtatgtgagaaaatttaaatataatagttgtgtattctactgaatatatggaatattatttattttaccaattcccattttattagtcttttaacttatatccacttattttggctgggcgtggtggctcacacctgtaatcctagcactttgggaggccgaggcaagtggacaacttcagtccaggagttcgagatcagcctggccaacatggcaaaaccctgtctctactaaaaatacaaagaattagctgggtgtggtggtgtgtgcttgtaatcccagctactcaggaggctgaggcacgagaattacttgaacttgggaggcggaagttgcagtgaactgagattgcaccactgcactccagcctgggtgacagagcaagacactgtctcaaaaaaaaaaaaagtacatatatccacttatttttgctctgatgaatattcctatattagtatctttgagtatctttccattatccctccatttatttccttaggatatattcctgaaagcagtatggccgggtcagagagtggcactttttaaaaacttattttttattatcaaagtagtatatatgctcatagtaatgagaagacacaaggtgcaaaaaggtacaaggtaaacagaaaatgctctgacttaacagttcccctctcagaggaactgtaaaataaacagatatacatttacattaatttatacattctatagaaaattcatgtgtgttagatgatatatttgttttcttgaaacatccactctaattacagagtttactaaggttacagagttaatatagagaggtattagagagtttaataaggttggcagttaaatatatcaaaattatgcagttatacaattatatcacatatacaccaacaataatcatctagacaatataatgaaaaaagctcttattcgtatatatcttcttattaagtttattccttagtatttttttttgttttttgggggggaccccccaaaaacaaaaaaatactaaggaataaatttaagaaatgtgcagtaagattcaatattgtaaaaagaggttaactctatttaagttagtctataaatttaagagattttgatggagggaggatctgacacaatgatgttaaggttcatatgaaagagtaaatatttgaaaacacacagagaaattctgaaaaagaaggatgacaagggggatgtgccttattagacaaaaaaatgcattaaaatgtacaacaattttaaaaagtaacattgtacctaatatattgtacacttaaatatgtgttaagagggtaactctcatggtaagtgtttttactccaataaataaaattttaaagaatttcttcatcccccctccaaaagtactggcaccaaaatagaataacaaatcaatgcaagaaaacatccagaaagagacccccaaataaaaatttagtatactgtatatttaatagtggtagcttttcaggtagatgaggaaagagtggcttacttaacaaatggcattgggacaatcagttaatgattttgaagaaaaaaagttagtttcttatgttatatacttaaactaaaataaattctagatgagttaaggatgtaaatgtaaagtacaaaaggtactagaagagagtgtaagttgaggtaaggaaggccttccaaagcctgacaccaaaggcatggtacttaaaaattaaaaaaccccacaaacagataaaagataaacaagaaacttaaaaaagactaacaatatgtgacaggtaaatgatgaatatctttaatatgcaaagatctcttacctatctgtaacaaaaaaggtaaacacccaaaataaaaatgcacaatggaagtaaacaggcagttcacaaatgaagaatacaaatggtcaaaaaatctcacaaagttattggagataaaaaacagatgatcatttttcacataacagattgacaaagcttaaaaagaattttcatagtacctgataaaagtgtggctagacactttcctatactgctagtgtaagtgtgaaatgatatctttccagagggtaatttacagtatgtatcacaagccttaagaagtactatttatatttagaacatgtggaaaaataaaaaataaataagtactatttatatatgttgttagtgggtatataaattgatacagtttttctggagggcagtttggaactatttatcaaagtttagaatgtacatgccctttgtcctagcaataacacttccaggaattttatctaaaagatatgctcatgaagatgtatatacaaggatattcattgaagcagggtttataatagcacaaaactgaaaacaacctaaatgttaatcaaaaaggaactaattaaataaaatatagcatatccacataagggaatattacaaccattttataaaatggtacgtttatctatcttctttggggatagttcagttttgttttttattgtggaggtctatatgtccttaaaatttttttttctttttaataattagagatgaggtctcactatgttgcccaggctggtcttgaactcctggcctcaagtgatccttggcttctcaaagtgctgcgattacaggcatgagtcactgcacctggcaggaggtttatatgtcttgatacaaggtgtaaaagatatgttaaatggaaaatgcaaggtgcaaaatagtacatatagtatgatcccatgtgtgtaaagaagaaaaaatagggaagatgggcattacagaggctttaaaatgcactgggaataataaagttttcatttttatctttagagtatagttcatgagtgaattcttttccattttttttcccagttatcttaaaagctctgttgattgtggatctgagaactaacatcacatgttataaaatccaaatagaaaatatatttaaattattagacaatttaaagcttatgagaacataagaataaaattactgcattcctttgcttattaattaagtatatcacactaacagaatttatttctgtgggaacaatgttaactcataggacccagatggaaatgatatgccagggtagagattcagatctttgagccttttgagtagatttttctcagaaaaagaaagatgttctctcaggtttactatttttaggcagattgagatgaccatattgtcttagttatccaggcagtctgacctctaagacctctaacgttattttgcccaatgcagattgattggtatttgttgttgttggattgagtctaaaaaagaatattttctcaactccaaaccatcatattatcttctaatatcaaaatcttcatttaacatactaacctctgtaattgctcatccatggggttttaatgtaacttacccatgtcttgttcctaatttgataaattttctatattactagttttggagtagaagatttaattcaaatgttacaaattcctttgtcctaaatctatccccaaagtcagaacaggacatgctgttttcctcaaccagtttaggaactccttttttttttgcggggggggtaggggagcggacagcatctagctctgttacccaggctggagtgcagtggggcgagcatggcttactgcagccttgaccgggtcccaagtgatcctcctgtctcagcctcctgtgtagctgggaccacagtcacgtgccactatgactggctaattttttttattttttgtagagacgagggtctcattttgttgtccaggctggtcttgaacacctgtgctcaagcagtcctctcaccttggcctcccaaagtgttgggattacaggcatgagccaccgcatccagccctctttctctgaaagtattattttcttttcacaaatggatttttctagcttttgttttttgtttatttatttattttttgagacacagtcttgctctgtcacccaggctggagagcagtggcatgatctcggctgactgcaaacaccacctcccagtttcaagcgattcttgattctcgtgcctcagtctcctgagtagctgggattacaggcaagcaccaccacacctggcaactttttgtatttttttagtagcaacggggtttcaccatggccaggctggtctcgaactcctgacctcaggtgatccacctgtgttggggcctcccaaagtgctgggattacaggcatgagtcaatgtgccctgcctttctaagcttttaaactaattatagtgagacttgttggtgctgctttttaaaaattatccttttatgattgaagaaaactgtctgattttctttttgattctcttataaatttaagattaatcttacagatttgaaaattaaagaatcacattctgctaattattttagtgcccagcactaaaagaattccttttttggtatgttttctgtcagccctctcttactgttgttttcttcacttccttaattgcagtttcctctttgttatctttaacctttgctcatttctgcctttaaacaggaactgtatatgacctgcttaatcttgggtttgggaaaaagctatctacaaatgtccaaagctatagaagacaataaatgcatccaattcagacaaagaaaatgtttggctaatttcagcattttcttaattattttcctgaataataaagtaatacatgcaaaaaataaaaataagaaattaaaaaaataaaaaatacatgcttgttttaatgaaactaaagtaatatagaattacataaagtaaaaagatagtcactccctcaaagggtaatcactattaatagcttgtattcttctagaccctttactagtcacagatatgcttccatgtcagtatatgcagatttagcttcttgttcttaactgctgtatagtattctatagtatggatgcaccataatttatttatctattccctaattgataggcatttagagagtctccaaattttaactattttagatatgcttatacctataactttatacatctgtgtaagtatttttgtagctagattcttttaagtaaaattgctgggtcaagttaggtacacatcatatgttgataagtattgcaaatttgcctttcaaaaaaggccgtagtgatttacacttcattaacagtatgataaaatatttttctatacccttgaccatgcttaatagatacataagtcttttaaatttttgccaacattataagaaaaaaacacgatgtcattgttttagtttgtatttaaatttctcaaatttgtgtttttaactagtttagttgaacatcttgtaacaactacattatatgtcaaataaaaaagtttgtaaattagagcatatgctataaaccttcagcaagaaaaaagtgtacacagaagaaagtttgtaattgtttatccctctttttctgcatatgtttgggataaagtaacataatatatgaactgatcatcttttcaggtgcctataaagaactcccaactggtagactttagcatctgttgggatgataggccaagtgatatttttaatttaaaatttttttagagacagggtctctagctcaggctggagtgcagtgacatgatcatagctcaccgtaacctcgaactcctgggctcaggtgatccttcctcagcctctggagtagttgggactacaggtgcactaccacgctcagataattttttttaaaaagtttatttaaagacgggacctttctgtgttgcccaggctgatcttgaatgccaatcctctagtgatcctcctgtgcccggccccaagtggctcttttctaccctgctctctcacttgttgtctggctgaacaggctcaagtctgccagtgaaagtgacttagctttgtggacagttgtgtcattcctcagtatggtatgtatgtatgtatgtatgtatgtgtgtatttatttatttatttatttatttatttatttgtgatggagtcttgctcttgttgcccaggctggagtgcactggcacaatcttggctcactgcaacctctgcctcccaggttcaagcaattctcttgcctctgcctcccaagtagctgggattacaggcgcctgccaccacacccagctaatttttgtatttttaattgaaatggagtttcaccatgttggccaggctggtcttgaattcctgacctcaggtgatctgcctgcctcagcctcagcctcccaaagtgctgggactacaggcataagccaccacgcctggccgaggatgttatttaatgttttgttttgttttgttttattgagataagatctgactctgtcacccaggctggagtgcagtggtgacattttggctcactgcaaccactgcctgcctggctcaggtgatcctcccacctcagcctcctgaatagctgggaccacagtcattcactaccacacccaactaacttttttgtattttttgtagaggcggtgtttcgccatgttgccccggctggtctcaaattcccagactcaagcgatctgcccactttggcctcccaaagtgctgggtttacaggtgtgagccactatgcctggcctggcaattatctttgactttataaatctttcttatattttagataactgatatagctcactactatttaatgtttatctgccttgataactctttatgttgtgtttataggccagagtccctgtagacacatgtactaattgaccagaattacacaataaaattgcagagctacatagtagcagaatagtaatttgccaaattattttaataggtcaatactgaaaggataatattatttgctgacttttattaagacctatattaagattctatagtgttatatttctaaggttacaagtttttttcaagaataaaaatatatgtttaattatgagttttactgttcatccaaaggtgtaacataaaataaatttacaggtgggataagatggattgagttacaattttttaacctcaggatctttgatggctagttcctacccctaaggtcatcttatgtgttcatatgcggtaatgcttttttcattagattttgcatttcaatcacagacatatttgtcaaaaaagatgaggtaggctggacactgtgactcacacctgtaatcacagcactttgggagacctaagtgtgaggactgcttgagtccaggaatttgatgccagcctgggcaacatagtgagaccccatctctacaaacaaatccaaaacttagcaaggtgttggtggcacgtgtctgtaatcccagctactcaggaggctgaggcaggagaatcacttgaacccgggaggcagatcgcagtgagccgagattgcgccattgcactccagcctgggtgacagggcgagactctgtctcaaaaaaaaaaaaaaaaaattccatttccttttttatatccattctaaaaataagcatatgatgagccaagaacatccactaatgaccagttgttacatccttttatcttgatccctttgaactcattccaagttattgtactaacctattaagctgattgttcatgaaatagaaatcaaagccaattatttcacatttaaagtatatataacaaccagttcttgccagaaaatcagaagagagggcaaagtcaagaaaaattataaaaatacattacaaatgaaataaaataacaaggaaatgactgacaatgaaatgtatctttccatttattcatagttaattttgattcttcaattcttcattgaaatttctgaaatataaaaaataagtgtattaccacttcacatccactaggatggctattactaaaaaaaaaaaaaaaaaaaaacctcagaaaatatcaagtgttggcgagaaactggaactcttgtgcattgttgataaaatgtaaaatggtccagtcatggtggaaaacagtatggtggttcctaaaaatattaaatatagaattaccacatgatctagcagctccacttctggacgtatacccaaaacaatttgaagtagggatttcaacagatatttgtataccagtgttcattgcagcattattcatagtagcccaaaggtggtagcagcccaaatgtccatcaacagatgaatgaataaacacaatgtggtatgaatatgtatatatgatataatagaacattagctttaaaaaggaattaaattctgacacatgatactacatgggtgaactttgaatgtgttatgctaaatgaaataagccagccacaataggacaaatattatatgagtttacttatgtggagtacctagagtagttaaaatcatagagatataaagtagtaccgtggttaccagggtctgaaggggagggagaatagggagttattttttaataggtacaaaatttgaatttgggaagatgaaaaagttctgaagacagatggtggcgatggttgcacaacaatatgcatgtacttaattccactaaattttacatataaaaatggttaaaatggtaaattttatgttattgtgtattttaccacatttttttttttttgagacagagtcttgctcttgtagcccagactggagggcaatggcacaatcttggctcactgcaacctccgtctcccgggttcaagtgattctcctgcctcagcctcctgagtagctgggattacaggcgcccatcaccacacctggctaatttttgtatttttagtagagacgggtttcgccatgttggccaggctggtctcgaactcctgacctcgtgatctgtccgcctcggcctcccaaaatgctgggattacaggcatgagccaccatgcctggccaatttttttttttttttttttgcgacagagtttcgctcttgttgcccaagctggagtgcaatggtgcgatctcagctcactgcaacctctgtctcctgggttcaagcgattctcctgcctcagcctcctgagtagctgggattacaggtgtgtgccaccacacccagctaattttttgtatttttagtagaaacggggttttaccatgttagccaggctggtttggaactcctgacctcaggtgatcgccctcttcagcctcccagagtgctgggattacaggcgtgagccaccatgcctggccattttaccacaatttaaaaatatttatttatttatttatttatttatttatttatttatttattcattcattcattcattcattcgttcattcattcattcattcaagacggagtcttgctctgtcacccaggctggagtgcagttgcacgatctcgactcactgcaagctccacctcccaggttcatgccattcttctgcctcagcctcctgtaatggctggaactacaggcgcccatcactacgccccgctaatgtttttgtatttttagtagacggggtttcaccgtgttagccaggaaggtctcgatctcctgacctcgtgatccgcctgccttggcctcccaaagtgctgggattacaggcgtgagccaccgcgcctggctaaaaagtcttttaaaaaagtgtctgcctttctcagaaaatagtcattttgctatagcccatacatattttgagagaaaagacaaatgttgtataaaactgtgtgtgaggaaaatcatctctgacttccactgagtattctgaatggcagcaacttaaagaatagcagcaaaacctaatggacatatccatttataataggacattgcagccatggctttatagggcaaacactggggaaaatgcaatgatgggaagaacaaagtggacgtcggtagttttttcttctttgttctgtgatatggtccagactctttcctcacagacaatggaaacatggtagaaactctctaccatggtcggtcagttgaagaagggaatcgtaaaaattatgtaaatatagcctagtcatttttttaaacctaaaacatgttcatttattctccaatatttatttgtatttattttatttttatttttattctggagacggagtcttgctttgtcgcccaggctggagtacagtggtgtgatcttggctcactgcaacctccgcctcccgggttcaagcaattcttctgcctcagcctcccgagtagctgggaccacagacgcatgccgccacactcagctcattgtttgtattttaatagagacagggttcaccgtgttgcccagactggtttcgaactcctgagctcaggcagtctgccaccttggcctcccaaaatgctaggattacaggcgtgagccactgcgcccggccttattctccaatatttatatgtagggccacaaccttttctttgcatgtgggtcctttggaattcttcctttccttccctgtataaaccacacccataatgcttcattccagatttctatctcctagtttggttttattaaaatagagaacaaatttaagagatgagagttcttttaggtttttattattaccccccaatctcttaaagtcgcttcacgtacagctattttagcagtaactttgctactcaccttattgaacattcctaatgcattcaactttgttttcatagaaagaacaactctcctttttgctgttatttaatcaacgtacataatatttaattaaatcacttggccatgagaagttcagtggacataaacagcttgagggcaaacacagctgaatttctatatgccaacaattctactggtgggaacaaggagtgtgcatctaagtactaagcatgctatgggcatctgaatattttagtgatagaaaagagaccatcagttaacccattggaggttggttaagataaatttttgcagggtaaaatttgctttttcttaatgtatcctaacatttttcttgtatgaaaatagagatctacatcattgtttttaagggacacatggtatttattatacatgcattaggctgggttcttacttgaagacaacataaagcagttctgactcgcttaaccagaaacggaatttattggttaggctatttggattgtttatagagacaacagaagtcaatcagagtcaaccaggcttggaaaataggtaggaacacaatgagactaaaacaggccaaggacatgccccaggaagtctagtgaggacctcttcactggcactggctttctcaggacttttgccagggccacttctggcatcttgactgtattgctgcctgtgctgagaattatcttcatctgtccttgtgtattcatgtcactttctcatgattcaaaatcctgggcagaagtgtctgactagccaagtctagaatcatttagaagcatctcagcttcaaggggacagggaaaaggaatatctgtctcctcccttctcccttcctcccacaacacacatgctttggctttaataatgggagccagggttgtactgtttatttctaagacgcttgcggtgggggcattttcttggcatgggatgtgtgtttgaatgctgggtagccaaaaatatgacaagtgttacactgtgatgcactagagtttatttaattaatatcctattataaaaaatttagatcgtttccagttttgttctgttttaagccacatagtaatggacacatgtgagcaatctactgggggaatgaggtatcttagctgttttaattaattattttaatttttaattttagctgttttaatttagattttaaaagttattagtgaggtgcagtaacttcatgtgtattggcattttggttttcttattttgtcaattgtctggcatatatattttttgagatataatttaacataccataaattcattaataaaaaaatgtcgtccaggcgcagtggctcacgcctgtaatcccagcattttgggaggccgaggcaggcagatcacaaggtcaggagatcgagaccatcctggccaacatggtgaaaccctgtctctactaaaaatacaaaaattagcccggtgtggaggcgcatacatatagtcccagctacttgggaggctgaggcaggagaatcacttgaacccgagaggtggaggttgcagtgagccaagatcacgccactgcactccagcctggtaacagagtgagactctgtctcaaaaaagaaaaaaattaaaaaaaatttaaaaaagtcaaattcagcgatttctagtatgttcacagacttgtgcaactatcatcactatctaattacagaatatttttattaatacaaaaagaaattccatgtatatgtttttgcagtttgtttacatggtggtttttgccacacaaaattttaaaatttcatttaattacattttaatctcttttcctttacagtttctgttttggcttatgcttagaaatgctttccccacccaatgttttgttgttgttaggtaatgcttatttttatattttcctagtattttttactttttatttttacatcttgttctttaacttggaattaatttatagattgtaagatggtttctaaaaatgttcacaattattaaatggttagcgtattatcccagcactacttactgattttctcagtgatgtgaattgctgcccttgttatatactgaattcttatatacacacatatgtacgtttctggaactttctgttctgttgcaaggatctttctattctgacatcagcacaagacctttttttttttttttgagatggagtctcgctctgtcacccaggctggagtgccatggtgcaatcttggctcactgcaccctctgcctcccaggttcaagtgattctcctgcctcagccttccaagtagcttggactacaagcatgcaccaccatgcccagctaatttttgtatttttttagtagagacgggtttcgccatgttggccaggctggtctcaaactcctgacctcaggtgatccgcctgccttggcctcccgaagtgctgggattataggcgtgagtcactgtgcctggccaatactttttttaatagacaattttttagagtaattttaggtccacagcaaaattgaacagaaggtacagtatgtagccttttcagattggcttctttcacttagtaatgcacatataagtttcctccaagtttttttatgaatagctcatctttaatgtgtgtgctgaataatatttgattgccttgctgcaccacagtttatttatccattcacctactaaagggtatcttggttgcttccaagtgtcagcaattatgaataaagttgctgtaaacatctgtgtgcagttttggtgtagacataagttttcaactgttgtgggcaaataccaaggagtgcaattgctggattgtatggtaaattatatttagttttgtaagtaactgcccaactgtcttccaaagtggctgtactattttgcatttccactagcattaaatgagcattcctattgctccacatcctctttagcatttggtgttgtcagtgttctggattttggccattctactaataatagatatgtagtagtgtctcatcattgttttaatttgcatttccctgatgacgtatgatgtggggcatcttttcatatgcttatatattatctgtatatcttctttggtgaattgtcttttaaggtccttagcccataacatcaggttgttttcttagcacaagactttttaataattaaaacttttaaagactctttaatgtctggttgggtaattagcatttagcatcattattttttagtaatgacttttataaaattaatggtatacttgaaatgtttggccaaactgagttgtccttttcagcctcaccaaacttttattgttttcttgtagtttattcttaacaagttatgataaatataaaataagtgttttttctttttccttttttttttttttgatagtcttgctctgttgtccaggctggagtgcagtggcatgaacttggctcattgcaacctctgcctcctgggctcaagccgtcctcccacctaagcctcctgagtagctgggactacaggagtgtgccaccgtggtcagctaatttttgcattttttgtggagacacagtttcactatgtttcccaggctggtctcgaactcctgggctcaagcaatccgcccatctcgacctcccaaagtgctgggattacaggcgtgagccaccatgtctagcctgttttttcaacttattctacataagtggttaaatactgacagttattttcgttttcataggcatttaatgttttcgcatttgttggttttggcactattttgtcttagaagtaaatttgtcttagaagaaagcaataacattacaggcagttcttgatttagacatagattgtgtctgacaagttgaatcagatgatttaaaaataaattttcttaatatttttatattcgggggtacatgtgcttgtttgttacatgggtattacatgtgtaatcaggtgattgttttgatgagggagaggaggcattccaatcaccaaatagccttcatagactcaaagattcctgcaccaagaccatatttaacacataacattgttgaaaagtagctgactcatttgtaatttcaagtagttgaattctacttccccctaccttcctgagataatgatagctgccttgcaagaaaagttccacacacactaaaaacatgtttctaccttttgtctattattgacatggcagcaattgcttagcccctgttggaaaggcacatatatacttgaggcatatttctcacttttggggaacctgtctctacctgtgtttattgcagggtattggtatttttcaagcattctctccacaccactctcacctttggctggttttactttatgacttttgcacacattgccctgttaagttaatccttttgaggttattgttagctttggactccagcctgaattggctgtatgaacatagacaagtctcagctttagcttccttaattttaaaaggaggttatgattctatttacgtagcaggattggtgtgagacacatgcagtgctataggaatctgaagcatctgtattgttatcataggacaacttatttgtagagatgctatgactactctaggagtcacaaaaatgaccagtgaagtacattgccttttaatttgaatgttctgttcttttttgaccttattactgtgtttaagtattactacctaatcttttaggaatggtcaaataaaaaaaactgttatttattttattttttttcctgagatggagtctcactctgtcacccaggctggggtgcagtggcgtgatttcagctcactgcaacctctgcctcccgggttcaagcgattcttctgcctctgcctcactctccgagtagctggattgcaggcgtgtgccaccatgcccggctaatttttgtatttttagtagagacgggatttcaccatattggccaggctagtctcgaactcctgacctcattatctgcccaccttggcctcccaaagttctaggattacaggcgtgagcaactgtgcctggcaaacatacacctgcctacttcagttgtttcatctggaatcttagtcctctgtttatataatactggttgtttgatgaaagaaattagacacttagtattttggaaacaagttaagtaataagattaattttcattttaaaggtttatacaatttaaaagaaaaggatgaattatataaaataatagagaagctaatgctttccccttttgttttcattttagaatgtggtagcaattttaaataaaagtgaatgggtaggaaaaaaattaattgatctggaaatactatatagataccttgaaggcaactagttgattgttatttgcatagctagaaatcatctatttatttaataaaataagcacgtttttatagccttggtataataaaatgggttatttgggctttttatatatatgaatttatcattggtcttacttattgaattatttcagtttcagtaacttttctcttaatttctacgtactttgtattttttttctttttcatttcccattaaaatgagttggctttatgagatgaaataatttaggcctacaatgagtataggtagtcctatgacatacctgtgtatttactacccagcctaagaagttaaacattaaatatatagttgcatttcccctttgtgctcctctcaagtcactcctctcccctctctcccctcaatctgttgaatttggagtttatcatgtctgtgcacatttttatatttttactatcacaactatatatgtgtgcatacaaaaacaatgtataacattgttttatgtttttaaacctttgtatcctttttttggacataacatcaacattttattttattttttattcataagcattgttttcttttgtcttgcatattttaaaatgtattagatggtatcaaactatcactttgtcatttgcatttttcttagaacattgttttcttagaacaatgtttcttagaacatttttcttagaacattgttttcttagaacatgcatttatttatcaacatatattgatacataaaaatacttctagttcatttgtttttaaaattattttgtggcacattataattattcatatttatggggtacaatttgatgttttgatacatctacatgttgtacaatgatcaaatcagggtatttagcatatctatcacctcatacatttatcagtgctttgtgatgagaacattcaaaagcctctcatccagctattttgtaatgtacaataccttactgttaacaatcctcaacctactgtgcaataaaaacaccagaacttattccttctatctaaatgtgaccttgtagccatttaccagactctttccatccttccctccccagtctctggtaaccactgttctactctatgacatcaaccattttttttttttttttgaaattccacatgagcaagatcatgtggtatttgtctttctgtgtctggcttacttcacttaacatgatgtcttccaggtccatccatgttgtcacagatggcagaattttattcttttttatggctgaatagtattccatgtatatatatacaccacattttgtttatgcatttatccattgtcggacatggattgattccatattttggctattgcaaatactgctgcaataaacatggcaatgcagataatctcttcaacataccaatttcatttcctttgaataaatacccagtagtgggattgctggatcatatggtagttcaattttcaattttttgaggaatcaccatactgtttcccatagtggctatactaatttacaatcccaccaactgtgtataagggttcccttttctccatatcatcaccacccctcttttcttttgttattttgataataactggagtgagttggtatctccttgtggttttcatttgcattttcctggtgatcagtggtatggattgcatctgtgtcctggccaaatctcatgttgaaatgtaatccccagtgttggaggtggagcctagtgggaagtgtttggaacatggaggcatatccctcattaatggctttgcactatccccttggtgatgagtgagttcacatgagatctggttgtttaaaagtgtgtggcacctcccattctgtctctcttgctcccacatcaccttccaccatgaacaaaagctccttgaggcttcactggaagctgagcagatactgacaccatacttgtacagcctgcagaactgtgagtcaattaaaccttttttctttatcaattacccagtctcctttctttctttctttctttctttctttctttctttctttctttctttctttctttctttctctttctttcttttttttttttttaactgacacagggtcttgctctttcacctagtctggagtgcagtggcccagtcacagctcactacagccttgacctcctgggcttacgtgatcctcccacctcagcccccaggtagctgggaatacaggtgtgtgccactacacctggctaatttttgtattttttgtagagactgagttttgccatgttgcccaggcttgtctcaaactccagggctcaagcattctgcctgctttggcatcccaaagtggtgggattacaggtgtgagccactgtgcctggccaggtatttctttatagcaatataagagcagcctaacacaattagtgatgttgagtgttttttcatgtgcttgttgggtatttgtatgtcttcttttgagaaatgtctattaaagtcttttggtcatttttaaaaaaatttattattatcatactttaagttttagggtacatgtgcacaacgtgcaggtttgttacatatgtatacatgtgccatgttggtgtgctgcacccattaactcgtcattggaaacaattaacaaagtaaagagacaatctacagaatgggagaaaatatttacaaactatacatttatcaaggggttaatatccagaatatataaagaacttaatgaccacaaaataacctgactaaaaaatgaccaaatgacgagtcttattttgtggttgttaagttctttatatattctggatattaaccccttgataaatgtatagtttgtaaatattttctcccattctgtagattgtctctttactttgttaattgtttcctttgctgtgtaaaagcttttcagttttatgtaatctcatttgtctacttttgcttttgttgtctgtgcttttgaggtccactcaaaacttccttgctaagcccagtgctgtaaagcatttcctgcatgtttttttttagtagtttcatagtttcagattttatatttaagcatttaatccattttgagtagatttttgtatatgatgagaggtaggggtctagtctcatttttctgcatgtggctattcagttttctcagcaccacttattgaagagagcagtgtgtgtttgttatggtttggatgtttgtcctttccaaatctcatgttgaaatgtgattcccagtgttggaggtgggacttgtgggaggcgattggatcataggggaagatccttcatgacgggtttggcaccatctccttggtgataagcaagatatggtggggggttttttttgtttgtttttgtttgtttgttagtttgtttttcaccatctcttacaggaaggagaaatctggttgtttaaaagattctggtacctccccctgtctctcttgctcattctcttgccatgtgacatgctggcataccttcgctttctgccataattgtaagcttcctgaggccctcacaagaagcaaatgccagcatcatgcttctgtatagcctgtacaaccatgagcccaaataaattctcttttctttataaattgcccagtctcaggtatttccttatagtgatgcaaaaatggactaacagtgttcttagcacctttttttgaaaatcagatggctgtaggtgcatgaatttattttagggctctattctgttccattgtgtatgtgcctgtttttataccaatactatgctgctttgattactatagccttgtagtatattttcaagtcaggtagtgtgatgcctccagccttgttctttttgcttcagattgctttggctatctggggacttttgtcattccatatgaattttagggtagttttttcctatgtgaagactgtcattgatatttttatagggattgcattaagtctatagattgctttgggtagtatggccattttaacaatattaattcttccaatccatgaacatgggatagcttttcatttgtttatgtcttcttcaatttctttcatcaatgttttatagttttttttttttttttttttggagacagagtctcactctgtcacccaggctggaatgcaatggcatgatctcagctcactgcaacctctgcctccagggttcaagtgattctcctgcctcagcctcccaagtagctaggattacaggtgtgcaccatcacactcagctaattttgtatttttagtagcgatagggtttctccatgttggccaggctggtctcgaactcctgacctcgggtgatctgctcccctcagcctcccaaggtgctgggattacaggtgtgagccaacgcacccagccagtgctttatagcttttagtgtagagatctttcacctccttggttaagtttattcctaagtatcttttttttatgtagcaattgtaaatggaatttttttttcaggtggtttgctattagcatatagaaacactactgattttaataagttgattttgtatcctgtgacttactgaatttattttttagttctgttttttagtagattctttagggttttctgtatataagatcatgccacctgcaaacagggacaatctgactttcttctgaaacttttttttctaaactatgttaatgggatttatccctgttgctacttgcagctctacttcaagctttctcattctcagtgctatagacatttggggccagatcattctttgttgtgaggggctttcttgtccattacaggataattggcagtatccatggcctctatgcactagatgccagtagtactcccttgctgcactctgagttgtgacaaccaaaagtgtctccagacattttgaaatgtcctattggtggtgacatcaccccttctctcagtgagaatcacatttctagttcattcattttaacttctatattatgtttcattataaatataccacaaccaattttttcatttccttgttgatggacatctagattatttccaaagttttaactattagcaacattgttgcaatgagcatttttgttcttgtttccttgtgcacatgtgtgagactctgtctaaggtactatgcttaggagagaaaatgttgagttttaatatatgcatattttcaactctaccggctatcatgaagcagtttccataattgtactaatttatactctaaccaacggaacaagagagatcctgtttctccatatcctcaccgacacttggtattgtcagattttgagatttttatctacctgatggaggtacattatattccttgattaccacaaggatcacaaattgtgcagatagagttgtatccaaaaaaggattaaggctgggcgtggtggctcatgcctgtaatcccagcactttgggaggttgaggcgggtggaccacttgaggtcaggagttcgagatcagcctggccaacatggtgaaaccccatatctactaaaaatacaaaaattacctggggcctggtggcatgtgcttttagtcccagctactcaggaggctgaggcaggagaatcacttgaacctgggaggtggaggttgcagtgagctgagactgctccactgcactcccgcctgagcgacagagcaagattctgtctcaagaaacaaaaacaaaagcaacagcaaaacaaaacaaaacaaaaccccaaaaaagaattaaatcttactgcatgattattgagaatacaggagcctttcccaaattataagtgctgattattttaggggaattttagaatgatgtttgagcttctgtgaccagctttaagaagtggttttgaacaatcagacttcatatgtgccatgttttctactcaatttctgtagtttctatttccaaaccagagatgatcatctagtcataatattgttcttcatcttagaaaatgatattactgatggtgattaccatctctacttagggaatggctcaaaatatattaataacttgaagttatttccctcagtgttgttggatgcttttgttctcagagtcactcatcactaacagctggatgccaaatttgtctctttgatactgtcgtttcccagaagcctacatgttttttccatactatatgaaactgtttatgatcttactctgttttctgagtcattttgctaaatgcagtaggatgttacaaaagatattcctggttttgtacctacctttaagatttaaaatgaaaacgatggacataacatatataacaaagtcaattagagttgtgtgtatatgtaataaagtagtgagagtgagatggaattcctccaaggtttcatgtgtaaagtccaatttaagtagagttttgaaaaaaaaacaatgcaggtgaattacgaaagcgaaagaaatatgtattcagaattgatatgacttaaattaagatgtagtgggaaaagtggcttaattagtataatttttgtttgtgctcacacattgtggactcctcaatacttacttcctgggtgaattatccagtgcctttctgcctgactgatctctctcagttcctcagtaagcctgagagttagtccagtgctttggtctgggacataccccatgataaaactgtatttcagtcttacattcctaaacaggtaaactagccttcacctaccaaaggtattgtattctaaaagtttgttgccaattctgtttgttgaatttgatgttttcccataaaacgatttagtcaactttggtaatcttgcaagatcagccctcaaaagccccatttgacccataagatacaggagcaagtctgagttctgtgttctggaggtagacagccaaagctataagaagaataaggaagagtttccttttttaggctcaggactatccttagataaaattttgataggatctgtttgttttagacattcttctacttccatttttatacccttgtactgcttcccactgactcctcctgggctcctaataccttcatgcttgccttaagtactccatcctggactcgccacctgaactcatcctatttgtcctttgctcccaaacttgcctttcctgtcctatctgggcttttgttctcttgtagtaactgaccttatgtaggtattaagagatataattccaactatcacccccctgattatcaaaaaagagtttatattttaaaaagaagatacactggatgttaagacaactgaccttcaaaaagtcacttcatgggggaaaagagatatggaaggagctattctagattaaatgagacaaaagagacataaaaccaaatgcaatgtgtgaaccttgtgagggtcctgaatagtaaaattggacttcttcagacttgaaaacttgtacacaaaaggacactatcaagagaatggaggatttgggtacaagcggttgaaagatggtttggctgctctggtcggattctgccgtcccagtgaggctggaaaatagggtctagaggcaggaacataaggctgattcacacttcagctatgacaggaaatatcctctcatagagcataggccaagtaaatgattttgtaactttacttcatcctctccttttacatagggtgtactccaagtagagggtatttaaactcaaaaaaactctgtaagagggccttttgagcccctgtgctcaggcctgctcccatactgtggagtgtactttcattttcaacaaatccctccattccttccttgctttgtttgtgcgttttgtccaattctttgtttaagacgccaagaacctggacaccctccactgttaacaccagcccttccctgtggctgaccctgaggtgttatgagtttcttcacagccctacttcctctctcttctccctcattttcagacccttcttcagcatcttccctgggcattgctgtgagtttaggccggcccgttttgagcaggagcagcagcggaacagtagacctgctggaggaagtggggctgcagatcagagacacagcattttcgtcaaccaaacttcttgaagccatatctacagtatcagctcaagtggaagagcttgccgtcaaatgtacggaaaatgcacgtttccttaaaacatgacgggacctcttgaaagaatgctgtgattcttggaaacctgacaattgatttggcatacttagctctttgatagtgactgtgtaataattcatacttcctcatatatgatcatttcacatgtgccacatatataggataatatctagcagttctctatatcttcagaatgaagtttttcttggttttcttgacctttgtaaaagcagaatactgattctatttttgatgttgatcagtacttgtttattcttacactttctgcccttcaaactttcataaaatcctttacaaaatttaattttatcagtagatagttaatattaattgtgccacagtgctaccagtagcaaactaagtggaccattatttgttttgcagtaagatgccaagcatggcagaattagaagttgagcttcatcttatggaccaagggagataactttaaggttccagctccattaggctgagttctctaggcaaatgattgtcttacttacttcgatatccccagcacctaaaacagtgtcacatagcattcactaaatgtttattgaaaagaagagttgattaacataatacaaagctattttttcttcctgtatttagcaggaagactataattgtttctctaaaaatgtatgaatcaggactttgttgacttgaaggaaaatgttatctttttcacagagattttaactttgatgatagcttttaaaaacatgataaatacttttgtcctcaaatgattattttaaaaagtcttttttttttgagacagagtctcattctgtctcccaggctggagtgcagtggtgcgatcttggctcactgcaatctctgcctcctgggttcaagtgattctcctgcctcagcctccctagtagctgggattacaggcgtgtgccaccatacccggctaattttttgtatttttagtagagacaaggtttcaccatattgaccaggctggtctcgaactcctgacctcaagtgatccacccgcctcggcctcccaaagtgctgggattacaggcgtgagccactgcacccagctaagaagtctttatttcagaaaatgaaagactgtctagaaagaacgaattttttttcctatttatttctatggttactgcttttacacttaatattttttgttttcggtatttttatatgtttgattgctgtctttaaagtgccttatcagatttatggctctgtactatgaattttggagctttacaagttatttacataactctaagttactttgcttccaatacatcaaatttaaataacatgattgtttttatattatttgaccttagtgacaatgtcctattttatttgttctgtatcttatgtcgctttttggtagtttgtattatgtgtgaatgattaagccaactaattctgtaccatatataacttctggatatctttgatatgacatcttaattctttgtagatatggtgatgtgtacagaatgatattctgaagctccacaatggtgcattgaaaggctgcagatggatggccaaagaatagttttgtttagcatattaggtctagttctggacttttttttttatactttaagttctggggtacatgtgcagaacatgcagttttgttacataggtatacacgtgccatggtggtttgctgcacccatcaacccatcacctacattaggtatttctcctaatgttatccctcgcctaatccccaccccccgacaggccccagtgtgtgatgcttccctccttatgtctgtgtgttctcattgttcaaatcccacttacgagtgagaacatgcagtgtttggttttctgttcatgtgatagtttgctgagaattattgtttccagcttcatccatgtccctgcaaaggacatgaactcatccttttttatggctgcggagtattccatggtgtatatgtgccacattttctttatccagtctgttattgatggacatttaggttggttccaagtctttgctattgtgaatagtgcctcaataaacatacatgtgcatgtgtctttatagtagaatgatttataatccttcgggtatatatcctgtaatgggattactgggtcaaatggtatttctagttctagatccttgaggaatcatcacactgtcttccacaatggttgaactaatttacactcccgccaacaatgtaaaagcactggacttttttttttttaagttaaaagatcacacacagggtgtgatttctataccaaagatatgcttatttcagtatgaggaaaaatatttttcttacatgtcctgaaaattgcaattttaaaaatgtacaaaataaatttttattaaaagcaaattttatttcaaaaaaaaagagtgaaagacaaccaactggataggagaaagtatttgaaagtcatatatctgataagggattaatatccaagaatataaagaactcttacaactcaacaacaacaacaaaataaccttattaaaaattgggtagagtgcttgaatagacatttcttcgaagatatacaaatacccaataagcacatgaaaagatgcttgacatcatcagtaatcagagaaatgtgaatcaaaaccacaatgagataccacttcacacctgctaggatgggtagaataaaaaagataataggtatcggaggtggaacaattggggcccttatatactgctcatgggagtataaatggtacagtcactttggaaaacagtctggcagatcctcaaacaattaaacatagagttattatatgacccagcaagtctactcttaggtattaccaaagagaaatgaaaacacaaaagtttgtacatgaatgtttatagcagcattattcataatagccaaaagatggaaacaacccaaatgttcatcaactgacaaatagataaattatggtgtatctatgcagtggaatattattcagccataaaagggaatgatgtactgatatgtgctgtaacatggatgaacactgaaaacatgctacatgaaagaagtcagtcacaaaagaccacatattacatgatttcattcatctgaaatgtccagaagaggaaaatctatacaagcaaagtagattagtggttgcccaggacagaaggcttaggaggtgatgactgataggtaaggggtatgttttgttgttgttgttgttgtttttaggtgatgaaaatgttctgaaattgcctgtggtgatggttgcacatgtctgtgaatatgctaacaactattgaattctacactttaaatgtgcgaattatataatacgtgaactacatctcaagaatgttttaaaactggtgttgggaaaacaggacatccacatgtaaaacaatgtatgtcagatccttaccatacaccatgtacaacaattaactcaaaatggattaaagacctaaatataagagccaaaactacaaaaactcttagaagaaaacatagcagtaaatattcgtaagtttgaatgtggcaatggtttcttagatatgacacaaaaaacacaaaagaaaaaagataaattggacttcacaaattaaaagcttttgtgattcaatggacaccatcaagaaagtgaaaagaatggaataccgatacattttacacatcaatgtaccttgaaaacattatgctaagtgaaagaatccagacacacaaggacacatattgaatgaatcaatttatatgaaatggccgtataggcaaatccgtagagataggaaataaaattagtgtttgccaggggctgtgagtagagaggaaatggggagtgttgctaatggacatgggatttctttttggagtaatgaaaatgttttgcaactacatagtcattatggttgcacatccttgtgaatgtactaaaaagtactgaactggataccttaaaaggctgaatttttttcatttcttctaaaaaaaaccaggatagatgtgcagaacgtgcaggtttgttacgtaggtacatgtgtgctatggtggtttgctgcatctattgacccatcctttaagtttcctcccctcacccctcaccccccagcaggctccggtgtgtgatgttcccctccctgtgtccatgtgttctcattgttcaactcccatttatgaacaagaacatgcagcatttggttctctgttcctgtgttagtctgctgaggatgatggtttccagcttcattcatatccctgcaaaggacatgatctcattcctttgtatggctgcatagtattccatggtgtatatgtaccacattttctttctccagtctatcattgatgggcatttgggttggttccaagtctttgctattgtaaatagtgctgcagtaaacatacgtgtgcatgtgtctttatagtagaatgatttatattcctctgggtatgtacccagtaatggggttgctgggtcaaatggtatttctggttctagatcctcgaggaatcgccatactgtcttccacaatagttgaactaattcacattcccaccaacagtgtaaaagcgttcctatttccccacagcctcaccagcatctattgtttcctgagtttttaataattgctattctgactggtgtgagatggtatctcattgtggttttgatttgcatttctctgatgatctgtgatgttgagctttttttcatatgtttgttggccgcataaatgtcttcttttgagaaatgtctattcatatcctttgcccactttttgatggggttgtttttttcttgtaaattgtttaagttccttgtagattctggatattagacctttgtcagatgggtagattgcaaaatgttttctcccattctgtaggttaaaaggctgaattttatagcatgtgaattatatcccaatttaaaaaagaatgcatatgtcttagttcaggcttccataacataataccatagactgggtggtctaattgttcaaagctccacagaaattagttggagaagttacaagagtccattaatcatcttgctttgttagtagcagcgggcatggttcagcattttctgcttaagtttctctgagctcaccaaaactaaaatgatgttgtaatactttttttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcactctcttctgcactgaggtgaggcagatgtcaaactcatagccagcatctcgtagcgcctgcccgccgcgcttcgcctcctcgtggcccgccgggctcagatcggcgtcgtaccagcagctgaagcggttctccaggttccatgtgctctcgccgtgccggatcagcaccagtttgtaggcggccatggcggtgggctgcaatactttttataccatttgaagtaaaaggtacaaaaggttatacgctgaaaattctttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctattggcgggaggccttaggtctttgctggtttttgacatgaggcctcagttcctcaccatatgaacctctccataaggctgcttgtatgtcttcatacttggtaggtggcttcccccagattgcgtgattcaggagagaggacaacaaggaaaacacaatgcttttttctcctcttgcaatgttttttatgacctagtcttggaagtcacaccttgtcgcttctaccgtagtctattcattagaaacaagtcattaggccaggtgtggtggctcatgcctgtaatcccagcactttgggagggcgaggcgggtggatcacttgaggtcaggtgttcgagaccagcctagtcaacatggtgaaaccttgtctctacttaaaatacaaaaaattagccgggtgtggtggcatgcgcccgtaatctcaggtactggggaggctgatgcaggagaatcacttcaacccgggaggcggaagttgcagtgaactgagatcgtgccacagcactccagcctgcgagacagaattgagtctcaaaaacaaaaacaaaaacaaaaaccaaaacaacaacaacaacaaaaaacaagaaacaagtcattaagttcaggccacaccgaaggggaaaggattaaattccacctcttgaaggaaggagtagcaaagaatttgtgggcgtattttaaaaccaccacaggaaggcagacaataagcaataaacagaataaatcagcaagttatggagtatgttagaaggtggtacgttctatgaaaacaaaagaaaaagcagaggtaaggggaatcagagtatgtttgtgtggaagggatgtaggttgcagttttaaatagggtggtcagcatagtcctcattaaggttagatttgaacaaagacttggagacaaagaagttagccaagcagttatctggaagaagaaagtcccaaagcaagagaatagctaaaataaggccttgaagtaggagtcatccttgcatgcgtaacagccaggaggccagtatgactggcacagagaagggtttggtgagtggtagaagaggaggccaggtaaacttgagggggacaggcatgggaaatcatgtgggaccttgttggctgttgtaaggatttgaggcatttttgattagttcttaattcgtacttacaaatgttaaatgagattatgtatgggaaacattagtaatcaggaaagcactctatgaaagctagttacttgtattaaagtattgaaatttttatttttagttagcatatccatagaaacaactttcctttacttcatctaaggtgataagaattttttttctaagcaggaagaatgcttaccatattttattactagcacattttaattttttaaacatgacacttgagcatatataaaatgtagcatatttttaattggggaggtgggggaaaagttgaggaaagattatttgcatggctgaaattaatgaatttattgtttctaacaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaagttactctttggaaactgaagtcaaatgccattgaagagaattctactagaaattacttctaacaatgagatagaagcagacacactgacacatttggcaataaaaactattgtacttcttatcttgaagctaaataagttttctttgacccattaattcctctcataaagaaaaaagatatattttcaatttaaaaacatctgaacatggaatcttgatattgtggttgtatatttatagatttatattttataagtatatgagtatttatatactgtttattactctgaatctcatactgaactaaaatgtatgttttcaggggatgggttagggttttctttttcttttataacatggtgattattttgcaattaaaacttgaagggaaaatgtctagagaattactagtatactttggtttttatttttagtttttttttcagacagggtcttgctctgtcacccaggctgcattgcagtggcaaaatcacagctcactgcagcctagatttcccaggctcaagcaatcctcccatctcggcctcccaagtacctaggaccacaggcgtgcaccaccatgctagctaattttttttttttaagatggagttttgctcttgctgcccaggctggagtgcagtggcacgatctcagctcaccacaacctccacctcccggttcaagcaattctcctgcctcagccttccgagtagctgggattacaggcatgcgccatcactcccagctaattttgtatttttagtagagacagggtttctccatgttggtcaggctggtcttgaactcctgacctcaggtgatctgcccacctcagccttccaaactgttgggattacaggcatgagccactgtgcccggctgcatgccagctaattttttaatttattttttgtagcgatgggggtctcactatgttgtccaggctgatctcaaactcctggactcaagtgatcctcccacctgggcctcccagagtgcggggattacaggtgtgagccaccatgcccagccaaaattactagtacaccttgtatgatatgcctaaggaagactctattattggttttttgtttgtttgtttttcagactctagggctttaagttgaagactctattgttgtttaacattacttgagcatcaacagcattctagatatactgtggttaaagatgtagttcaggttataaaaaagccttctgaatactgcatgaagtacctgtggttatcataagaaacttcatgcatatatggcagggattggaaaatggtgatctgcaggccaaacccagtttgccaactgctttcatatggctcataagctaagaatgccttttacatttttacaccattgaaaaaaattaaaaaaatatttaggaacttatgaaaagcacatgaaattcaaatttttgtgtctgtaagtaaagttttagtaatatacagttttattagaacacagccacactcattcatttacgtattgtgtacagcccttttttcactacaagagagttgaatagttgtgacagagcccatacgtggtgtcctcattggtaagtgatacactgccaaatgatttaccacagtggaaataccattttatcttcccaccagcagtgtttgtgttccactttgaaagtgttccattttctccacattccctccaacaatttgtattgtcagtcttttaaattatagacattctaatgggtgtgtaatattacatcactaattctcatttccttaatggctaatgatattgagcatcttttcatgtgtttattaggcatttgtataccttctttggtgaaatgtgtgttaaaccctttggccaaatttttagttgggttttttgttttgttgttattgaatttcttctttttcaaaattgttttggttagtctaggcccttttactttccatataaattttagaatcagtttataagtttctacaaaaatatctgctgggattttcgttgagattgtgttgattctacagatccatttggacagaagtaacatcttaccaatattgagttttccaatccatgcacatagtatatgtctatttatgttggtattctttgatttcttttatcaggaatcaatagttttcagcatgcagtttctgtacatattttgttagatttatatttaagtactttatgtttttgaatgctgttataaatggtactgtttttaaattttaaatttaagtttaatttcaggtgttcattatgaggtttttatatgttgactttgtatcctggaacgtagccaaactgacttatcaaacctattagcttttttgtacatttcttgggattttctatgtaattatgtcatcaaggtatatagtttttttttttttttaagatagtctcactctgtgacccaggctggagtacagtggcacaatgttggctcactgcaacgtccacctcctgggttcaagcaattctcatgcctcagtcacccaagtagctgggattacaggcacatgccaccacacctggctaatttttgtatttttagtagagttggggtttcgccgtgttggccagggtggtcttgaactccagaccttgagtgatccgtccacctcggcctcttaaagtgctgggattgcaggtgtgagccactgcacctggccacatagttttatttattcctttgtagtctgtatatcttttttttttcccttgtattatcaaaccttcattacaattttgattgggagtggtgagagtgaacgatggttgggggaaacattcagtcatttacagttagcattgtgttagttgtagagttttgtaaatactatttatcagattaattaagttatttctattactagtttgctgagggtttttttaaacatcatgaatggatgttgaattttgtcaagtgctttttctgcatatagagatgatcatatggtttttctcctttagtctgttaagatggtgaattacactgattgattttcaaatgttgagccagccatgcattcccagggtaagcctcacttggtccaagaagacttactttccattaaaaatttcaaacatacacaaaggtggagaaactatttttttttattatactttaagttttagggtacatgtgcacattgtgcaggttagttacatatgtatacatgtgccgtgctggtgcgctgcaccactaactcgtcatctagcaactattaatagtacaagaatctaccctatacccatcacctagaaaaatccttgctatttatttgcatgccattctcatcagttgaattttataatgtgttttgctgatgattctaagagttggtccaggccttcctgcctattgtattctgttaaggtagatgtctctgactagtggattggaacttcctagtatatctccataccagttgccatttctaagccttttggccaccccctgccaccacccctgcccgcccctttcccttgtcactcttcgcaattctcagcactaattgtagtgtatataatttcagtactctttcccatgctttatttagtttgtttttgaacatatttttttctcatttctctccaacttgtatctcaggatccaaagaattaacaatatctcatgccaaaagcttgaggattcctactgtattgacaataacatacagaagctttgcttaaatattatgcttactttttttttttttttttttttttttttagatggaatctcactctgtcgcccaggctggagtgcagtggtgccatctcagctcactgcaacctctggctcctgggttcaagcaattatcatgactcagcctcccaagtagctgggactacaggtgcacgtcaccattcctgggtaattttttgtacttttagtagaaacggggtttcaccatgttggccaggctggcctggaactcctgacctcaggtgatccgcccgcctcggcctcccacagtattgggattacaggcatgagccaccacgcccagcctgaattgcttacccttaaacatgtttatttttactgccaggccttaatgagtcagtaatggatatgtcattttagctgagttgtattctcatttgtgtaatatacttatcattttaatgttatcttatcattaaaacaaccttatattggtggtaattctatttgctggaggttctctgtaattttgcttttatgcaatgttcattacagtaatggcgggaagttaatgccactttggaatttgatcagcttgcatcactaccagaatggttttcctatgactagttgagatccacatgcaatacattttttgacatactaccaggagcagatgttaatatcataatgaaagctttgtccaactggacatcagatttagcacaaaattcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatctgaggtggggctggtgttgagggccagaacagaagctgaaccttactaattatatagtagtgtctgtgctaattgcagtaaagctgttttaaccatttggaaactagttcatgtaattttttgccaaatgacttaggtacttattgtccactgacagctaaagtattttccaaaaccctcaactctctgtctagcaaactattgtaggtgaatatttgtctctgccaacatatccatgtataactataaaactagattctgctttgatgtttgcaaatacattcttgcttcccaaaacagcctgtttgcatcacactcatatgtaagatggctatttccgctgcatcttcccaaagttcaccactgcttaataaggtctgtttaaggtcaaacaaatgcaattgaattttgattacactgaaaatgaagaatagcagcaatataatgtgaaagcactttgtgttgtcaacagtgatttatacaaattccagtgacagatactcaagactactttccagggcacattcataatttgattgctaaaaataaaagaaaacacacttgttctgcctttttcagctctgcttctcctctttcagtcaaaagcccttatgttagtaacctttattcttttttaaaaaaatattttactaagtgtgaagtgttctggggccagagagagattttctgtgaagttaatgaagcttaagtttcagagctcctcatttgcagtgaccttcttctaagactctggaaggagtatcagcaatgtgtttatatggtcatgtgtttttgtacaatttgaaaaattaaaaaaaaatttaaccacaacccttcaaggccattgtccatttctacttcaatgactcttctgttagacctcccctttgtgttagtgtgatattggaatggccatgagctttttggggatgtgactaaggggaggttgagttggggatatgtttagtttggggttagtaggctatttggctataggtggttctttgtcacttctgtgtatagtggagtttttgctaggaattctgatatagggatggcttcttggaacacccctactactcatggggccaactcactaagcatcatgacatgaagatgcagggctcagtgtaaaactggtaaatgaatgttaccagttcaaagaatatgtaagattagtcacttcacaagtaaatttgaaatgccctgaaatcttacagctcatatatgaaagaaactcaacagttttctcaaatttgacagtagctttaaaaatgtatcaatgcctagttgttatgttgaaaggaacttttctaaactatcattaattttaaaaatttttatctagagaaaagactgaactatttttattttctttatatacaagtgattttataaagtcgtcaaatgaagcactaaagaatatacagccaaaaacataggaaaagaaactatcagagaggtatatcaggcattattaataaaaatgttattgttatggatttttatgatatttgttagctttaaaaatttataacttgtgatttaaatttttttaaattttattttgagacggaatcttgctctgtcatctgtactggaatgcgatggtgcgatctcggctcactgcaaccttcgcctcctgggttcaagtgattctcctgtctcagcctcccgagtagctggcattacaggcacgtggcatcatgcccggctaatttttgtatttttagtagagacagggtttcaccatgttggccaggctagtttcaaactcctgacctcagatgatccgccccccttcaccttccaaagtgctgggattacaggtgtgagccactgcacccggccatataacttatgatttttgttatgcgctcagaatattttcttttgtacaaaattttgtgtttatggttttttattcctttttttaaagaaggcccttcaaattgtttaagtttcagacaccacaaagtgtgaattcacctctttctagacatcatatagaaagctgtctttgcccaaacataatttatagtcagaatgtagttcaacatgatcatacataaatattgattactttttaaagaatgttaaagcttaaaatttctgcaaataattaatgggaactaggcttaatacctgggtgacagaataatctgtacaacaaacccctatgacacaagtttacctatatcacaaacctgcacatatacccctgaacttaaaagaaaagttaaaaaagaaatgtacacaaaaaagaatatttctgaatcataacttctaggattataattaagcctcaggtgcagttaatttagaaatcagatttggggagaagagtgtttcaactaagtcaaggagctcttggtagtgtttggaatgaagtaatataattgtgatattaaattgagtaaagttgttttattggaaaatgcaacagcagaacagattaattaacagaattcaaaaagagtgaatagtcaggaaatctctaattttggaataaatagaatatgactatttgcctttgcaactttagaatttaaatgcattttgggaattgtgtcctaagttatacagtaaataaatgtaattttcttgtttgtactgccagtgttaagactgtagactttaaagggattaacctgaagtttaatttaatcaccctggtggtctgttcaaaggaaaagtaaaataggcagataatgtgaagatctttctccggggttgtttggcctttttgaaagtggaagtataaaaacaaatttaattagatataagtactgaatgattccaaaggttaatgccttattaacaaattagtttgtccctgaaacttacaacactaactttttgagtgcttttcctttttaattagataaaggctatagtccattctcttaatagagactatcctttagaaaaatgaccacctcacggatcacgaggtcaggagttcgagaccagcctgaccaacatggtgaaaccctgtctgtacttgaaatacaaaaattagttgggcgtggtgtcgcgcacctgtaatcccagctactcaagaggccaaggcagaattgcttgaaccctggaggtggaggttgcagtgagccgagttcatgccactgcactccagcctgggcaacagagcgagactccaactcaaaaagtaaataaataaaataaaataaaaatgaccacatcaatgctagcagttactaaattcctcctttggatcaataaatacattccttactccccttacaattaattggtgtttttattattgaaaaagtaacacatacacagagtaaaattcctctcccaaggaaaaccagttgtcctatgtatatgtatccttccagaaagactattaatataaaacttttttttaaattattttttgagatggagtctcgctcttgtcacccaggctggagtgcagtggtgcgatctcggctcactgcaacctccgccacccgggttcaactgattctcctgcctcagcctcctgagtagctgggattacaggtgcctgtcaccatgcctggctaatttttgtacttttagtagagacgagttttgccatgttggccaggctggtctcgaactcctgaactcaggtgatccgcctgcctcggccttccaaagtgctgggcttacaggcatgagccaccgtgcccagccaaagctatttacatgtacataagtatatatacttgatgtgtgtgtgtccactttttctaaaaatggaagcatactatgcacatcattctgcaccttgcttttttttaaattagcaaatatatcttagatattgttccacatcaatatacagagccccatctaatatttttctttctatatgggactctttttttggcttcttagctttttctggcaaatgacagtgcattgaatattctgtttttcaaactggtgctctgtcaccaatactatattagagtaacataggcatttttattattataaattagtaggtaataatcatttatccatgaagatgtcgagtcagcttcaaagaggattaggtttctgatttagctgaactctattctgaggaccaaaggaaggtcaaatccaagataaaaaatttagcagtgaaggaatggtgtaaagagggactttcactatttcttttgtatatttttgtgtttaaatttttatagcgaacaatcatacatttgtcatataatgtttgaagcaaagtgaaaatacattagaaatggccaggcatagtggttcatgctgtaatcccagtactttgggaggccaaggtgggaggattgcttgagaccaggagtttgagaacagcttgggcaacatagcaagaccttgtcttttaaaaagaaagagagaaagagagagagagaatgagaatatattagaaatgagaattctgacaaagtactcagtttaaagatggtttagttcatgaaaaacaatgctacaatgtaataaaaactaacagaatgtctgcatctttttcatcttaaaacatttgatttttgaatttttagattgattttggactattatttagtgtctaaggattgtctttttctagtttataatctgatataatagttttaaagtgataacctttatttaggttactcaaataggataaatgttcatggagcttgatggcttcctcttacaatattttaattttcaatattctatattgaagcatcaaatagagtgttaccctattaatgtaaatacattatatttttcagcaaaccataatggaatttgtattgagactgtatgtattataagtgatgatctttttgtatattataaataatttttagttgattcaaaaatatattatgggtggtgaatcaaacatattagaaattcaggataattgattaatcatgtcacttttctgacttcagtctccacatctgtaaaataacagaatcctttcaagctgtgaaaaatctcttataacctttatgttgagttgttatatgaaaatgtaagaaagtaagctttaaactgtctgaagattcccacactgagcagcatgctaacctgaatttattatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaacaaacaattaaaatttggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctcaaaggccccctgccaatattattaccttgggaattagcatttcagcacatgaatttttgagggacctttccctatcaaataagaaagaatacagaagagaaaacatgtactgatgacaacctaagaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccacaaaaattaaaagaatcgatctttacaatctctgtgacagtcagcactctacaccaccattaatactatgaaggccacagagtacgtttggtatattttccttttttctctcccactactgccttcatcaaaatacagtgaatagtcctccatcttcagtctttcctatgagctatatttataatttgtaggctgttacatttattttcagaggaacttttttttttttccgagacggagtttcactctcttgtccaggctggagtgcagtggcacgacctccgcctcccgggttcaagcgattcttgtgcctcagcctcttgagtagctgggattacaggcgcccgccaccatgcccagataatttttacatttttagtagagacggggtttcaccatgttggccaggctggtctcgaactcctggccttaagtgatacacccacctcggcctcccaaagtgctgggattacaggcatgagccaccactccggcccagaggaacgattgatataatggaaaaatagttcctctgaaaataaaaataacaacattggttcctaataaaagattaagagaaaaagacaagctgtcgaaatattggagcaatgtggggaatgaggaaggtggggtagggcagagaagggaagttatttttggagcaggggttggggttagaggacatatgaaaggagagcagcacagacccggaatcagactgccgccagcactttccagctctatggagtctgcctggttttgctcatcactgtatctctagcagctagcatagtgccgggcacataatggacattcaataaatatttgttgaatacataagtacctttttttttttttgaggcgaagtcttgttttgccgcccagcctggagtgcagtggtgcaatgtcggctcactgcaacctccacctcccgaggttcttcaagtgattcttcaagtggttcttcaagtggttcttcaagtgattctcctgcctcagcctcccgagtagctgggattacaggcacccaccaccacggccagctaatttttgtatttttggtagagacgggttttcctgcattggctaggctggcctcaaactgtgacctcaagtgatccgcacacctcagcctcccaaagtgctgggattacaggtgtgagccaccacgcccagccaataagtaccattttgacttcctgcccaaagatttagcacccagagctgtactgtgaatttgtttcctttgagaccttaggtttgaaaagtctctttgctatctaacattcagaggcaaagttgagtgctgttaccccaaagagggatacttttgtttgtgctgagtgtggttggtcagcttttaaaacagaaatagaatttactaaaggaagtgttttctcatctgcagcatgcaaatagcgtagggtactttgacttctcttttgtgtagtattttatgcatagttttcttatgccttttataaataaaagataggctaaagcagttagaaagtatagcaaaccatccagtgacaaagtgatttttttttttgagacagtgtcactctgtcacccaggctggagtgcagtggcacgactttggctcactgcagccttgaccttcaggctcaggcaatcctcccacctcagccccttgagcagctgggactacaggagtgtgtcaccatgcctgggtaatttttgtattttttgtggagacagggttccaccatgttgcccagactggtctggaattcctgagctcaagctatctgcccaaccacctcagcatcccaaagtgctaggattacaggcgtgtgccacctggcctgaggaagtgatttttgcttttaaaatgagaacaatttctgattggctatgttggtaaattgacatttttggggggggtgggtgcgggggaaccaggtcttgtttaagatgtaccggatacaacgtatttaaagggcaagaatcctttacgttggtactttatcagaaaaagtatagtagtacctagagcaataccacccaagaatggtctgtgatgatggaaatactgtgtatccgccctgtctggtaggactaaccacattggccaatgaacacttgaaatgtggctagtgcaaccgaggaactgaatttttaatcttatttaatagttttttttgttttaaaaaataatcatctagtaaaatagactttttttgggtatatagttctatgaaatttttttttagttttgtgaatgttaacacatgtatagatttgtttaacaccaacacaaccaggacatagcgcagccctgttacccctaaaaaactccctcttgctaccattttccctacctctaacccctggaaaccactgttctgttctccatcttcccctttagttggaaagtttaaattatttacagtcattttcttaaccctaaaatcacctcaggggagggaaattaaagtttaaaagaggccttctttaaaaacacaaggacacaaaagccttcatttgatggtggctactcttatattgcatgtctttcaatactatatgtctcaactatacgtggtttgactattctgcatttttttttcatggaaaatgttatatagtattatccaaaaccaaatataatttatttccccacttctgttttggatcatttatgctagtgatttcctccatccctaagaaccagctagccaactagaattatcagagtcttagaaactttccatgccatgggtacatttcacattttcacccaaatacacagtcatcaattatcaagctaaaggaagaaataaaaatatgttcattaaaataagtgaaagatttaactattgtagacaatttaaagagagattttctatgctgaattacttttaattataattttgagtttttattttatagagcaaagcttttcactagaaattaataacacctatatttaactgcttttttgaatattaatatcctatggccatctcaaaaatcaataggtccagcactgaatttatcatctctcctttccctccactttaacctcttaatttcctcctgatttcctcctctctttctgatatcagttaatgacgccaccatctatctatccactggcccaagccagatacctttaagtcatcctagtcgtctcctttatcctatacatcttgttaggaggccctaccctcctgaatgtatcttggagctgcctcttttatctttgcccccagtattcatgtcttaattcagaccctctattgcactacttttgcaattgcagtagcctcctagctgatagtcctccctcctgtatcactccaccctactacactatcatcttccacactgcctccagaatgatccttctctaaaatgaaaatctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaaattaagaaaatatgatgacaagaatgagagagaaacaattatttgtggttattgatttagaaaacagaatgttttctgaagtagcccaggaataactgaattaattatatttctttttattaactagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcaggtaattatcattttttctttgattaccctaatgttcttttacttccattttgctgcttcttttggcatttatcaatgagaaatgattcataggcactgtaattccacttttgcaaatatgtcctatggaggtagccagcagtatatacaaagatgcataaggatgtttgtataattgcttatgatatttaaaaactggaaacaataactcgtggtgcaacaataaataactcatgatgaaatgctatgaagtcataaaacattatggtattaaagataattaatgccacaggaaggtgtctgaggtattttgttaaatgaaaaaaagctgaaaagctatatatacaatgtgatcaaaattttataaagaaatgtatctgaatttacgccatgtatatattgtttatgtatatgaataagattcctggtaggatatgaaccaaaattttaacagtgattatctttgggtggtaggataaatgtgatttttgtttccattgtgtttcctggttttataagttgtttttacaataagaatgtatgtatgtagctatgtatttatataatgggggaagccagtgctcttttaaaaacaaaagtagttgaaataaataataggattttaactataattttatatttaggcattcaaattaaactgactccagagctgtcccaaagttttcgtatttcctgacagctcttacctttgaactgaaacaaaaaatgtatattcaatggaatttaattatgtgaaattgttcttttgaaccagaattgaacctggccttgaattaaactggaaaatgcccaaatgaaattttttgcttgaaataacaattgaaacgttttacaaccaatttctggacaatataattaatctttgctatcctgattagaatgaaagatatcaaatagtagtattccctttttaggctcactaaatctgagtaaaaaattttactaaacacatgtctaaattgttatggtagattaatgtcagtgagagaggacttagagacataccattattaatttttagttcttaatttttctgttggtgacaaatggtagaaattatagaattctcactttttaaaattgacacatagttcacataccataaaatttgcccatttaaggtacacaacccagtggttgttagtatacttacagagttttccagccatcatcactatataattttagaactttttatcactcccaaaagaaatcacatatccattagcagtcattgcccatttctccttcccctccccaagctcctgataacaactgttctactttctgtctctgaatttgactattctagggacatcatttaagtggaatcatacaacatttgtccttttgtgcctgaattattttatttagcataatgttttcaaggtccatccatgttgtagtatgtattagaacatcattcctttttattgctgaatattattccattgtatggatatatcacatttttgttttttcattcaacagttgatgggaatttggattgtctccactctcttgcctattatgtataacactgctatgaacaatttgagttcaaatttttgtatgaacatatgtttttatttctcctgggtatatatctaggagtggaattgctgggtcacatggcagctaaactttttgagggactgccagactgtttttcaaagtagctgttccattttacattaccatctcaaattctcactctaatgtagaaaatctcaattttttgagatttttaaattagaatctggcctggtacggtagctcacaactgtaatcctagcacttttggaggctgaggcaggcagaccacttgaccccagaagttcgagaccagccttggtaacatgatgaaaccccgtccctacaaaaaatacaaaacatcagctgggcatggtgacacacacctgtagtcccagctactcagcgggctaaggtgggaggattgcttaagcccggaagtcaaggctgcagtgagccgtgatcgtgtcactgtactccagcctgggtaacagaacaagaccctgtctttaaaaaaatagattttagattagaatctaatctaaaaaattagattcttttttttttttttgagacggaatcttgttctgtcacccaggctagagtgcagtggcatgatctcagctcactgcaaccttggcctcccaggttcagacaattctcctgcctcagcctcctgagtagctgggattacaggcgcctgacaccatgcctggctaatttttgtatttttagtagagatggggtttcaccattttggtcaggctggtcttgaactcctgacctcgtgatccaccggcctttgcttcccaaagtgttgggattacaggcgtgagccaccatgcctggcctttagattcttttgctctaaaaaagagatacatagttctctattagaaaattcatacagaacactaaaatgttaaagggactctagtaccaaaagtctgaacgaagtgtaggaaatccataattgctgaaggaaataattatgaaaccagaagaaaaatttaagttggaaataagtgcagttatatcagggagccataaaaatgactaaaattggtttcagcaaaatttcattttacctatcaccacttaattttttttttctttttgagatggagtcttgctctttcacccaggctgaagtgcaatggcatgatctcggctcactgcaacctctgtgccccgggttcaagcaattctcctgcctcagcctcctgagtagctgggattacaggtgcacgccaccatgcccagctaatttttttgtatttttagtagagacagggtttcaccatgttggtcacgctggtcttgaactcctgacctcaggtgatctgcccgcctcggcctcccagaatgctgggattacaggcgtgagccactgtacctggcccacttacatttttttaaatttttgaaaatgacagtgtttgaaattatattgattcacatttcactacttcataatgttggattatttctcagagcttctattaaattaaaatactttgatatgcataatggattatgttgtcaataatgagcaccacataaattagttatatcagtatcaccaaaacaagttacttacattataatattcctatgcctcttacatataggaacacaattataatcatcttacatcacatatggtataaaactgaaatatttttcatgttcaaatgtggtatctgtcattacagtaagcaagggcatcataaactttcagattggattcaaaaacagaatttttttctattcacttgggtttatatttttgcaactcacatttttgcaagtgtggttcacagaccagcagcacctaggaccttgttagaaatcagactctggcccactgcagacccagtaaatcaaattctacattttaattttaatgagctctccaggtaatccatttgcacattaaagtttgagaacactgatctacataatgtgattcattgacctttaaattctaaattaaatctacattaactttgtttacataaacaagtccagaaatttgattgaaggcaataatatcagtcataacaacatttcgatcaacaatggaccacatagacgatggtggtcccgtaagattataatggagcatatatagaaacctcatataaggcatttgatattggcatagcagatcaagtaggagaaatgattgatattcattaatggtgctaggacatttggtgttccatctgaaaaaatatatataaatacaaatataaagagcatctagttttgtgtaagtacactctatgatgttcacacaatgatgaaattgcctaaagcatttttcagaacatatttccatcgtttaagtgactcatgactgtataatattaaatattataatttaaaatagctagcatttttttaggagaaaagccatataaatttatttgatcatagttttacatgacatgggagccttcagaatgaagacccaaagatacaggagaaactgcccatttttgtgcttagatttagcacaatatggatagctaaaatagctagcattttattattattattattattggagacagagttgcactctgttgcccaggctggagtgcaatggcgcaatctcggctcactgtaacctctgcctcccgggttcaagcaattctcctgcatcagcctcctgagttgctaggattacaggcgcatgccaccatgcccggctaatttttgtatttttagtagagacagggtttcgccttgttggccaggctggtcttgaactcctgacctcaggtgatctgcctgcctcagccttccaaaatgctaggattacaggtgtgagccacagtgcccagccaaaaaagctagcattttatgaaggtttatataacaaatgtgagcagagtaaaagcaacttttcaattaccttagctgatcaaactagtaaatggaattcaagagtacttgatcagtctctggcaccatgtatagcatctacctagtccttaggaactatgactgcagcaagttcagtaacttttttttttttgagacacaatctcgctctgttgcccaggccggagtgcagtggcacgatcacagctcactgcagccttaatttccggggcttaagcgatcttcccacctcagcctcctgagtggctgggactataggcgtgtaccaccacacccggctaatttttttctattttttgtagagatggagtctcagtttgttgcctaggctggtctcaaactcctgggctcaagcagtccacccaccttggcctcccaaagtgctgggattacatgtttgagccaccatgcctggcctcagtaacttttaacaatgtcttttacctcaacctactattgttaagggccccgggaatcaattattcaacaaatgattatcaggagccagttatatgccctgcatctgttagggcttataacatacatactaatggccatgatgggtaggtaaaaaaccttggcatagtgaatgtcaccataaaagaattgatagagcttaactacagtgacccatattatcgggacatgaagtgactgcattctgtgattctgctagagattagagtttaagatttcaccagaattgtaactacccattttttaagtgtaagtgtcagtgctgatccaggttctcacagcctacttctgccacccattctcagacagaaggattgacacattttgcctttgtatcatactagtcctaggtgagctataaatcttaaaagaggtagtgagaagccagacgcagtggcttacgcctgtaatcccacgactttgggaggccgaggcaggtggatcacctgaggtcaggagttcgagaccagcctggccaacatggtgaaaccctgtctctattaaatatacaaaaaaaattagccgggcgtggtggtgggcgcctgtaatcccagctactcggaaggctgaggcaggagaaacgcttgaacgtgggaggcgaaggttgcagtgagccgagattgcgccactgcactgcagctgggtgacaagagcgagactccatctcaaaaaaaaaaaaaaaaaaaaagaggtagtgagaaaaatgggagatgccttttatcctgactatctgtattatcgtttccttaaagtaaaaaggcatgatatatgaagtaatcactaaccaattaaagcaatctaaatacttgattaaattccttccattttgtgactttttatttttgtttgtttgtttgttttgcgaaggagtcttgctctgtcgcccaggctggagtgcagtggcacaatcttggctcactgcaacctccgcctcccgggttcaagcgattctcctgtctcagcctcccaagtagctgggataacaggctcacgccaccatgcccggctaatttttgtattttttttagtagagacggggtttcaccatgttggccaggctggtctccatctcctgatcttgtgatccacccgcctcggcctccccaagtgctgggattacaggcgtgagccaccgtgcccagccgtgactttttatttttaactaatttcaagcttacaaaaaaactgcaagaaatagtagagaattcctgtttaccaatttcatgcaggttccacagttaatattttacatcgtttatcattctctcttaatagatagatatacatttatatatatatatacacacacacatacatacatttttttctgaactatttgagagtaagctgcagacatgatgtttatgattattttaaagccatttttagattatttatgtattcttcacactacaccagaggctgaacttcacatcggttttgagtatcagactggaaattctttcttgaaatatttggaatcatttgtagttgttgcctcaagtgcaggaaaatcaattttcctttgaatttatttaaaagtttaagtagtgttgttacagcctgtagaaaaattaaaattaaaattaaaaaattaaaattcattgtgaccttttcacacccttactgtctctgtggaggatgaagaaggctttgctcttttgcttgccacactcacagagctaaaggatacaattttatggatctttatttagaggtcatgctaaggtagctaaaagggactacctcttatgacttattttaatataatactgtatttccagagtgtgaaaattacagatggtattccaggttacctctggtacctaaaataacgaaattgctctggaacaacaggtaaagtgatgaacagaaaaaactttttttttcattgtccaagttcataattaagtctcaatagtaattatgagagaatgaaggaaccttctggttggattaaaatggtggttttattcaaaaccaaagtgattttttttttggctactcagcctcctttttgtttttctttggtttttaaaaaagcataacagcagtactatttggtaaatttcacagtctgtgttctaaataaagttctcacaatctgaatcagtatctttctgaagtgattcaattaagaccagagacaggctaattaaggaacactttactattcaaagtgtcctttgctggaatcatccaaaatccaaacctcagtgtcatgtggtgttcccatgtgacagacttgtacacgtacctcctgaatctaaaataaaagttgaaattatttttttaaagtgtcctttgctatactcagacctaggctggcagcactgccatcaactcagagcttggtggaaatgcagaatctcagaccctaccttagatgtattgagtcagaacctgcattttaacaagctcccccaggtgattgtgtatgcattcagatttaagaggcattaatatacttatttgagaagtctacattattctgtagggaagtggtcaggcttttgttaaagtttcttccaaacttgctcatcttcaacatcctgaaaaccagctcttctgtgcaggggttcctttgtctgctagctaaatagacatgagctggtattttgtccaaggacaagaatgaacaaattagatagactagtggaaatttgctcttttcttccttttctctacaggggaggagaaaatctttggcttttttttttttcaggtgcagggatgtgttagaataatttctcctttcttgggaggtaactaatactgcagtggataaactaaaacaaaatagcagaatttcagagacttcaggggagcttctgggatgatatgagcttccacagtccataaagattctctgaatactccattgtgcaaaatagactttttgctgacttattccttgcctcttcttccactgtccacagacatattaaaatttaaaaatattatatatgtatgttaaaaattcaaacaatatagaagtatagatagaggaaatttattcatctgtctgtcattctattcctgccttaaccctattccccagaagtagccactgttaatagtttggtatgtaacccccccgcccagctttcttatgcatgttctcatctatgcatacactaaaattaaaaaaaaaaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctgcctcagcctcccaagtagatgggactacaggcatgcaccaccacgcccagctaatttttgtatttttagtagagatggggtttcaccatgttggccaggctgatctcaaactcctggcatcaggtgatccacccaccttggcctcccaaagtgccaggattacaggcgtgagccaccacacacggcccataaattttcttctaaagctatgcctaaaactgacaaatagaatatttaagaatttcattattactatacccagaccaagcaccagaccaaaaacaagtttgtttagaattatatttttctctttgcttgtggtaaaaatgttcacaagttacttaatattgtatacaagtgttaattttaggttacacaatcttagaaaatgtataccacagttttttaaattcagtcacactcagatgttttagcttattaatttgcactcatatttatagacttcccagtatagcacagtagatttgttaaccataaagatatgtgatgatggccaggcacggtgactcacacctgtaatcccagcactttgggaggccgaggtgggcggatcgcctgaggtcaggagttcaagaccagccgggccaacatggtgaaaccccatctctactaaaaatacaaaaattagctgggtgtagtggcgcatgcctggagtcccagctacttgggaggctgaggcaggagaatctcttgaacctgagaggcggaggttgcagtgagctgagatcgtgccagccactgcactccagcctgtgcaacagggcaagactccatctccaaaaaaaaaaaaaaaaagatatgtgatgaggtttcatgagatcaaagtcataaatttggtactttggctgccctacccctaggtgtcttaatgatacatatggttagtcacagagctaaataaagaagtatggactagtataagcttatccccaccattgagaaaattactcaaaatgtatgtagtaatcacctcacctcatatattaagggcagaacattattataataaaatgtatggtatacggagtcatcttcagttcaatattaccttgtctgcattctatgatttctgcttcagtttagcctccattatttctaactggaatgcactcaaggctaaagcttctattattctttttttagattaattaaaaaagaaaaggagggaggttgccaagcaaatgaaaatgaaaagaagcattcaaggtttctatttaatttaagaaccaactattttggggcaattcagaaatagctttcttcatgagacaagcaatgcctatgccagttacaattttttttaagtctgttaagctgatttttccaattacttccatattatcccctttacaacctcttagcccagttagaaataactttagcctagctggagtcactacattcattttgtttttaactaagtagcattggtcttctctcaatttagtctgcaacatacatatatatttatatatattttataatatatgttatatataaatatataaatgtatattaatataatatataaatatatatgtaatttatattttgagacaaatcgcactctgttgcccaggctggagtgcagtaggaccatctcagctcactgcagcgtctacctcctgggttcaagcgattttcctgccttagcctccctagtagctgggactacaggtgtatgccaccatgcctggctaatttttgtatttttagtagagacagagtttcaccatgttggccaggctggtcttgaactcctgacctcaagtgatccacccatctgagcctcccaaagtgctaggattacaggcatgggccaccacacctggccctgcgttatatttttaaaaaatgaacagaaagagttcttattatagtttgaagagtttttttaaattatctgcaatttacataagtattgaacttatgtttttgacatttgaaaaatcaaattttcccttctatttctgtttgcccatagattacattcagctgaagcaaaaagattttttcctactttctctatacctttcctatattactgacactttcccattaactgatcacctgaattgtttgataccaacaaagcccaaaatgtaagcactttatatagaaaaattagattatattaggtattttttctttttttcactgtgtatacgtttatctacttttttaatttttaatttttgtgagtatataataggtatatatatttataggttacatgagatgttttgatacaaacatgcaatgcataataatcacatcatggaaaatggggtatccatctcttcaagcatttatccttgtgttataaacaattcaattatattctgttacttttaaatgtacaattaaattatgattgactatagtcacactgttgtgccatcaaatactaggtcctattcattctttttatttgtacccattaaccatccccacttccccttacaacccccactatcctgtttacttatttaaagctattaaattaatatttaatcattttttctttttttatcaaacctcagacttgacctatggactgttgatccccattccctgtcaggtagccatcaaatgccacagaatcctagaaagaacttctatttttgctatgtagaattaattttcttcctggcaatgacagcaatagctggcctagaaaagtggaatggttgttaaaaaaaaaaaggtttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccaggatgtattatttacttaagcaaaacaagttgcagtgtaatacttatggcataatctcatttagtaaaaaatgcaaaactacatgtatgtgtacttacatatgtatataaacacctagagaaaggactagtatatacacatgattaacactgtttatctcaggaagagagcgggattgagggagaagatcaaagagaaacttgcatcttttcaacattgaaatttttacagctagaatgtatttaaatttatttgtataacttaaaaaattaaaacaaaaaatcttgtaccaaaataagttccagtttaagcaaaaattcaaatgtaggctgggtgtggtggctcacgcctgtaatctcagcattttgggaggccgaggtgggaggatcacttgagcccaggagttcacgaccagcccaggcaacaggtgaaaccccgcctctacaaaaagtaaaaatttaggccagtcatggtggctcacgcctgtaatcccagcactttgggaggccgaggtgggtagatcacttgaggtcaggagttcaagaccagcctgaccaacatggtgaaaccccgtgtctactaaaaatacaaaaattagctgggtgtggtggcatgcgcctgtaatcccagctactcgggaggctgaggcatgagaattgtttgaacctgggaggcagaggttgcactgagccaagactgcgccactgcactccagcctgggcgacacagtgagattccatctcaaaaaataaaaaaataaaaataaaaataaaaaatttaaaaagtaaatatttagccaggtgtggtggtgtgcatctgtagtcccagctacttgggaggctgaggtgggaggattgcttgagcctgggaggttgaggctgcagtgagctgtgttcatgccactgcattccagcctaggtgacagagtgagacattgcctgcctcccaaaattgaatgtaaacaatgaaaccatgaaattactagaagaaatatttggagcattttttttcaatattatgaaactttcggacatacagaaaagtcagaagaattgtacagtagatatcctatatacaccagctagattctacaattaatactttactatatttgctttatcatacatcaatccatcaatacatcactgaaataattttagactcacaagtaagtaaaaaaaagtacagaaaatttccatgtagccttcatctagcttttcccaatgataacatctaattcatttataaaacaatattggaggctgggtgcggtggctcatgcctgtaatcccagcactttgggaggctgaggtgggtggatcacctgaagtcaggagttcaagaccaccctcgccaacatggtgaaaccccgtctctactaaaaatacaaaaaattagccgggcgtggtggcacgcgcctgtaatcccagatactcgggaagctgaggcaggagaatcacttgaacccgggaggtggaggttgtagtgagccaagatcacgccattgcactccaacctgggcaacaacagtgaaactccatctcaaaaaaaaaaaaaaaaaaaaaaagaaaaaaaaagaagaaaaaaacaatattggatttggaagcgtttttctaaaatatgatacaaaaccaataaaagaaaagattaatagattgatgaattcagatacctaaacatttcttcttgggatgaagacaccaaatggaaagtcaaaaggcaattaaaataattataattcatatcatagatgaaggttaattttttcatatacgaagaacttttatacatcaataagacaagcgtcagcaccccaaaatttcttttctatgataaaggatatgaactgacagttcacagaaaagcaaaaacaatacctcttaaacatgaaaagatgttcaacttcattcgtaatgagtaaagcaaattaaaatggcactgaaataccattttcacttattggattggtaaagttaacaattttgttaacactatgtttctgatctctcatgtattgctggtggtgtgtacattgatacaagatgccaacagaggaatttggcaatatctgtcaaaggtgaaattgcacatagcctttgcctcagaagttccacttgtaggaatttatccaacagacatttttgcatatgtatgaaatgacatgtatgcaaagatgttcattatagtattgtttacaatagcaaaatatgaggaaaaactaaatttcagtcattagggactaaaattatgatacaatcatatcatgggatactgagtagctattaaaaacaatgaaaaagaatgagtaggtttttatatgtttttaaggattaaaaaataatagcttttttgaaataccataaaactcacctttttaaagtgtacaacccagtggtttttagtatattcacagacttgtgcaactatcactactatctgatttcaaaacattttcatccccattaaaataaaactcattagtagtcattctttagtcctaatctcttacctgtactggttctactctctctaccctaggcaaccactaatctactttgtatttgtatagatttgcctattctggacatttcatataaatggaataatataatatgtggtcctttgtaaccggcttcttttatttaccatagtgtattcatggttgatccatgttgtagcatgtatcattactgcattcctttttattgccaaataatattccaatgtatgaatatactacattttgttgatttagtcatcagttgatggacaattgggttgtttccactttatgaatattgctgctattataaataatgctgctatgaacattcatatacaagtttttgtgtgaacttatgtttttaattcccttggggatatacctagaagtggaattactaagtcatctagtaactctatatttaaccttttaagggactgccagactgttttctaaagcagctgtaccatttcatatccccaccaacattgtattgacgttccaattgttccatatgcatgtcaacacttgctattacctttttattatagctatcccagtggaagtgaactggtatctcattttggtttgatttgcatttccctgatgactaataatgttgagtatcttttcttgtgcttattggcctttcataaatgttctttggagaaacaattcgaatttttaccttttttttttttgagacggagtctcgctctgtcgcccaggctggagtgcagtggcgcgatcttggctcactgcaagccccgcctcccaggttcacaccattctcctgcctcagcctaccgagtagctgggactacaggcgtctgccaccatgcccggctaattttttgtatttgtagtagagatggggttttactgtgttagccaggatggtctcgatctcctgacctcgtgatccgcccacctcggcctcccaaagtgctgggattacaggcgtgagccaccgcgcccgaccatttttgcccatttttaattggattgtttgtctttttattactgagttgtaagaattctttatatattctagatacaagtcccttatctgatatatgattttaaaatattttctcccattctggtattgcctcttcgttggcggtgttgtttagagcacagaagttttctgggtacagcataggtgcatgtgcctgtatttatgaggtatatgagacgttttgatacaggcatgcaatgagtaacaaacacatcatataacatggggtatccatcccctcaagcatttatactttgtgttacagataatccatttatactcttttagttatttttaaatgtatgattaagttattattgactatagtcatcctgttctgctatgaaatactatgtcttattcattctattttttgtactccatgttgttttcttgaataaatgcttcctagattgctgcaagcttttgtttgatttccagatttctggaaaaagatggttcttacaatttctgccagttttctcattgcttttacagaggagagaattttagaggtcttactgcaccatttgcactgatataccttcagcagatattcttgaataaatccttcttaatttgtggtatgccctttggtcaatttccagagtatttcaatggctgttttttgatacttttgtcagttttatcattgctttttgaggaaaggatttgctgagctcctcacgcagtcattctagaagtcatgcccatccattttataatttaacgcccagctaaactataaccccactcaagatatagggaaagatacatttttagacatacaaagtcaaaacacttttgccatccattaatttcactgaaagctatactagtgattatatacttcagcaggatgaaaaaaaaatccagcgggaagcaagactggatacaagaaacaataataaatgtcaaatcctctatcactgagtagtagtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctcttaaaaaaaaaaaaaaaaaaaaggaagaaatatctgattttccttgtattatggaatatccattggatcatagatgatagccccacaggcttgtgcagcaatttgaatacctccctctgcatgtacatctattgaaatacaaacacgattgttttggcttaatctccctttagtgtttatggattagctaaaagccaaagaaagtgactattgatactttaagttattgagatatatatgtgaatttcagcattttttaaaattcaatgattatcattcctatattgcagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaaggtaaagtaagaaagggtgacatttgttaaaatgttgggtggataaatgaccttagtattttttaggccaatcattggaaatacatgcttttatgtagttaaccatttactgaaagacgtattttcattttggcaatattttaagttaaatatcagtttagaagatttaccaaatatggaattaatactgtagatagtacagtatgtctgtttattttaagagagacaaatgagaaatacttatcacttatttacttacattattaattgaaaaattgacatgaccacatggtttaaaataatgatagaaaaaattcacccatattcccttgctataatgtaaatcattttctaattccattctacatacctttctacttaacagagttgcaaatgtagtattcatactactttgtacccttaacactataaagtttttcaccatttttgcagtctagattattatctaatatttctgactaagtctgtcacatcagtttgctttaatttaataaaccattcaggtgtttttcaccattagattgtttctaattttttatttttagataatcctgcattgaacatactcatgtctaatagtcatttccattgagctaatatcttagaagacattacaaaggatgtgtttactgggttaaagggcataaatatttctctggttcatggtacaagttgtaacagtttttgccagcaggggtatgtcagtgaagtatttttactacaacttcaccagcattgcatcccccccacaaattctttctaagttaatagacattaaatggtattacagggtaactttagtttgtgtttcttccattaatggtggggataaacattttttcatcatcggatgtttatatttccttttgaatgatttgcttatatatgtcctttgcctgtgtgtttattgggttcatgtttttcttattaatttatataatttcttcataaattatacctaataatacttttaaaatattttgtgtacttttaggctgggcgcggtggctcatgcctgtaatcccagcgctttgggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatattgttttacggctaaatattctgtgttatctctaaaaaaggatatattctgatataactatactaccgtactgtacctaacaaaatgaacattaattccttaatgtcacctaagacccaattcatattcacatttctcctgttgtctccaaaatgttttaagtctctttgcctgaaatagaattcaaacaagatccatgcatcatagcatttgactatcatatggcttatgttcttttaatctaaaacagcgcctctcttctttctcctcattgtccttccttccctcctccccacaaaacaattgacttgaagaaatagccatcagttgttctgtagaatatcccacaatgtgaatttatcctttgtttccttttggtttcatttaacttgttctataactcctatgttacttgtaaattggaagataaagctaaagacttgattatatttcattcttttgtatttctcatttttatactaataaaattgtttaggcaaagttacataataaagaaatttttagttaaatgaaacccattacattattttttaaaactttcatttttaatttaatgactgttcaaaaaaatagagtgcctactttgtgctagctactgtgctgttcactaacagtaagcaagactgacatactagttcctagtttaaatgttggttctagcttccattggcagtaattatggagccacaagcttgacgtgaactaaagagcttacatggagaggtcagggtaggaagcatattatcatggtgctttttatgttaacttatatccagtgaagaacaagtggatgtggaacttgtacaacgtggagatatcattaaagtagttccaggaggcaaatttccagtggatggtcgtgttattgaaggacattctatggtagatgagtccctcatcacaggtatgttctttcaaaggatcatgaccaaaatgttaagaaaaatagacatgaaagatgaagcactttttgtagaagctatgaataactaaattatgaacagagagaataagttcttttaagactgtattaaatcaatttcctcagatttactttgtggctttagttatgctattagtccattttcacattgctataaagaaatacctgaaactgggtaatttataaagccaagagatttaattgactcacagttctgcatgtctggggaggcctcaggaaacttgtaatcatggtggaggagaaggggaagcaaggaccttcttcacaaggcagcaggagagagaagtgctagcaggggaaataccagatgcttataaaaccataaggtctcatgagaactcactcactatcatgacaacagcataggggaaaccgcccccatgattcaatcacctcccctcctcgacatgtggggattacaatttgagatgagatttgggtggggacacagagccaaaccatatcatcccacccttgacccctcccaaatgtcatgtcttttcacatttcaacaccaatcatgccttcccaacagtcccccaaagtcttatttcagcattaactcaaaagtccacaatctaaagtctcatctgagacaagacaagtcccttccacctatgaggctgtaaaatcaaaaacgagttccttccaagatacagtgggggtgcaggcattggataaatgctcccattccaaatgggagaaattggccaaaacaaagggactacaggccccatgcaagtccaaaatccgttggggcagtcattaaatcttaaagctccaaaatgatttcctttgacttcatgtctcacatccaggtcatgctgatgcaagaagtgggctcccaaggtcttgggcagatccacccctgtggctttgcagggtacagcccctgccactggctgctttcactggctggtgttgagtgtctgtggcttttctaggtatacagtacaagctgttggtggatctctaccattctgtggtctggaggatagtggccctcttctcacagctccactaggcagtgccccattggggactctgtgtgggggctctaaacttatatttcccttctgcactgccctagcagaggttttccatgatggcttctcccctgcagcagacttctgcctgggcatccaggcatttccatacatcctctgaaatctaggcagaggttcccaaacctccgttcttgacttctgtgcacctgcaggcccaacaccacgtggaagctgccaaggcttggggcttgcaccctctgaagcaatggcctgagttgtaccttgaccccttttagccatgactggagctgaagctgctgggatgcaggatacgatgccactgaggctgcaaagagcatcagaggccctggttcccagcccacaaaatcattttttctcctaggcctcagggcctttgatgggaggggctgctgccaagatctctgacatgtcctggagatgttttccccattgtcttggcgattaacatttggctcctcgttacttatgcaaatttctgcagcccgcttgaatttctccccagaaaatgggtttttcttttctattgcattgtcaggctgtgaattttccaagcctttatgctctgcttcctttttaaacataagttccaatttcaaaccatctctttgtgaacacataaaactgaatgctttcagaataatgtaggtcatgtcttgaatgctttgctgcttaaaaaatttcttctgccaggtatcataaatcatctctctcaagctcactattccacagatctctagggtgggggaaaaatgccatccgtctcttttcttgtttctttttttttttttttttttttttttttttgagacggagtctcgctctgtcgcccaggctggagtgcagtggcacaatctcggctcactgcaagctctgcctcccggttcaccccattctcctgcctcagccgctggagtagctgggactacaggcacccgccaccacgcctggctaattttttgtattttttattagagacggggtttcaccatgttagccaggatggtctcaatctcctgacctcgtgatcagccggcctcggcctcccaaagtgctgggattacaggcgtgagccaccgcgcccggccaccacccatctcttttctaaagcatagcatgagggacctttactccagttccccataagttcctcatctccatctgagaccacctcagcttggacttcattgttcacatcactgtcagcattttgatcaaaaccattcaacaagtttggctgggcgcagtggctcatgcctgtaatcccagcactttgggaggctgaggctggtggatcgcttaaggtctggagtttgagaccagcctgaccaacatggtgaaaccccgtctctactaaaaatataaaattagccaggtgtggtggagcatgcctgtaatcctagctacttgggaggctgaggcagaagaatcacttgaactcaagaagcagaggttgcagtgagccgagattgcaccattgcactccagcctgggcaagaagtgcgaaactctgttacaaaaacaaaaaacaaaaaaacctaacaccattcaacagatttctatgaagttccaaactttcccacattttcctgtctttttctgagccctccaaactgttccagcctctgcccattacccagttccaaagtcgcttccgcattttcaagtatctttatagcagtgtcctactccctgtggtaacaacttactcaatttactacattagtcagttttcacactgctctaaagacatacccaacgctgggtaatttatgaaggaaggagatttaattgattcacagttctgcatgactgggaaggcctcaggaaacttaaaatcttggcagaaggtgaagggggcaaggaccttcttcataaggcaacagtagagagaagtgccagcaggggaaatgccagacacttataaaaccatcagatctcgtgaaaactcactcatcacaagaacagcataggggaaatgcccccacatgactcaatcacctccctcccttggcatgtggggattataggtccctccctcaacatgtggggattacaattagagatgaaacttgggtggggacacagagccaaaccgtatcaactattgaagacttttatcactggagattattagctgctagaatgcataaccaaaggaagttgtctcagtttcctgtagacttgatggactttggcaaattttcctgggcaaatacctattctgcccttcctgctgtaaagactggtctaatctgagctatgacacgagtccaggttttccacatcagggtctactctaagggaataggcctggcatagttttagaaattttaggtaactaaggccaatctgaggcagaatcaaaatgatacctttccaatctcaactctctgatagtcctagaagaagctcagtttatgaaccatgtggaaataatttaggactgtgtgtttctttctttctttcttttttgtttttttgttgttgttgttgttgagacaaggtcttaccctgtcacccaagctggagtgcaatggcacaatcttgactcatggcaacctctgcctcccaggctcaaacaatcctcccacctcagcctcccacgtacctgggactacaggcgcatgccaccatgcctggctaacttttgtatttttttgtagagatcgagttttgccatgttgcccagtctcgaactcctgagctcaagccatctgtctgcctcagcctcccaaagtgctaggattacaggcatgagccgctgtgcccaacaagactgtgtgtttctcaataggggtgctattgccagtttggatggggcaattcttagttctcggggactctcttacatactgtagtacaattcagtgcccctgaccctggcactggcacactaaatcgaagtagtagcacccccttccccatcccgtgcagtcattattacaaacgaaaactccctcccacatttctaaatgttccttgagaacaggttaagaaccaatgttctaggactagggtgaaactctaaaagtatctgccaacaagagctaccatacaggtttttccagttcaaggtttatattcctggcattggcctagaactgatataaggaaaaagggaaagcaactttcacctaggcatttgttcagattctattttatatctagatatttttgacaagtaacaaataatgatatgtttcatgatagtgatcatttatgctccttaaatctatctttactctccatacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggtaacttaactccctaggagaaacacaaactattttctttaaagccttctcagtataaatcttcacctagtttttacgttttccaataaaaattttagttgcattaatatggagttcgtttgtttttgttttgagatagggtctcactctgttgcacaggctggagtgcagtggcaccatcatggctcactgcacccttgacctcctaagttcaagcgatccttctgcctcagcctcccgagtagctgggactgtgtgtgggcacatgccaccacacccagctaattaaaaaaatttttttttatagaaacagggtctccctaagttgcccaggatggtctcgaactcctggactcaagctatcatcctgccttagtctctcaaagtgttgggattacaggtgtgagccaccacacctggccattaacatgaagtttgttaaaatatttctatttgtgctaactactaaatatactctgcattcagtatcagaaaagactttgatatgcttcttcttcttattattgttgttatttttaattctaggctcctatccagcagtttgcagacaaactcagtggctattttgttccttttattgtttttgtttccattgccaccctcttggtatggattgtaattggatttctgaattttgaaattgtggaaacctactttcctgtaagtgacttgtaataactcgttactatatgcagaacaatttgtgagtcttttgcattagtaattcattggaaataactttaataattaccaggatctttaaaggtttggagtgggagagtgataagaataatatttgcatttttataaatataaaaaatttccttttggaaaaaaaattttattatgactggtgattttccaaaagcaaataccaaacttttacatgttatgcttagtctcatttctgacatggttttgctttcacagaggactatagatatattgaggaaaacctcaggatttcagctctgtcatttactgtcaatatgatcttagactacttaattgctctctgagcttcagtttcctcaactataaagtgaggttttaataatacccattttgtgtaacttaaggttgttgtgaaggttaaataatatattagaaataatttgtaacttattaaatgctttacaaatataagatattattagtgtctactcatctagttctctgatgctgtctatggtgttgtaaagtggtaaagcagaactggactgtgcctcaaattagatatataaactttaagtcatgtaagttttactatcctcagttctcttatctgtaaaatagggaaaatagtacctaagatacaggattggaattagtataggtgaaagcatctaacatattgacagatgcaggtgacagccaagggtccccctgcgaaacccctgaaggttgaaaactttcaagcctaaaacatcctgaaggttgaaaaaccggactgctggtcccagatgaagcctgccctactcccctacccccgactgattctttctaaataatgtccacctacgcactgggaggatggggtggggcccctggaagttcaccccgtttgtatagggaaggagtctggactgacctgttcctgggtggtacctggggttcagtcggtgaggtggagagcctgttaacaggactcaatctcattttgttgagttgtttttcctttttcctttttggccaataaattcctttcccctcgcccttcaaagtgtctgcagacctaatcttttcctggtcgtgtgacaagaatctgttctttttctataacaacatgtatacatatgtgaagtttatggaagcataagcctagaaatctatgaaagccccttccagctgtgtttctatatagatctataattcttggatgaatatttaagtatttgagaacttaacctaacactgtaaaactgttactgataagagctgcagtgagccatgatggcactaatgtactccagcctgggcaacagagcgagactcctactcaaagtaaataaagtcttactttgttgtatttatttattttattttttattcaggaggtacatgtgcatgtttgtttgtttgtttgtttatttatttatttatttatttatttattgcgacagagtcttgctctgttgcccaggctggagtgcagtggcacgatctcggctcactgcaacttccacctcccaggttcaagtgattctcatgcctcagcctcctgagtagcggggattacaggcttatgtcaccatgcccggctaatttttgtatttttagtagagatggggtttcgccatgttggtcaggctggtctcaaattcctgacctcaggtgatccacctgcctcggcctcccaaagtgctgggataacaggcatgagccactgtgcccggcccgtggatatattgtttattacatgggtatattgggtgatgctggggtttaggcttatagtgaccccatctcccaaacagtgaacatagtactcaataagtagtttttcatcccttgcccccctcccttcttctcaccttttggaggccccactgctcattgatttcatctttatgtccatgtgtagccattgtttagctcctgcttataagtgagaacatgtagtatttgattttctgtccctacgttaactcacttaggataatggcctccagcttcacctatgctactcaaaggacatgatttctttttttatggctgcatagtattccatggtgtatatgtactacatttcctttatccagtccaccattgatgggcacctgggtgactccatgtctttgctattgtgaagagtgctgtgataaacacacacatgcagttgtcttttgataaaacaatttaaaataaatataagaaaatcctttgggtagatatccagtagtgggattgctgggttaaatggtagttatattttaagttcttggagaaatctccagactgttttccgtagaggttgaactgatttacattcccaccaacagtatataagtgttcccttttctctgcatcgttgccaacatctgttattttttgatttttttaattatagccattctgactggtgtgaaggggtatttcattgtggttttaagttgcatttccctgatgattagtgatgttgagtattttttcatgtgtttttttttatcacttgtatgtcttcttttgagaggtgtctatttatgccctttgcccacttttaaatagggttgttttatccttgttgatttaagtttcatatagagtctagatattagtcctttgttggatgcatactttgcaaatattttctcccattctgtaggttctgtgtttattctgttgattgtttcttttgttgtgcagaagctctttcgtttaattaaatctcctttattaatttttggttttgttgcaattgtttttgaggtcttagtcataaattctttccctaggataatgtctagaagagtttttcccaggttttcttggggtttttatagtttgaggttttacatctaagtcttcaatctatcctgagttaatttttttatatggtgagagatatgagtccagtttcattcttctgcatatggctagctagttttcccagcaccatatattgaatagggtgtcctttccccattgtttgtttttgtcaactttgttgaagaccagttggttgtaggtgtgggctttatttctgggttctctattttgttcagttgatctacgtgtctatttttgtatcaataccacgctgttttgattactatagtcttttagtataatttgaagtcgggtaatgtgatgcctctagttttattctttttgcttaggattgcttcggctatttaggttctttttccatatgaaatttaggattgctttttaaattctgtgacagagaacattagtagttttataggaattgtgttgaatctatagattgctttggacagtatggtagataggattagggttagacatggagagaagatcatctcctgccacacccttcccccacacctacagtgctgcggatgcagcagtgctatttcccaccaggggccagctagcgcacacttggacaaagcatatttcatgcttttcatggtggctccacccctactgcaagtgagtcacgtgccgcttgggttttttccaagggcgaggctcaactccctctcccgacagagtggcactgtcccagcaaggagggacagacaaatcactgagttgcctgctttggtctgggggaaaagactaacccaaacccattttagtggtagctatcagaggggcatactcatgggaaccaaaggacaaagtccttatgaaatgaaggtcaggagccctataacaagggcacaaaagagaagctgatcatgttcttgctggcacaggatcaggagtgcgagtgcaccctaatataatctcttcccaccacccctgcatcagggcaggtgcttctacctggcaccaacctacctgctgtctcttactcttgagtgccatctactggtgtgtatcctgaactgcatcataaaatttaaaatctgctaacagaagggcttagttctagcccttaagataagtccacagggacctctgcaccctaaaccctataggagattgttagctctaatggctaatacctcactacaaaaagcagcatctgagaaagctatggcatagaagctatccacaaccaagtaatctgtacagcaccttggacccctgaaagcaccaaaaacaaagctaaatgatcacacacaacatgcaccacagtaaagcacccaagggaaaaaaaagaaggaaagaaaacgtcccttggaaatgatagcaaattcaaaaacaggaagcaaaagttcccttggatgggaaagaatcagtgcaagaactctagcagtacaaaaagtgttttcacaccgccaaacgattgtaatagctctctagcaacggatcctaagcagacagataagtaatttaaaatatggattgcaaggaaacctcaatgagatccaaatgaaagttggaatccaatgtaaagaaaccagaaaaacgattcaggatatgcaagacgaggtagccatattaagaaaaaaaacaaatggaactgctggaactgaaaaattcagtaaagaaatttcaaatccagagaactcctgcaagacactatacaagatgaccatcctcagggcacacaggcattagaatatccaaagtcaatgcaaaagaaaaatatcttaaaggcagctacagaaaagggccaaattacctacagagcaaaacccatcaggctaacagcagacttctcagtggaaatgttacaagctggaagtgattgagagcctatttttagtttccctaaagaaaaaaaaaactggcaaccaggaatttcatatcctgccaaattaagcttcatacatgaagtagaaacaaagtcttcctcagacaagcaaacagtaaggaaattcatcaccaccagaccagagctataagaaatgttcagagaagttctgaacatggaaacaaaagaatgatacttgctaccacaaaaacatatataaatacaaagctcacagaccctataaagcaattacacaattgagactacaaagaaactagcaaacactaccataaggaacaaaaactcatatatcaatattaaacttgaatgtaaatggcctaaatactccacttaaaagacatagagtggcaaattggaataaaaaaacaagatccatccttttgctgtcatcaagagacccatctcaaaggtaataactcataggttgaaggtgaagggatggagaaagatctatcatgcaaatggaaaacaaagagcaggggttgctattcttgtattacataaaacagagtttaaatcaacaatagttttaaaaaaaggcaaagaagggcactacaaaatgataaagatctcaattcaacaagaagatttaactatcttaaatacatatgcacccaacattggagcatccagatttataaaacaaatactgctagacctacaaaaagaggtagactgccatacaataatagtggaggacttcagtaccccactgacagcactagagagatcatcaaggacaaaaattagcaaagaaactctgcacttaaattggattctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaaccctatctctactaaaaaatacaaaaattagccaggcatggtggcacgcacctgtaatcccagctacttgcgagactgagggaagagaattgctcgaacccaggaggtgtaggtttcactgagcctagatcacgccattgaactgccgcctgggcaacaagaacaaaactccgtctcaaaaaaaaaaaaaaaatctctgttcctgatgacatgattctatacctagaaaaccataaagatttctccaaaagactcccagaccagataaactacttcagtaaagtttcagggtataaaatcaacatgcaaaaattattagcatttctatacaccagcaacgtccaactcgagaactaaatcaagaactcaatcccatttacaataatcacacacaaaacatacctaggaatacatttaaccaaggaggtgaaagatctctacagagagaagcataaaacactgatgaaagaaactgaagaagacacaaacaaatggaaaaacattccatgcccatggattggaagcattaatattaaaactaccatactgtccaaagcaatctatagattcaacacaattcctataaaactaatgtcctctgtcacagaattaaaaaagcaatcctaaaattcatatggaaaaagaacctaaatagccaaagccatcctaagcaaaaagaataaaactagaggcatcacattacctgacttcaaattatactgcaaggctatagtaatcaaaagcatggtattgatacaaaaatagacatgtagatcaattgaacaaaatagagaacccagaaataaaaccacacacctacaaccaactgatcttcaacaaagttgaccaaaacaagcaatggggaaaggacaccctattcaatatatgatattattatatgggattacagacatgagccactgtgtccagcccactactgtaatattaaaaagtttctttaagtgattcatgtctgtttagtacacactgaacaaaaggattgttgggaagtttttttggtatttatttatttatttatttatttatttatttatttatttatttttgagacagggtctcgctctgttgcccaggcaggaatgcagtggtgcaatcatggctcactgcagcctcaaacttctgggcttaagcgattctcttaccttagcctcccgagtagctgcaactgcaggcatgcaccaccatccctggctaattttttttttttttttgagaccgagtttcgctcttgtcacccaggctggagtgcaatggcatgatctcggctcactgcaacctctgccttccaggttcaagcaattcttgtgcctcagcctcccaagtagctgggattacaggcatgtgccaccatgcccagctaatttttgcatttttaatagagacggggtttcaccatgttggccaggcaggtctcggactcctgacctcaggtgatccacctgccttggcctcccaaagtgctgggattacaggcgtgagccactgtgcccggccatacctggctaatttttcacaaattttttttgtagagatgaggtcttaccatgttgcccagggtggtctcaaactcctggcctcaaatgatcctcctgccttagcctccaaaagtactgggattacagatgtgagcccgtgcacagaccagcaagtagcttggaatgtgtttccttcaggaatttttctcatgagttcaggatgtcttagatttcttctaaaactaccaattatatttttcccacatgagcaaacactgaacgtcactaagagcttaattagcagatatacttggttcacattgttatgtccaaaaggattttgttgaaatatgactaaggtccctttgcatgccatgtgattctttttcattgtctttcaagaatagtgtgaaaggcagaattatggttttactctacagagattgagaattctgtttattcagtatcaaattttttgaaaattatgtctcacatttgcagctatttctgaaaatttctaataaaaacattcattctcaatatggagcacttatattcagtccatagtttgtaattctggaatctcagtatgtcccaatttcttatattcataaaagaaagaaagtgttttcttacctgtaactaaaaaatatatgtaggtagctaggtaggatatgtcactttttaaattgtggttttatttaaatagtgttaagttttgtgtcttttgttttgtacagctctaaatcaataaccaaaatttatgcctttcttctaaagggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaagacagtccccagaactaaaacctgtaccaccaaactatcaatagcacccctcacatgtgagaaacacatactcctaaattatttctctgtggtccatgagctgagctgcttctaggactatccagagatttgaggtaggaaaggtgttattttggttctgcttcagattggcctttgttacctaagattcctaaaactactccaggcctatttattagagcagaccctaatgtggaaaacctggactcctatcctagctcagactagactagtctttgtggcagaaagacagaataggtgtttgcccaggaaaatttgccaaactccagcagccttctaacctatttgtgtgtgacttgttttcttcactgggaccttcaattgcagtgccgtttctttgcctttgctgccaccagccgacagtttgcagctatgactttaggaatataatcctatctctgatctcatattaggatttccataatcatctcaaagctacttgacttcaactaaaaccatgtttctactagtatgttcttattatgaggatgtaagctatgtacagaggtatatagtaaacatagaacatatcttagaacaaatctggaaactcacctcgccagagaatacaggctagtaatttttatagacattttaaactttgatataatttcaaacttaaaagtcgcaagactagcctggcacagtggctcacgcctgtaatcccagcactttgggaggctgaggcaggcggaccacgaggtcaggagtttgagaccagcctgaccaacatggtgaaaccccgtctctactaaaaatacaaaaattagctgggcgagttggcacacctgtaatcccaactactcaggagactgaggcaggagaatcgcttgagcccggagggcaggggttgcagtgagctgggatcgcgccactgcactccagcttgggcgactgagcaagactccatctcaaaaaaaaaaaaaaatgttgcaagactagtacaaagaactcctatatgccctttactgcagtcgttgggctcttttcctaagaataaggacattctcttatgtaaactgtagtacaactatcaaaatcaataaattaatattgatatgttgttatctgatctgtagtccatgttccagtttcctcagttgtctcaataatgtgctttatagctatttttcccctgtccagaatcatactttgttggtttatttttcttttctttctttctttctttttttttttttttgagatgaagtctcgctctatggcccaggctggagtgcagtggtgcgatctcggctcactgcaacctccacccaccaagttccagcgattctcctgcctcagcctcccgagtagctgggattacaggcatgcaccaccatgcccagctaactttttattattagtagagacggggtttcaccatgttggccaggctggtctcgatctcctgacctcaggtgatccatacacctcagtctctgaaagtgctgggattataggcttgagccaccgcacctggccatttacctttattcttataatcatttccctactgcttagatttcctcatcagatctataattcattatattgaaagcctttcttttttaccttgaggcactagaggcgtctcttaattacctattaacagtcaacccttaaaaattagctctagttgtttaacatatattcacagttatttagcatgaacaaacagttcagcattggcagaggagagctgttgtgtataactaagagtatttcttcttttattttcccgaagaccatcagttttttaagtcaaattaagtcaaaggtcagtttactaagaaactaaatagtcatctctttgtcaaaacagaccttttttcttatttctggaaaggtgatgtggaggatcatcaagtcattgtatcttaatttttttacaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggtacatttttttcctcttgtttattagtgtagtcatctcctgtaggaattccccggatcaaatctagtctggtgtttgactgtgatttgcatatatagttggtatgaggctaaaaagacttgtattttctcatttaattgtatgtaacttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgtgcatctgttaaccgtttttaatgcatatagccacatatacgtatttatcatcttttaaactttatacagaaaggtcatacaatgatcaatctttgttaccttgcttttttattttattaagtgaattttcctgtcaggaaatgcagatctgcctcattgtttttaatggctgtattatactctatagtgtgagtgtttgtttttttttgacttttgcagtatatactcaacatccttatcagtttttgcaagtctgtctctacattaaatgcctatcaatgcaattgctaagtcaaaggatgcatgcagttaaattttgatgaatgctaccaatacccatatgatgaatattaccaatatacatgaggggttataccaatttatacctgcaccaaaagttatgagtgctcatttccccacattcttaccaacgctttatttttattttctcaatttaataggtgaaaaaatatttacttgatggtttgctttgcatttccttaattatgaataaggttgagcatctttttatatatgtattgaccatttgaatttcttttcctctaacctgtttgtatctatgacctatttttccacagagttgtttgtctttttcttattcatttgcatgagttctttatgaattgtctcacattaattttacacttaaaacgtggcagtttctaccattggtgttgccatttatttatttgttctttctcttttacctattacctattactgacctggcttccttacacccaaatcaaacagcagagaggatgaagctataaaaagctaggaaacaatgagggcccccagaacttttcggcttgctaaagatgtagactatagagcagatggagagcctccggtaactaaaggccctatactttgttactctttgccctgtactgagtagaaaacctgacttgactatggagttaaaaatttaatttgtaattatctactggaaagagcagagaatactgataagctttccatgttttctataaattttagagagtgggattaaaacaaagatttttttttattattgtttttgagacagagtctcactctgtcacccaggctggagtgcaatagcgcaatctcaactcactgcaacttccgtctcctgagttcaagtgattctcctacctcagcctccctagtagctgagattacaggtgtgcaccaccacacctggctaaatttttttgcacttttagtagagacagggtttcaccattttggccagcctggtccctctgcccacctcggcttcccagccggcttcttcagctgggattacaggcatgagccactgtgcctggtcaaaacaaagactttgaggctcttctgtaactttgaatgttatgtttgatgctctattcctttgtccttatcaaaatccactgtcaagtaggcaatatgtgacaattttattataaacatttagaattaactaggggtttttatcttgctaatgaatgaccttgcattatcagaacagtagaggaaatccttttgtttctgtttgttaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaagtaagctaattttctttgtagtaccaattatggggcagttatgaacagatggctaactttataaccctgaactgttatagaagaaacaaaaattggcatcataatttcatttcctcaagtcaataccctatgccttctgatcatttaaattagtcaagaatatttcccaactgtggtcattgacaccaccatagggtgatgaggtctagccttagctgatcatccatgatcattcttttgtcactacaactactccaaaccttttctatctttcacaagatcctgtgactctctcctttgtccctctgcaaattatcttattttttatatagaaaattatggttcttgggcatgtgttcttacatatttttgcccagaatcattccttttttcagggaaagcagtatccttcatcttgcctaatgaatcccttcatctagatcccaccctctcttgattcatcagggacctccctctttctgttaggtccccttgctgctttatttttcatctctttctgttttagcttcttttcttaaacatataaacatttcttccatcaaaatcactatattcccatctagattttgtcctttcccatctatattcccatatagattctgtctttttcttttatatccaagttctagaaatggtaatctaggtttgttgaattcacttactccacagtcatgcctcagttcattgcagtctggcttctcccccatccatactactgaatccgttctttctaagttaactgatgaccattgacctcactgctctctccagtggtcacttttcagtcctcatcctgcaagacctcattaagatatttgacaatgttgaccatcccttccttcctaaaggatgattccatgaccctgctttgtctagattctcctctcacctccctggctgttcctttttttttttttttgagaaggagtcttgctctgtcacccaggctggagtgcagtggtgcaatctcagctcactgcaacctctgcctcctgggttcaagcaattctcctgcctcagcccccaggaagctgggattacaggtgtgcgcagccatgcctggctaattttttgtatttttagtagagatggggtttcaccatgttagccaggatggtctcaaactcctgacctcaagtgatccacccacctcagcctctcaaagtgctgggattacaggtgtgagccactgcacccctggctgttccttttaattgtcctttggttcctcatttctcttgctttcaaatgtcgtatgtcgtcagggttttgttctttgtctttttctcattttataatacatactctctctgtacaatcttattcatgctcatcacttagtctaccacccacagacttccactaccgctctaaaatccatatctttagctaagtcctgtttccttggctccatgccgatctatctatctgcccccaaaacatgatctacccacctaagtgttccaacacctccctcccgatttgtgcctgagtgattttgctaacatggaaatctagtcgtgtcactctctaaccagtaccttttattacagtgttttataagctgtttttgagccatagacctttggaggaatatgatgaaagctatgggcccacccctcagaaaatttttgtttcaagagatgcacatgtatcctgaaacccatccacgggtctctgttaaggatcccagctttaatgggtctctctctcctatgggacaaagtccagtctctctggactttgttttagatctgttccccatgatatgtctcctgcctccctgcatcactcatcttctttttccactaccgcatatgtactccatgttccatccctacctaactacttacagttcttccttacggtgtgtcatttccttattagatcatttcatttaccattttctctatgtaatgttcttgttcacaaatggcatctatctcgtgaacttacgcttatctttcaagacccagcttatatctctctcttcagtgacaccctcattgactgacatatattgacagaggtatttgctcttcttcctgaatcataactgtacttaatctctgttactgtactaggacagtgtatgataattatatatttacctgcctgtttctactagtctgtgacttctttattatttgtctatgaacttctagtatcaagcacagtgacaaataggaaattcatttgacagcttttattgagcacctactgtgtgtcatgcactgttcaaggcactaaagaatcggcagtaaacaagataaactaagttcttatttcatggagcttacattcttggtggaagaacacaagagagtgagcaaataagaaaatacaataattccaatggagatagtgctgtggaggaaaattaagtggggcaaggggcataggggtgctgggagtagtgggttctgtttcatatagggtgatcagggtaggcctcactgagaaggtagtgtttgaacgaagatctgaggggatgagagaaaaagctatgtggatttctgtggcaaacacgttctaggcaggagaaatagtaagtaccaaagcctttagtcaggagtgtgcttgacttgtttgaggaatggcaaggagaacagtgtggcaagcgcagagtaaatggatgggcaaggggtataagacaaggtcagagaggtggtttgggactagatatgtaaggacaaaaccaatatgacagttttgagtagaggagggacaaaatctgacttaacattttaaaagtaaaccgggcgcggtgactcacgcctgtaatcccagcactttgggaggctgaggcgggtggatcacttcaggtcaggagttcgagaccagcctggccaacatggtgaaaccctgtgtctactaaaaatacagaaattagtcgggcgtggtagcaggcacctgtaatcccagctactcgggaggctgaggcaggagagaatcttgcggggattcggggcaagggcagaagcagggagatgagttggtggacattgtcataatcgaggtgaaacataatggtagcttggaccagtatagcagaggttgtaagaaatgatagaattctagatgtgtcttaaaaggagagtcacagatttttctcatgggttggatatatatggcgtatgagacaaacaggagtcaagaattatgccaaggtttgtggcctaagcagttagaaggatggagttatcatttaaataagatgggggatcccacaggagggacggtattgggaaaaagatcaggagttcagttttgtacatgttaagtttgagtacctattagagatatcccaagtggtgatatcatataaatggaaatatgaagtaagcagttggctacataagtttggaattccaggaaacagactgaatcagagagatggatttgggagtcctctgcttatagatctgtggtgtctaggaaaatagccactaattatatgtgactctttaaattagttaatttacatttaatttaatttaaaattcatctttcagtcatactagccacatttcagtgctcaatagccacatctgtgtgttagtggctattgtattaaacatagcagatatagaacatttctaatatcacagaaagttctcttggactgcagtggtatagatggtatttaaagccatgagactggataagaaccccaaggagtgagagtagataaagggaaagagagagttaagtactgaatcctgcagcactataaattaagaagttagggagatgaggagggatgggcaaagaaggccaagaagtggccaattaggaggtaacccctaagaatgtggtatcctagaagccaaatgaagaacgtatttccaggagggagtgaacagctgtgttaaattctgctaataggacaagtaagatgaggaatgagaattaactattaggattattaaagtaaaggtcactggctgtaataattcactggagtattagagtcaaaagcataaagcttttgactaccccaataaatggggtaggttcacaagaacatgggaagatatgaattggagacagccaatagagatacttttggaaagttttgctatgtacagaagcagataaatgtggtagctagagaggtgggtgagatcaagaaaggttttttttttttttttttttttttttaagataggacaatgtacagcagagaaaagttgtgcaggagtgggcggggagaattgttgggttggagagatgttctagaataggcaaaggagcgggggtgtctagtgcacaagtagaaaggttggccttaaattaggagcagaatcagtttataataacagaagggaagctagatacacagacacaggaggcacaggtagttgagtggatgcggcaatgagagctgtggaagttcttttctgattgcttctattttctttctgaagtaggaagcagagtcatcatatggtattaggatggggcaggagaagttggagatttgaagggagatgagaaggtatgaaatagccacctagaagaaatggagaatgaatggactagggaaatatagttaagttgccagatagcactaagagcccacttaaagaaaatgagatgtcagcatgattgtacatgttcatctagccacattcagctactgatgcacagtaagtatttttaaatttgattgaatttttatggaaggtcaaagggaaagcctcaccaagaaagtaatatttgaactggctcttgaagaatgtgattgagtttgctgtctggagaggagggataaggacatttcagatgaaggcagcaatgtgtgcaaaggcccagaggcatggaagaacagagtatgttcttagaaaatttgaacatcactgttggaggctatgttctaggagcaatacaatgtagtgactgtgcaaggttagacaggaagaacttgcttcatggggttttataaagattaattgaacttactaaatgttatttctgtgcctactttcagatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatggtaaggttttccataagtatgctataactcaatgttttgttattgttttattaatttatttatttttgagagacctctgaactatgagggttattcaaaagcatcttgaatgcaaaatgaaaatgtcaacaacacatgattattactgattaatttaaaattctctcgcatttgcctgcctttgttactttcttccctagcctatgttttaaatgaaggctaatcaaggattttttaaaacctaaaaatagcaacagtaaaataatagcaaagtaaaataatattcgtaatcccatcatcctaacacaatgtcaggttttttttgtttgtttctttgttttgtttttgttcttgtttttgttttttttgagacggagtttctctcttgttgcccaaactggagtgcaatgatgtgattcggctcactgcaacctccgcctcctgggttcaagcgattctcctgcctcagcctcccaagtagctgggattacaggcgcgcaccaccatgcccggctaattgtttgtatttttagtggaaatggggtttcaccatcttggccaggctggtcttgaactcctgacctcaggtgatccacccacttcggcctcccaaagtgctgggattacaggcgtgagccaccatgcccagcccacaacgtcagttttaattttgtatattccattcctagttttcttgaaatgtgtgtgtgtttgcagaattacagtattagtacatataccattttttactgggtacattttatcgtaagtaaattttacctcaataaagttaaaatcacttgtacacatactattttattatgctttattttacttaatgctttctaatgttgctatataattttactataatactgcataatttatcaatcttacacactataatcattcccctcttgttggaaatttaggctattcctaatatttcactattgtaaatgacactacaataaatatctttgaggttgtatgtgctttattttgttatttcttagggtaaatttctagttgtgagattaattccactctacatttataatgtctgctaagtatgaaggcagtcttttactatggcctttttaggtctgggaagaagcagagaataccattttacttttgttttgtaaatagaataaaataataagatttatggtaatatttttcccactataaagtgcccattttgtctctctctgcccccccccccttaccttaaaaagaaaaaaagtattaatcttcagtttcatttgcctataaattagataaagtgtttgaggctgttggcaaatacctttctgaggaacaaaaagggtcttctaatatccagtaaggtctctctttttattttcctgtgattactttattagtaacccctacctcactctgaaattttcataaccaaatatggaggcttgttacagagtttgtagtataaagtctgtgtgggcttagagatattttaagttaagccatgccctgaacaactttacttgagaaaattcatttcattctgaaatttcaagtcaaaatgttattctcctttcagtatattccaagttcttttattttgtgctgcccctatattagatgagctgtgtggcttgatagccattgcagacacagtgaagcctgaagcagaactggctatccatattctgaaatctatgggcttagaagtagttctgatgactggagacaacagtaaaacagctagatctattgcttctcaggtaattgataggggtatgtgataacttctaattattgatatacattttatatcttgccttcaaatgctaagaaatttacattacctactattttcattatcactgagtagtcctatctggttccttcaagaaaatttaccatgctttgctggaaagactttgggctttgtgtgttgctgttatacgtaaaaaggtatttgcttagttcatgggatgcttgcgtgacactgtacaccaatttctgttgatgtgccctttgaaatgttgctcatattctttaccagtgctgccaacctaagctgggctctcctgatctcatgcctgaaacacagcaatagctccacacacatccctctctagtccatcctaaataccaccaccaatggaactattttcctaatgcaccactttgacataccatttttctgctcctgactcccacatctgccttatctctaaaatttttcaatctttttaactttggaatgccttctcccctcttctaataaataatgcaagtaatcttttaatacattcttttgtttcttttttttttcttgggacggagtttcgctcttgttgcccaggctgaagtgcagtggcgcgatctcggctcatcgcaacctccacctcctgggttcaagcgattctcttgcctcagcctcccgagtagctaggattacatgcatacaccaccacgcccggctaattttgtatttttagtagagacagggtttctccatgttggtcaagctggtcgtgaacttcggacctcaggtgatccgcccgcctcggcctcccaaagtgctgggattacacgtgtgagccaccgcacccggcctattaacaccttcttatgtaaaaaatacagaaggatataaagtaaaaatgtcctcttttccccatgctccccattcagtcctactgcccctcacactgccactttttcatatgcatatatgtgcatatacagagtacatatacagtataattctggtcttttcaacatcagatcattttgaacagattgttcagtagtttgctttttttacgtaacagtatactttggagcttcatccatatctgaacataaagttattttggccgggtttgttggctcacgcctgtaatcccagcactttgggaggctgaagtgggcagatcacatgaggtcgggagtttgagaccagcctggccagcatggtgaaaccttgtctctactaaaaatacaaaaattagccgggtgtggtggcgcatgcctgtaatcccagctactcaggaggctgaggcaggagaatcgcttgaaccaggaggcggaggttgcagtgagccgagatggtaccattgcactccagcctgggtgacagagcaagactctgtctcaaaaaaaaaaaaaaaaaaaagttacaaagttactttattctttctatactgaattccatggtatggatgtatcataatttatttaaccatttccctaatgatggacatttgggtggttttgaaaattttctttttgcaaacaaggcaataataaacatctttggacatgtatctttctgtacatgtgcaagcctgtccaagatagagctagacatggaattgctagaccaaatgatgctcacattttgatagatgctgccagatgccctccaaaaagagttacaatttacacaccagccactggtgtataagagagctcatttctccacatccttgctatcactagatattatcagtcttttaaaatgtggacatcttgtgggtgaaaactgatggcttgttattgctcagttatgtttcacgtactcattattttttaaatgaattgagtttattttcatcacataggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataagggtaagtgccatggcttgacctttgaggagtatgagactgccctatgtggtcaatgataatgtcataaagtatattgagcataacaattctgtcttaagttccatgctatcagccattaagagtttaagaatatggagtgggattatgggaagtcatgctaatttaccccctgactttctcaacccagctcataagcaagtgagaattataagtttctgaagtgaagaagaagatttaagaatggattcggaataaaatgatcttcaacaaatagttgctgagattattttaagtagatttaatcatagtaccagcatacacccctaaaagtgttttcagaaccctgaggaaaatttttgaaaaacaccttcggaagctgagtctaagttttagcattatctgagatttgtaattaattcacatattaccctaaggtagacgtaatcttcaacatacacagtatcaaatgtaaaagttactggttaagttagagtctcttactaatatcacaaatatttctgttcttagaatgatcttctggatgtagtggcaagtattgacttatcaagagagacagtcaagaggattcggataaattttgtctttgctctaatttataatctggttggaattcccatagctgctggtatgtgactcttaactagtactgctttttccactaaagttattagagacctaacatattggaagcctgtcttcttactattagttttgagcttagtttttgtttgtagcctactggtatggtgagaggtaatgttaaaatcaatcattttaattttcagtaatgtttgttatagcttaagaatatataagcattctgacagatttatttttttccctccaacttttttttttttttttttgagacagagtctcactctgttgcccaggctggagtgcagtcatacaatctcggctcactgcagcctccatctcctgggttcaagcagttctcctgcctcagcctcctgagtaactgggactataggtgcccgccacaacgcccaactaatttttgtatttttagtatagacggggttctccatgttggccaggctggtctcgaactcctgacttcaggtaatccacccacctcggcctcccaaagtgttgggattacagctgtgagccaccactcccagccttcaactttgtattttgaaaaatttcaaacttgacacctgtaatcccagcactttgggaggctgaggtgggcggatcacctgaggttgggagttcaagaccagcctgaccaacatggagaaaccccgtctctactaaaaatacaaaattagccgggcgtggtggcacatgcatgtaatcccagctactcgggagacggaggcagtagactcgcttgaacccaagaggtggaggttgtggtgagccaagatcgcgccatcgcacttcagcctgggcaacaagagcgaaactccgtctccaaaaaaaaaaaaaaaaaaaattcatacctccaaaaacattgaaaaaaatggtacaataaaaatctgtatgcctttcacctaaactcaccaactgatggtattttgccacattgcttcatctctttctgcatatatttgcacagagatatgtatttgtttgcttattaatttttttctaaatagatttacctttaatctgactacccaaacccaacactgtttgcaagattaattcatggagcaaatgatttttaaagaattatacaagtattttcctctagtcttttttttactctacatcagtttttgtcttgttacatagttgtgattgtagcttatggagaattttctgctcttcacttaatattctattatagtcagctggtattttttttaggttgagagaccagatgacagagagagtgaacaaagcaatataactgagaaaaaagaatttagagttatttaataagcatctgagaatctcctaaacttagggacctggtaggagttagtaatgatgacataaaagaaataagtattgttttcttcttgttctctctggtttgagggccaaggaaagacaagaaatgacatgagaacaattacaaaactgtttatcagcaaggacacacaaatactgagagaacaaagaacaaaagaacaatctaagtccagtaagattaattcatggagcaagtgatttttaaataattatacaagtaatatatgatcaccatagaaaaagtagaaaaatataaagaagcacataaaaagttaaaagtatgagtctatttcatcctcatcatgtgagcaaacattcttatgtctgtgaaaaccaagtgtggatgagtttgtagaacatgaactcccatacgctattggttggattttgaatcactacagccactttggagaacagctgaggaatatccacgtaaagttgaagatgtgcccatgttatgacccagtagtttcacccctaggtatataccccacagaaactctcaaacatggacacggggagacatgtacaagaatgttaacagcaacactctgttagtgaaaaaaatggcaacaacaaaaatctctaccaccaagaggataaatgctgaagaagtatcaaacaaagaaatgatttgtatgtatgttagaaacacattaataatctgtttagtattatctactctaactaatccatacttgtttcttaggagtttttatgcccattggtttggttttgcagccctggatgggatctgcagcaatggctgcttcatctgtttctgtagtactttcttctct

SEQ ID NO: 4751 - DNA, 1677 bp, human
atggccgcctacaaactggtgctgatccggcacggcgagagcacatggaacctggagaaccgcttcagctgctggtacgacgccgatctgagcccggcgggccacgaggaggcgaagcgcggcgggcaggcgctacgagatgctggctatgagtttgacatctgcctcacctcagtgcagaagagagtgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctatgagagtccgaaggatactattgccagagctctgcccttctggaatgaagaaatagttccccagatcaaggaggggaaacgtgtactgattgcagcccatggcaacagcctccagggcattgccaagcatgtggagggtctctctgaagaggctatcatggagctgaacctgccgactggtattcccatcgtctatgaattggacaagaacttgaagcctatcaagcccatgcagtttctgggggatgaagagacggtgtgcaaagccatagaagctgtggctgcccagggcaaggccaagaagtgaaggccagcggggaggatactgtccccaggagcaccctccctgctggtcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctgtggaaaagctccccttatccaacagagtttaaaagtagtgacttgggtttttgtgagtgctttgtttactaaggactttggggaggaacatgctaagccacgaccaatgaggagaagcaacagagcctgtctgtccccatgagcagagtctgtcctctgctcttctgcagtcaggccactgcctgggggctctagtcattccagtggaagatgaatgtaatctgcatggtgatgtgacaactgtttcctccttgaccccagaggatctggctctaggttgggatcaatcctgaatttcgttatgtgttatatttacttttattaaaaaagtatagtatatattaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtgtctttcactgatttctgaatcatgttctagttgcttgaccctgccacatgggcccagtgttcatctgagcataactgtactaaatccttttaccagatcagtataataaaggagtgatgtgcaa

SEQ ID NO: 4752 - DNA, 47151 bp, human
gaaatgtgaatcaaaaccacaatgagataccacttcacacctgctaggatgggtagaataaaaaagataataggtatcggaggtggaacaattggggcccttatatactgctcatgggagtataaatggtacagtcactttggaaaacagtctggcagatcctcaaacaattaaacatagagttattatatgacccagcaagtctactcttaggtattaccaaagagaaatgaaaacacaaaagtttgtacatgaatgtttatagcagcattattcataatagccaaaagatggaaacaacccaaatgttcatcaactgacaaatagataaattatggtgtatctatgcagtggaatattattcagccataaaagggaatgatgtactgatatgtgctgtaacatggatgaacactgaaaacatgctacatgaaagaagtcagtcacaaaagaccacatattacatgatttcattcatctgaaatgtccagaagaggaaaatctatacaagcaaagtagattagtggttgcccaggacagaaggcttaggaggtgatgactgataggtaaggggtatgttttgttgttgttgttgttgtttttaggtgatgaaaatgttctgaaattgcctgtggtgatggttgcacatgtctgtgaatatgctaacaactattgaattctacactttaaatgtgcgaattatataatacgtgaactacatctcaagaatgttttaaaactggtgttgggaaaacaggacatccacatgtaaaacaatgtatgtcagatccttaccatacaccatgtacaacaattaactcaaaatggattaaagacctaaatataagagccaaaactacaaaaactcttagaagaaaacatagcagtaaatattcgtaagtttgaatgtggcaatggtttcttagatatgacacaaaaaacacaaaagaaaaaagataaattggacttcacaaattaaaagcttttgtgattcaatggacaccatcaagaaagtgaaaagaatggaataccgatacattttacacatcaatgtaccttgaaaacattatgctaagtgaaagaatccagacacacaaggacacatattgaatgaatcaatttatatgaaatggccgtataggcaaatccgtagagataggaaataaaattagtgtttgccaggggctgtgagtagagaggaaatggggagtgttgctaatggacatgggatttctttttggagtaatgaaaatgttttgcaactacatagtcattatggttgcacatccttgtgaatgtactaaaaagtactgaactggataccttaaaaggctgaatttttttcatttcttctaaaaaaaaccaggatagatgtgcagaacgtgcaggtttgttacgtaggtacatgtgtgctatggtggtttgctgcatctattgacccatcctttaagtttcctcccctcacccctcaccccccagcaggctccggtgtgtgatgttcccctccctgtgtccatgtgttctcattgttcaactcccatttatgaacaagaacatgcagcatttggttctctgttcctgtgttagtctgctgaggatgatggtttccagcttcattcatatccctgcaaaggacatgatctcattcctttgtatggctgcatagtattccatggtgtatatgtaccacattttctttctccagtctatcattgatgggcatttgggttggttccaagtctttgctattgtaaatagtgctgcagtaaacatacgtgtgcatgtgtctttatagtagaatgatttatattcctctgggtatgtacccagtaatggggttgctgggtcaaatggtatttctggttctagatcctcgaggaatcgccatactgtcttccacaatagttgaactaattcacattcccaccaacagtgtaaaagcgttcctatttccccacagcctcaccagcatctattgtttcctgagtttttaataattgctattctgactggtgtgagatggtatctcattgtggttttgatttgcatttctctgatgatctgtgatgttgagctttttttcatatgtttgttggccgcataaatgtcttcttttgagaaatgtctattcatatcctttgcccactttttgatggggttgtttttttcttgtaaattgtttaagttccttgtagattctggatattagacctttgtcagatgggtagattgcaaaatgttttctcccattctgtaggttaaaaggctgaattttatagcatgtgaattatatcccaatttaaaaaagaatgcatatgtcttagttcaggcttccataacataataccatagactgggtggtctaattgttcaaagctccacagaaattagttggagaagttacaagagtccattaatcatcttgctttgttagtagcagcgggcatggttcagcattttctgcttaagtttctctgagctcaccaaaactaaaatgatgttgtaatactttttttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcactctcttctgcactgaggtgaggcagatgtcaaactcatagccagcatctcgtagcgcctgcccgccgcgcttcgcctcctcgtggcccgccgggctcagatcggcgtcgtaccagcagctgaagcggttctccaggttccatgtgctctcgccgtgccggatcagcaccagtttgtaggcggccatggcggtgggctgcaatactttttataccatttgaagtaaaaggtacaaaaggttatacgctgaaaattctttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctattggcgggaggccttaggtctttgctggtttttgacatgaggcctcagttcctcaccatatgaacctctccataaggctgcttgtatgtcttcatacttggtaggtggcttcccccagattgcgtgattcaggagagaggacaacaaggaaaacacaatgcttttttctcctcttgcaatgttttttatgacctagtcttggaagtcacaccttgtcgcttctaccgtagtctattcattagaaacaagtcattaggccaggtgtggtggctcatgcctgtaatcccagcactttgggagggcgaggcgggtggatcacttgaggtcaggtgttcgagaccagcctagtcaacatggtgaaaccttgtctctacttaaaatacaaaaaattagccgggtgtggtggcatgcgcccgtaatctcaggtactggggaggctgatgcaggagaatcacttcaacccgggaggcggaagttgcagtgaactgagatcgtgccacagcactccagcctgcgagacagaattgagtctcaaaaacaaaaacaaaaacaaaaaccaaaacaacaacaacaacaaaaaacaagaaacaagtcattaagttcaggccacaccgaaggggaaaggattaaattccacctcttgaaggaaggagtagcaaagaatttgtgggcgtattttaaaaccaccacaggaaggcagacaataagcaataaacagaataaatcagcaagttatggagtatgttagaaggtggtacgttctatgaaaacaaaagaaaaagcagaggtaaggggaatcagagtatgtttgtgtggaagggatgtaggttgcagttttaaatagggtggtcagcatagtcctcattaaggttagatttgaacaaagacttggagacaaagaagttagccaagcagttatctggaagaagaaagtcccaaagcaagagaatagctaaaataaggccttgaagtaggagtcatccttgcatgcgtaacagccaggaggccagtatgactggcacagagaagggtttggtgagtggtagaagaggaggccaggtaaacttgagggggacaggcatgggaaatcatgtgggaccttgttggctgttgtaaggatttgaggcatttttgattagttcttaattcgtacttacaaatgttaaatgagattatgtatgggaaacattagtaatcaggaaagcactctatgaaagctagttacttgtattaaagtattgaaatttttatttttagttagcatatccatagaaacaactttcctttacttcatctaaggtgataagaattttttttctaagcaggaagaatgcttaccatattttattactagcacattttaattttttaaacatgacacttgagcatatataaaatgtagcatatttttaattggggaggtgggggaaaagttgaggaaagattatttgcatggctgaaattaatgaatttattgtttctaacaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaagttactctttggaaactgaagtcaaatgccattgaagagaattctactagaaattacttctaacaatgagatagaagcagacacactgacacatttggcaataaaaactattgtacttcttatcttgaagctaaataagttttctttgacccattaattcctctcataaagaaaaaagatatattttcaatttaaaaacatctgaacatggaatcttgatattgtggttgtatatttatagatttatattttataagtatatgagtatttatatactgtttattactctgaatctcatactgaactaaaatgtatgttttcaggggatgggttagggttttctttttcttttataacatggtgattattttgcaattaaaacttgaagggaaaatgtctagagaattactagtatactttggtttttatttttagtttttttttcagacagggtcttgctctgtcacccaggctgcattgcagtggcaaaatcacagctcactgcagcctagatttcccaggctcaagcaatcctcccatctcggcctcccaagtacctaggaccacaggcgtgcaccaccatgctagctaattttttttttttaagatggagttttgctcttgctgcccaggctggagtgcagtggcacgatctcagctcaccacaacctccacctcccggttcaagcaattctcctgcctcagccttccgagtagctgggattacaggcatgcgccatcactcccagctaattttgtatttttagtagagacagggtttctccatgttggtcaggctggtcttgaactcctgacctcaggtgatctgcccacctcagccttccaaactgttgggattacaggcatgagccactgtgcccggctgcatgccagctaattttttaatttattttttgtagcgatgggggtctcactatgttgtccaggctgatctcaaactcctggactcaagtgatcctcccacctgggcctcccagagtgcggggattacaggtgtgagccaccatgcccagccaaaattactagtacaccttgtatgatatgcctaaggaagactctattattggttttttgtttgtttgtttttcagactctagggctttaagttgaagactctattgttgtttaacattacttgagcatcaacagcattctagatatactgtggttaaagatgtagttcaggttataaaaaagccttctgaatactgcatgaagtacctgtggttatcataagaaacttcatgcatatatggcagggattggaaaatggtgatctgcaggccaaacccagtttgccaactgctttcatatggctcataagctaagaatgccttttacatttttacaccattgaaaaaaattaaaaaaatatttaggaacttatgaaaagcacatgaaattcaaatttttgtgtctgtaagtaaagttttagtaatatacagttttattagaacacagccacactcattcatttacgtattgtgtacagcccttttttcactacaagagagttgaatagttgtgacagagcccatacgtggtgtcctcattggtaagtgatacactgccaaatgatttaccacagtggaaataccattttatcttcccaccagcagtgtttgtgttccactttgaaagtgttccattttctccacattccctccaacaatttgtattgtcagtcttttaaattatagacattctaatgggtgtgtaatattacatcactaattctcatttccttaatggctaatgatattgagcatcttttcatgtgtttattaggcatttgtataccttctttggtgaaatgtgtgttaaaccctttggccaaatttttagttgggttttttgttttgttgttattgaatttcttctttttcaaaattgttttggttagtctaggcccttttactttccatataaattttagaatcagtttataagtttctacaaaaatatctgctgggattttcgttgagattgtgttgattctacagatccatttggacagaagtaacatcttaccaatattgagttttccaatccatgcacatagtatatgtctatttatgttggtattctttgatttcttttatcaggaatcaatagttttcagcatgcagtttctgtacatattttgttagatttatatttaagtactttatgtttttgaatgctgttataaatggtactgtttttaaattttaaatttaagtttaatttcaggtgttcattatgaggtttttatatgttgactttgtatcctggaacgtagccaaactgacttatcaaacctattagcttttttgtacatttcttgggattttctatgtaattatgtcatcaaggtatatagtttttttttttttttaagatagtctcactctgtgacccaggctggagtacagtggcacaatgttggctcactgcaacgtccacctcctgggttcaagcaattctcatgcctcagtcacccaagtagctgggattacaggcacatgccaccacacctggctaatttttgtatttttagtagagttggggtttcgccgtgttggccagggtggtcttgaactccagaccttgagtgatccgtccacctcggcctcttaaagtgctgggattgcaggtgtgagccactgcacctggccacatagttttatttattcctttgtagtctgtatatcttttttttttcccttgtattatcaaaccttcattacaattttgattgggagtggtgagagtgaacgatggttgggggaaacattcagtcatttacagttagcattgtgttagttgtagagttttgtaaatactatttatcagattaattaagttatttctattactagtttgctgagggtttttttaaacatcatgaatggatgttgaattttgtcaagtgctttttctgcatatagagatgatcatatggtttttctcctttagtctgttaagatggtgaattacactgattgattttcaaatgttgagccagccatgcattcccagggtaagcctcacttggtccaagaagacttactttccattaaaaatttcaaacatacacaaaggtggagaaactatttttttttattatactttaagttttagggtacatgtgcacattgtgcaggttagttacatatgtatacatgtgccgtgctggtgcgctgcaccactaactcgtcatctagcaactattaatagtacaagaatctaccctatacccatcacctagaaaaatccttgctatttatttgcatgccattctcatcagttgaattttataatgtgttttgctgatgattctaagagttggtccaggccttcctgcctattgtattctgttaaggtagatgtctctgactagtggattggaacttcctagtatatctccataccagttgccatttctaagccttttggccaccccctgccaccacccctgcccgcccctttcccttgtcactcttcgcaattctcagcactaattgtagtgtatataatttcagtactctttcccatgctttatttagtttgtttttgaacatatttttttctcatttctctccaacttgtatctcaggatccaaagaattaacaatatctcatgccaaaagcttgaggattcctactgtattgacaataacatacagaagctttgcttaaatattatgcttactttttttttttttttttttttttttttagatggaatctcactctgtcgcccaggctggagtgcagtggtgccatctcagctcactgcaacctctggctcctgggttcaagcaattatcatgactcagcctcccaagtagctgggactacaggtgcacgtcaccattcctgggtaattttttgtacttttagtagaaacggggtttcaccatgttggccaggctggcctggaactcctgacctcaggtgatccgcccgcctcggcctcccacagtattgggattacaggcatgagccaccacgcccagcctgaattgcttacccttaaacatgtttatttttactgccaggccttaatgagtcagtaatggatatgtcattttagctgagttgtattctcatttgtgtaatatacttatcattttaatgttatcttatcattaaaacaaccttatattggtggtaattctatttgctggaggttctctgtaattttgcttttatgcaatgttcattacagtaatggcgggaagttaatgccactttggaatttgatcagcttgcatcactaccagaatggttttcctatgactagttgagatccacatgcaatacattttttgacatactaccaggagcagatgttaatatcataatgaaagctttgtccaactggacatcagatttagcacaaaattcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatctgaggtggggctggtgttgagggccagaacagaagctgaaccttactaattatatagtagtgtctgtgctaattgcagtaaagctgttttaaccatttggaaactagttcatgtaattttttgccaaatgacttaggtacttattgtccactgacagctaaagtattttccaaaaccctcaactctctgtctagcaaactattgtaggtgaatatttgtctctgccaacatatccatgtataactataaaactagattctgctttgatgtttgcaaatacattcttgcttcccaaaacagcctgtttgcatcacactcatatgtaagatggctatttccgctgcatcttcccaaagttcaccactgcttaataaggtctgtttaaggtcaaacaaatgcaattgaattttgattacactgaaaatgaagaatagcagcaatataatgtgaaagcactttgtgttgtcaacagtgatttatacaaattccagtgacagatactcaagactactttccagggcacattcataatttgattgctaaaaataaaagaaaacacacttgttctgcctttttcagctctgcttctcctctttcagtcaaaagcccttatgttagtaacctttattcttttttaaaaaaatattttactaagtgtgaagtgttctggggccagagagagattttctgtgaagttaatgaagcttaagtttcagagctcctcatttgcagtgaccttcttctaagactctggaaggagtatcagcaatgtgtttatatggtcatgtgtttttgtacaatttgaaaaattaaaaaaaaatttaaccacaacccttcaaggccattgtccatttctacttcaatgactcttctgttagacctcccctttgtgttagtgtgatattggaatggccatgagctttttggggatgtgactaaggggaggttgagttggggatatgtttagtttggggttagtaggctatttggctataggtggttctttgtcacttctgtgtatagtggagtttttgctaggaattctgatatagggatggcttcttggaacacccctactactcatggggccaactcactaagcatcatgacatgaagatgcagggctcagtgtaaaactggtaaatgaatgttaccagttcaaagaatatgtaagattagtcacttcacaagtaaatttgaaatgccctgaaatcttacagctcatatatgaaagaaactcaacagttttctcaaatttgacagtagctttaaaaatgtatcaatgcctagttgttatgttgaaaggaacttttctaaactatcattaattttaaaaatttttatctagagaaaagactgaactatttttattttctttatatacaagtgattttataaagtcgtcaaatgaagcactaaagaatatacagccaaaaacataggaaaagaaactatcagagaggtatatcaggcattattaataaaaatgttattgttatggatttttatgatatttgttagctttaaaaatttataacttgtgatttaaatttttttaaattttattttgagacggaatcttgctctgtcatctgtactggaatgcgatggtgcgatctcggctcactgcaaccttcgcctcctgggttcaagtgattctcctgtctcagcctcccgagtagctggcattacaggcacgtggcatcatgcccggctaatttttgtatttttagtagagacagggtttcaccatgttggccaggctagtttcaaactcctgacctcagatgatccgccccccttcaccttccaaagtgctgggattacaggtgtgagccactgcacccggccatataacttatgatttttgttatgcgctcagaatattttcttttgtacaaaattttgtgtttatggttttttattcctttttttaaagaaggcccttcaaattgtttaagtttcagacaccacaaagtgtgaattcacctctttctagacatcatatagaaagctgtctttgcccaaacataatttatagtcagaatgtagttcaacatgatcatacataaatattgattactttttaaagaatgttaaagcttaaaatttctgcaaataattaatgggaactaggcttaatacctgggtgacagaataatctgtacaacaaacccctatgacacaagtttacctatatcacaaacctgcacatatacccctgaacttaaaagaaaagttaaaaaagaaatgtacacaaaaaagaatatttctgaatcataacttctaggattataattaagcctcaggtgcagttaatttagaaatcagatttggggagaagagtgtttcaactaagtcaaggagctcttggtagtgtttggaatgaagtaatataattgtgatattaaattgagtaaagttgttttattggaaaatgcaacagcagaacagattaattaacagaattcaaaaagagtgaatagtcaggaaatctctaattttggaataaatagaatatgactatttgcctttgcaactttagaatttaaatgcattttgggaattgtgtcctaagttatacagtaaataaatgtaattttcttgtttgtactgccagtgttaagactgtagactttaaagggattaacctgaagtttaatttaatcaccctggtggtctgttcaaaggaaaagtaaaataggcagataatgtgaagatctttctccggggttgtttggcctttttgaaagtggaagtataaaaacaaatttaattagatataagtactgaatgattccaaaggttaatgccttattaacaaattagtttgtccctgaaacttacaacactaactttttgagtgcttttcctttttaattagataaaggctatagtccattctcttaatagagactatcctttagaaaaatgaccacctcacggatcacgaggtcaggagttcgagaccagcctgaccaacatggtgaaaccctgtctgtacttgaaatacaaaaattagttgggcgtggtgtcgcgcacctgtaatcccagctactcaagaggccaaggcagaattgcttgaaccctggaggtggaggttgcagtgagccgagttcatgccactgcactccagcctgggcaacagagcgagactccaactcaaaaagtaaataaataaaataaaataaaaatgaccacatcaatgctagcagttactaaattcctcctttggatcaataaatacattccttactccccttacaattaattggtgtttttattattgaaaaagtaacacatacacagagtaaaattcctctcccaaggaaaaccagttgtcctatgtatatgtatccttccagaaagactattaatataaaacttttttttaaattattttttgagatggagtctcgctcttgtcacccaggctggagtgcagtggtgcgatctcggctcactgcaacctccgccacccgggttcaactgattctcctgcctcagcctcctgagtagctgggattacaggtgcctgtcaccatgcctggctaatttttgtacttttagtagagacgagttttgccatgttggccaggctggtctcgaactcctgaactcaggtgatccgcctgcctcggccttccaaagtgctgggcttacaggcatgagccaccgtgcccagccaaagctatttacatgtacataagtatatatacttgatgtgtgtgtgtccactttttctaaaaatggaagcatactatgcacatcattctgcaccttgcttttttttaaattagcaaatatatcttagatattgttccacatcaatatacagagccccatctaatatttttctttctatatgggactctttttttggcttcttagctttttctggcaaatgacagtgcattgaatattctgtttttcaaactggtgctctgtcaccaatactatattagagtaacataggcatttttattattataaattagtaggtaataatcatttatccatgaagatgtcgagtcagcttcaaagaggattaggtttctgatttagctgaactctattctgaggaccaaaggaaggtcaaatccaagataaaaaatttagcagtgaaggaatggtgtaaagagggactttcactatttcttttgtatatttttgtgtttaaatttttatagcgaacaatcatacatttgtcatataatgtttgaagcaaagtgaaaatacattagaaatggccaggcatagtggttcatgctgtaatcccagtactttgggaggccaaggtgggaggattgcttgagaccaggagtttgagaacagcttgggcaacatagcaagaccttgtcttttaaaaagaaagagagaaagagagagagagaatgagaatatattagaaatgagaattctgacaaagtactcagtttaaagatggtttagttcatgaaaaacaatgctacaatgtaataaaaactaacagaatgtctgcatctttttcatcttaaaacatttgatttttgaatttttagattgattttggactattatttagtgtctaaggattgtctttttctagtttataatctgatataatagttttaaagtgataacctttatttaggttactcaaataggataaatgttcatggagcttgatggcttcctcttacaatattttaattttcaatattctatattgaagcatcaaatagagtgttaccctattaatgtaaatacattatatttttcagcaaaccataatggaatttgtattgagactgtatgtattataagtgatgatctttttgtatattataaataatttttagttgattcaaaaatatattatgggtggtgaatcaaacatattagaaattcaggataattgattaatcatgtcacttttctgacttcagtctccacatctgtaaaataacagaatcctttcaagctgtgaaaaatctcttataacctttatgttgagttgttatatgaaaatgtaagaaagtaagctttaaactgtctgaagattcccacactgagcagcatgctaacctgaatttattatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaacaaacaattaaaatttggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctcaaaggccccctgccaatattattaccttgggaattagcatttcagcacatgaatttttgagggacctttccctatcaaataagaaagaatacagaagagaaaacatgtactgatgacaacctaagaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccacaaaaattaaaagaatcgatctttacaatctctgtgacagtcagcactctacaccaccattaatactatgaaggccacagagtacgtttggtatattttccttttttctctcccactactgccttcatcaaaatacagtgaatagtcctccatcttcagtctttcctatgagctatatttataatttgtaggctgttacatttattttcagaggaacttttttttttttccgagacggagtttcactctcttgtccaggctggagtgcagtggcacgacctccgcctcccgggttcaagcgattcttgtgcctcagcctcttgagtagctgggattacaggcgcccgccaccatgcccagataatttttacatttttagtagagacggggtttcaccatgttggccaggctggtctcgaactcctggccttaagtgatacacccacctcggcctcccaaagtgctgggattacaggcatgagccaccactccggcccagaggaacgattgatataatggaaaaatagttcctctgaaaataaaaataacaacattggttcctaataaaagattaagagaaaaagacaagctgtcgaaatattggagcaatgtggggaatgaggaaggtggggtagggcagagaagggaagttatttttggagcaggggttggggttagaggacatatgaaaggagagcagcacagacccggaatcagactgccgccagcactttccagctctatggagtctgcctggttttgctcatcactgtatctctagcagctagcatagtgccgggcacataatggacattcaataaatatttgttgaatacataagtacctttttttttttttgaggcgaagtcttgttttgccgcccagcctggagtgcagtggtgcaatgtcggctcactgcaacctccacctcccgaggttcttcaagtgattcttcaagtggttcttcaagtggttcttcaagtgattctcctgcctcagcctcccgagtagctgggattacaggcacccaccaccacggccagctaatttttgtatttttggtagagacgggttttcctgcattggctaggctggcctcaaactgtgacctcaagtgatccgcacacctcagcctcccaaagtgctgggattacaggtgtgagccaccacgcccagccaataagtaccattttgacttcctgcccaaagatttagcacccagagctgtactgtgaatttgtttcctttgagaccttaggtttgaaaagtctctttgctatctaacattcagaggcaaagttgagtgctgttaccccaaagagggatacttttgtttgtgctgagtgtggttggtcagcttttaaaacagaaatagaatttactaaaggaagtgttttctcatctgcagcatgcaaatagcgtagggtactttgacttctcttttgtgtagtattttatgcatagttttcttatgccttttataaataaaagataggctaaagcagttagaaagtatagcaaaccatccagtgacaaagtgatttttttttttgagacagtgtcactctgtcacccaggctggagtgcagtggcacgactttggctcactgcagccttgaccttcaggctcaggcaatcctcccacctcagccccttgagcagctgggactacaggagtgtgtcaccatgcctgggtaatttttgtattttttgtggagacagggttccaccatgttgcccagactggtctggaattcctgagctcaagctatctgcccaaccacctcagcatcccaaagtgctaggattacaggcgtgtgccacctggcctgaggaagtgatttttgcttttaaaatgagaacaatttctgattggctatgttggtaaattgacatttttggggggggtgggtgcgggggaaccaggtcttgtttaagatgtaccggatacaacgtatttaaagggcaagaatcctttacgttggtactttatcagaaaaagtatagtagtacctagagcaataccacccaagaatggtctgtgatgatggaaatactgtgtatccgccctgtctggtaggactaaccacattggccaatgaacacttgaaatgtggctagtgcaaccgaggaactgaatttttaatcttatttaatagttttttttgttttaaaaaataatcatctagtaaaatagactttttttgggtatatagttctatgaaatttttttttagttttgtgaatgttaacacatgtatagatttgtttaacaccaacacaaccaggacatagcgcagccctgttacccctaaaaaactccctcttgctaccattttccctacctctaacccctggaaaccactgttctgttctccatcttcccctttagttggaaagtttaaattatttacagtcattttcttaaccctaaaatcacctcaggggagggaaattaaagtttaaaagaggccttctttaaaaacacaaggacacaaaagccttcatttgatggtggctactcttatattgcatgtctttcaatactatatgtctcaactatacgtggtttgactattctgcatttttttttcatggaaaatgttatatagtattatccaaaaccaaatataatttatttccccacttctgttttggatcatttatgctagtgatttcctccatccctaagaaccagctagccaactagaattatcagagtcttagaaactttccatgccatgggtacatttcacattttcacccaaatacacagtcatcaattatcaagctaaaggaagaaataaaaatatgttcattaaaataagtgaaagatttaactattgtagacaatttaaagagagattttctatgctgaattacttttaattataattttgagtttttattttatagagcaaagcttttcactagaaattaataacacctatatttaactgcttttttgaatattaatatcctatggccatctcaaaaatcaataggtccagcactgaatttatcatctctcctttccctccactttaacctcttaatttcctcctgatttcctcctctctttctgatatcagttaatgacgccaccatctatctatccactggcccaagccagatacctttaagtcatcctagtcgtctcctttatcctatacatcttgttaggaggccctaccctcctgaatgtatcttggagctgcctcttttatctttgcccccagtattcatgtcttaattcagaccctctattgcactacttttgcaattgcagtagcctcctagctgatagtcctccctcctgtatcactccaccctactacactatcatcttccacactgcctccagaatgatccttctctaaaatgaaaatctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaaattaagaaaatatgatgacaagaatgagagagaaacaattatttgtggttattgatttagaaaacagaatgttttctgaagtagcccaggaataactgaattaattatatttctttttattaactagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcaggtaattatcattttttctttgattaccctaatgttcttttacttccattttgctgcttcttttggcatttatcaatgagaaatgattcataggcactgtaattccacttttgcaaatatgtcctatggaggtagccagcagtatatacaaagatgcataaggatgtttgtataattgcttatgatatttaaaaactggaaacaataactcgtggtgcaacaataaataactcatgatgaaatgctatgaagtcataaaacattatggtattaaagataattaatgccacaggaaggtgtctgaggtattttgttaaatgaaaaaaagctgaaaagctatatatacaatgtgatcaaaattttataaagaaatgtatctgaatttacgccatgtatatattgtttatgtatatgaataagattcctggtaggatatgaaccaaaattttaacagtgattatctttgggtggtaggataaatgtgatttttgtttccattgtgtttcctggttttataagttgtttttacaataagaatgtatgtatgtagctatgtatttatataatgggggaagccagtgctcttttaaaaacaaaagtagttgaaataaataataggattttaactataattttatatttaggcattcaaattaaactgactccagagctgtcccaaagttttcgtatttcctgacagctcttacctttgaactgaaacaaaaaatgtatattcaatggaatttaattatgtgaaattgttcttttgaaccagaattgaacctggccttgaattaaactggaaaatgcccaaatgaaattttttgcttgaaataacaattgaaacgttttacaaccaatttctggacaatataattaatctttgctatcctgattagaatgaaagatatcaaatagtagtattccctttttaggctcactaaatctgagtaaaaaattttactaaacacatgtctaaattgttatggtagattaatgtcagtgagagaggacttagagacataccattattaatttttagttcttaatttttctgttggtgacaaatggtagaaattatagaattctcactttttaaaattgacacatagttcacataccataaaatttgcccatttaaggtacacaacccagtggttgttagtatacttacagagttttccagccatcatcactatataattttagaactttttatcactcccaaaagaaatcacatatccattagcagtcattgcccatttctccttcccctccccaagctcctgataacaactgttctactttctgtctctgaatttgactattctagggacatcatttaagtggaatcatacaacatttgtccttttgtgcctgaattattttatttagcataatgttttcaaggtccatccatgttgtagtatgtattagaacatcattcctttttattgctgaatattattccattgtatggatatatcacatttttgttttttcattcaacagttgatgggaatttggattgtctccactctcttgcctattatgtataacactgctatgaacaatttgagttcaaatttttgtatgaacatatgtttttatttctcctgggtatatatctaggagtggaattgctgggtcacatggcagctaaactttttgagggactgccagactgtttttcaaagtagctgttccattttacattaccatctcaaattctcactctaatgtagaaaatctcaattttttgagatttttaaattagaatctggcctggtacggtagctcacaactgtaatcctagcacttttggaggctgaggcaggcagaccacttgaccccagaagttcgagaccagccttggtaacatgatgaaaccccgtccctacaaaaaatacaaaacatcagctgggcatggtgacacacacctgtagtcccagctactcagcgggctaaggtgggaggattgcttaagcccggaagtcaaggctgcagtgagccgtgatcgtgtcactgtactccagcctgggtaacagaacaagaccctgtctttaaaaaaatagattttagattagaatctaatctaaaaaattagattcttttttttttttttgagacggaatcttgttctgtcacccaggctagagtgcagtggcatgatctcagctcactgcaaccttggcctcccaggttcagacaattctcctgcctcagcctcctgagtagctgggattacaggcgcctgacaccatgcctggctaatttttgtatttttagtagagatggggtttcaccattttggtcaggctggtcttgaactcctgacctcgtgatccaccggcctttgcttcccaaagtgttgggattacaggcgtgagccaccatgcctggcctttagattcttttgctctaaaaaagagatacatagttctctattagaaaattcatacagaacactaaaatgttaaagggactctagtaccaaaagtctgaacgaagtgtaggaaatccataattgctgaaggaaataattatgaaaccagaagaaaaatttaagttggaaataagtgcagttatatcagggagccataaaaatgactaaaattggtttcagcaaaatttcattttacctatcaccacttaattttttttttctttttgagatggagtcttgctctttcacccaggctgaagtgcaatggcatgatctcggctcactgcaacctctgtgccccgggttcaagcaattctcctgcctcagcctcctgagtagctgggattacaggtgcacgccaccatgcccagctaatttttttgtatttttagtagagacagggtttcaccatgttggtcacgctggtcttgaactcctgacctcaggtgatctgcccgcctcggcctcccagaatgctgggattacaggcgtgagccactgtacctggcccacttacatttttttaaatttttgaaaatgacagtgtttgaaattatattgattcacatttcactacttcataatgttggattatttctcagagcttctattaaattaaaatactttgatatgcataatggattatgttgtcaataatgagcaccacataaattagttatatcagtatcaccaaaacaagttacttacattataatattcctatgcctcttacatataggaacacaattataatcatcttacatcacatatggtataaaactgaaatatttttcatgttcaaatgtggtatctgtcattacagtaagcaagggcatcataaactttcagattggattcaaaaacagaatttttttctattcacttgggtttatatttttgcaactcacatttttgcaagtgtggttcacagaccagcagcacctaggaccttgttagaaatcagactctggcccactgcagacccagtaaatcaaattctacattttaattttaatgagctctccaggtaatccatttgcacattaaagtttgagaacactgatctacataatgtgattcattgacctttaaattctaaattaaatctacattaactttgtttacataaacaagtccagaaatttgattgaaggcaataatatcagtcataacaacatttcgatcaacaatggaccacatagacgatggtggtcccgtaagattataatggagcatatatagaaacctcatataaggcatttgatattggcatagcagatcaagtaggagaaatgattgatattcattaatggtgctaggacatttggtgttccatctgaaaaaatatatataaatacaaatataaagagcatctagttttgtgtaagtacactctatgatgttcacacaatgatgaaattgcctaaagcatttttcagaacatatttccatcgtttaagtgactcatgactgtataatattaaatattataatttaaaatagctagcatttttttaggagaaaagccatataaatttatttgatcatagttttacatgacatgggagccttcagaatgaagacccaaagatacaggagaaactgcccatttttgtgcttagatttagcacaatatggatagctaaaatagctagcattttattattattattattattggagacagagttgcactctgttgcccaggctggagtgcaatggcgcaatctcggctcactgtaacctctgcctcccgggttcaagcaattctcctgcatcagcctcctgagttgctaggattacaggcgcatgccaccatgcccggctaatttttgtatttttagtagagacagggtttcgccttgttggccaggctggtcttgaactcctgacctcaggtgatctgcctgcctcagccttccaaaatgctaggattacaggtgtgagccacagtgcccagccaaaaaagctagcattttatgaaggtttatataacaaatgtgagcagagtaaaagcaacttttcaattaccttagctgatcaaactagtaaatggaattcaagagtacttgatcagtctctggcaccatgtatagcatctacctagtccttaggaactatgactgcagcaagttcagtaacttttttttttttgagacacaatctcgctctgttgcccaggccggagtgcagtggcacgatcacagctcactgcagccttaatttccggggcttaagcgatcttcccacctcagcctcctgagtggctgggactataggcgtgtaccaccacacccggctaatttttttctattttttgtagagatggagtctcagtttgttgcctaggctggtctcaaactcctgggctcaagcagtccacccaccttggcctcccaaagtgctgggattacatgtttgagccaccatgcctggcctcagtaacttttaacaatgtcttttacctcaacctactattgttaagggccccgggaatcaattattcaacaaatgattatcaggagccagttatatgccctgcatctgttagggcttataacatacatactaatggccatgatgggtaggtaaaaaaccttggcatagtgaatgtcaccataaaagaattgatagagcttaactacagtgacccatattatcgggacatgaagtgactgcattctgtgattctgctagagattagagtttaagatttcaccagaattgtaactacccattttttaagtgtaagtgtcagtgctgatccaggttctcacagcctacttctgccacccattctcagacagaaggattgacacattttgcctttgtatcatactagtcctaggtgagctataaatcttaaaagaggtagtgagaagccagacgcagtggcttacgcctgtaatcccacgactttgggaggccgaggcaggtggatcacctgaggtcaggagttcgagaccagcctggccaacatggtgaaaccctgtctctattaaatatacaaaaaaaattagccgggcgtggtggtgggcgcctgtaatcccagctactcggaaggctgaggcaggagaaacgcttgaacgtgggaggcgaaggttgcagtgagccgagattgcgccactgcactgcagctgggtgacaagagcgagactccatctcaaaaaaaaaaaaaaaaaaaaagaggtagtgagaaaaatgggagatgccttttatcctgactatctgtattatcgtttccttaaagtaaaaaggcatgatatatgaagtaatcactaaccaattaaagcaatctaaatacttgattaaattccttccattttgtgactttttatttttgtttgtttgtttgttttgcgaaggagtcttgctctgtcgcccaggctggagtgcagtggcacaatcttggctcactgcaacctccgcctcccgggttcaagcgattctcctgtctcagcctcccaagtagctgggataacaggctcacgccaccatgcccggctaatttttgtattttttttagtagagacggggtttcaccatgttggccaggctggtctccatctcctgatcttgtgatccacccgcctcggcctccccaagtgctgggattacaggcgtgagccaccgtgcccagccgtgactttttatttttaactaatttcaagcttacaaaaaaactgcaagaaatagtagagaattcctgtttaccaatttcatgcaggttccacagttaatattttacatcgtttatcattctctcttaatagatagatatacatttatatatatatatacacacacacatacatacatttttttctgaactatttgagagtaagctgcagacatgatgtttatgattattttaaagccatttttagattatttatgtattcttcacactacaccagaggctgaacttcacatcggttttgagtatcagactggaaattctttcttgaaatatttggaatcatttgtagttgttgcctcaagtgcaggaaaatcaattttcctttgaatttatttaaaagtttaagtagtgttgttacagcctgtagaaaaattaaaattaaaattaaaaaattaaaattcattgtgaccttttcacacccttactgtctctgtggaggatgaagaaggctttgctcttttgcttgccacactcacagagctaaaggatacaattttatggatctttatttagaggtcatgctaaggtagctaaaagggactacctcttatgacttattttaatataatactgtatttccagagtgtgaaaattacagatggtattccaggttacctctggtacctaaaataacgaaattgctctggaacaacaggtaaagtgatgaacagaaaaaactttttttttcattgtccaagttcataattaagtctcaatagtaattatgagagaatgaaggaaccttctggttggattaaaatggtggttttattcaaaaccaaagtgattttttttttggctactcagcctcctttttgtttttctttggtttttaaaaaagcataacagcagtactatttggtaaatttcacagtctgtgttctaaataaagttctcacaatctgaatcagtatctttctgaagtgattcaattaagaccagagacaggctaattaaggaacactttactattcaaagtgtcctttgctggaatcatccaaaatccaaacctcagtgtcatgtggtgttcccatgtgacagacttgtacacgtacctcctgaatctaaaataaaagttgaaattatttttttaaagtgtcctttgctatactcagacctaggctggcagcactgccatcaactcagagcttggtggaaatgcagaatctcagaccctaccttagatgtattgagtcagaacctgcattttaacaagctcccccaggtgattgtgtatgcattcagatttaagaggcattaatatacttatttgagaagtctacattattctgtagggaagtggtcaggcttttgttaaagtttcttccaaacttgctcatcttcaacatcctgaaaaccagctcttctgtgcaggggttcctttgtctgctagctaaatagacatgagctggtattttgtccaaggacaagaatgaacaaattagatagactagtggaaatttgctcttttcttccttttctctacaggggaggagaaaatctttggcttttttttttttcaggtgcagggatgtgttagaataatttctcctttcttgggaggtaactaatactgcagtggataaactaaaacaaaatagcagaatttcagagacttcaggggagcttctgggatgatatgagcttccacagtccataaagattctctgaatactccattgtgcaaaatagactttttgctgacttattccttgcctcttcttccactgtccacagacatattaaaatttaaaaatattatatatgtatgttaaaaattcaaacaatatagaagtatagatagaggaaatttattcatctgtctgtcattctattcctgccttaaccctattccccagaagtagccactgttaatagtttggtatgtaacccccccgcccagctttcttatgcatgttctcatctatgcatacactaaaattaaaaaaaaaaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctgcctcagcctcccaagtagatgggactacaggcatgcaccaccacgcccagctaatttttgtatttttagtagagatggggtttcaccatgttggccaggctgatctcaaactcctggcatcaggtgatccacccaccttggcctcccaaagtgccaggattacaggcgtgagccaccacacacggcccataaattttcttctaaagctatgcctaaaactgacaaatagaatatttaagaatttcattattactatacccagaccaagcaccagaccaaaaacaagtttgtttagaattatatttttctctttgcttgtggtaaaaatgttcacaagttacttaatattgtatacaagtgttaattttaggttacacaatcttagaaaatgtataccacagttttttaaattcagtcacactcagatgttttagcttattaatttgcactcatatttatagacttcccagtatagcacagtagatttgttaaccataaagatatgtgatgatggccaggcacggtgactcacacctgtaatcccagcactttgggaggccgaggtgggcggatcgcctgaggtcaggagttcaagaccagccgggccaacatggtgaaaccccatctctactaaaaatacaaaaattagctgggtgtagtggcgcatgcctggagtcccagctacttgggaggctgaggcaggagaatctcttgaacctgagaggcggaggttgcagtgagctgagatcgtgccagccactgcactccagcctgtgcaacagggcaagactccatctccaaaaaaaaaaaaaaaaagatatgtgatgaggtttcatgagatcaaagtcataaatttggtactttggctgccctacccctaggtgtcttaatgatacatatggttagtcacagagctaaataaagaagtatggactagtataagcttatccccaccattgagaaaattactcaaaatgtatgtagtaatcacctcacctcatatattaagggcagaacattattataataaaatgtatggtatacggagtcatcttcagttcaatattaccttgtctgcattctatgatttctgcttcagtttagcctccattatttctaactggaatgcactcaaggctaaagcttctattattctttttttagattaattaaaaaagaaaaggagggaggttgccaagcaaatgaaaatgaaaagaagcattcaaggtttctatttaatttaagaaccaactattttggggcaattcagaaatagctttcttcatgagacaagcaatgcctatgccagttacaattttttttaagtctgttaagctgatttttccaattacttccatattatcccctttacaacctcttagcccagttagaaataactttagcctagctggagtcactacattcattttgtttttaactaagtagcattggtcttctctcaatttagtctgcaacatacatatatatttatatatattttataatatatgttatatataaatatataaatgtatattaatataatatataaatatatatgtaatttatattttgagacaaatcgcactctgttgcccaggctggagtgcagtaggaccatctcagctcactgcagcgtctacctcctgggttcaagcgattttcctgccttagcctccctagtagctgggactacaggtgtatgccaccatgcctggctaatttttgtatttttagtagagacagagtttcaccatgttggccaggctggtcttgaactcctgacctcaagtgatccacccatctgagcctcccaaagtgctaggattacaggcatgggccaccacacctggccctgcgttatatttttaaaaaatgaacagaaagagttcttattatagtttgaagagtttttttaaattatctgcaatttacataagtattgaacttatgtttttgacatttgaaaaatcaaattttcccttctatttctgtttgcccatagattacattcagctgaagcaaaaagattttttcctactttctctatacctttcctatattactgacactttcccattaactgatcacctgaattgtttgataccaacaaagcccaaaatgtaagcactttatatagaaaaattagattatattaggtattttttctttttttcactgtgtatacgtttatctacttttttaatttttaatttttgtgagtatataataggtatatatatttataggttacatgagatgttttgatacaaacatgcaatgcataataatcacatcatggaaaatggggtatccatctcttcaagcatttatccttgtgttataaacaattcaattatattctgttacttttaaatgtacaattaaattatgattgactatagtcacactgttgtgccatcaaatactaggtcctattcattctttttatttgtacccattaaccatccccacttccccttacaacccccactatcctgtttacttatttaaagctattaaattaatatttaatcattttttctttttttatcaaacctcagacttgacctatggactgttgatccccattccctgtcaggtagccatcaaatgccacagaatcctagaaagaacttctatttttgctatgtagaattaattttcttcctggcaatgacagcaatagctggcctagaaaagtggaatggttgttaaaaaaaaaaaggtttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccaggatgtattatttacttaagcaaaacaagttgcagtgtaatacttatggcataatctcatttagtaaaaaatgcaaaactacatgtatgtgtacttacatatgtatataaacacctagagaaaggactagtatatacacatgattaacactgtttatctcaggaagagagcgggattgagggagaagatcaaagagaaacttgcatcttttcaacattgaaatttttacagctagaatgtatttaaatttatttgtataacttaaaaaattaaaacaaaaaatcttgtaccaaaataagttccagtttaagcaaaaattcaaatgtaggctgggtgtggtggctcacgcctgtaatctcagcattttgggaggccgaggtgggaggatcacttgagcccaggagttcacgaccagcccaggcaacaggtgaaaccccgcctctacaaaaagtaaaaatttaggccagtcatggtggctcacgcctgtaatcccagcactttgggaggccgaggtgggtagatcacttgaggtcaggagttcaagaccagcctgaccaacatggtgaaaccccgtgtctactaaaaatacaaaaattagctgggtgtggtggcatgcgcctgtaatcccagctactcgggaggctgaggcatgagaattgtttgaacctgggaggcagaggttgcactgagccaagactgcgccactgcactccagcctgggcgacacagtgagattccatctcaaaaaataaaaaaataaaaataaaaataaaaaatttaaaaagtaaatatttagccaggtgtggtggtgtgcatctgtagtcccagctacttgggaggctgaggtgggaggattgcttgagcctgggaggttgaggctgcagtgagctgtgttcatgccactgcattccagcctaggtgacagagtgagacattgcctgcctcccaaaattgaatgtaaacaatgaaaccatgaaattactagaagaaatatttggagcattttttttcaatattatgaaactttcggacatacagaaaagtcagaagaattgtacagtagatatcctatatacaccagctagattctacaattaatactttactatatttgctttatcatacatcaatccatcaatacatcactgaaataattttagactcacaagtaagtaaaaaaaagtacagaaaatttccatgtagccttcatctagcttttcccaatgataacatctaattcatttataaaacaatattggaggctgggtgcggtggctcatgcctgtaatcccagcactttgggaggctgaggtgggtggatcacctgaagtcaggagttcaagaccaccctcgccaacatggtgaaaccccgtctctactaaaaatacaaaaaattagccgggcgtggtggcacgcgcctgtaatcccagatactcgggaagctgaggcaggagaatcacttgaacccgggaggtggaggttgtagtgagccaagatcacgccattgcactccaacctgggcaacaacagtgaaactccatctcaaaaaaaaaaaaaaaaaaaaaaagaaaaaaaaagaagaaaaaaacaatattggatttggaagcgtttttctaaaatatgatacaaaaccaataaaagaaaagattaatagattgatgaattcagatacctaaacatttcttcttgggatgaagacaccaaatggaaagtcaaaaggcaattaaaataattataattcatatcatagatgaaggttaattttttcatatacgaagaacttttatacatcaataagacaagcgtcagcaccccaaaatttcttttctatgataaaggatatgaactgacagttcacagaaaagcaaaaacaatacctcttaaacatgaaaagatgttcaacttcattcgtaatgagtaaagcaaattaaaatggcactgaaataccattttcacttattggattggtaaagttaacaattttgttaacactatgtttctgatctctcatgtattgctggtggtgtgtacattgatacaagatgccaacagaggaatttggcaatatctgtcaaaggtgaaattgcacatagcctttgcctcagaagttccacttgtaggaatttatccaacagacatttttgcatatgtatgaaatgacatgtatgcaaagatgttcattatagtattgtttacaatagcaaaatatgaggaaaaactaaatttcagtcattagggactaaaattatgatacaatcatatcatgggatactgagtagctattaaaaacaatgaaaaagaatgagtaggtttttatatgtttttaaggattaaaaaataatagcttttttgaaataccataaaactcacctttttaaagtgtacaacccagtggtttttagtatattcacagacttgtgcaactatcactactatctgatttcaaaacattttcatccccattaaaataaaactcattagtagtcattctttagtcctaatctcttacctgtactggttctactctctctaccctaggcaaccactaatctactttgtatttgtatagatttgcctattctggacatttcatataaatggaataatataatatgtggtcctttgtaaccggcttcttttatttaccatagtgtattcatggttgatccatgttgtagcatgtatcattactgcattcctttttattgccaaataatattccaatgtatgaatatactacattttgttgatttagtcatcagttgatggacaattgggttgtttccactttatgaatattgctgctattataaataatgctgctatgaacattcatatacaagtttttgtgtgaacttatgtttttaattcccttggggatatacctagaagtggaattactaagtcatctagtaactctatatttaaccttttaagggactgccagactgttttctaaagcagctgtaccatttcatatccccaccaacattgtattgacgttccaattgttccatatgcatgtcaacacttgctattacctttttattatagctatcccagtggaagtgaactggtatctcattttggtttgatttgcatttccctgatgactaataatgttgagtatcttttcttgtgcttattggcctttcataaatgttctttggagaaacaattcgaatttttaccttttttttttttgagacggagtctcgctctgtcgcccaggctggagtgcagtggcgcgatcttggctcactgcaagccccgcctcccaggttcacaccattctcctgcctcagcctaccgagtagctgggactacaggcgtctgccaccatgcccggctaattttttgtatttgtagtagagatggggttttactgtgttagccaggatggtctcgatctcctgacctcgtgatccgcccacctcggcctcccaaagtgctgggattacaggcgtgagccaccgcgcccgaccatttttgcccatttttaattggattgtttgtctttttattactgagttgtaagaattctttatatattctagatacaagtcccttatctgatatatgattttaaaatattttctcccattctggtattgcctcttcgttggcggtgttgtttagagcacagaagttttctgggtacagcataggtgcatgtgcctgtatttatgaggtatatgagacgttttgatacaggcatgcaatgagtaacaaacacatcatataacatggggtatccatcccctcaagcatttatactttgtgttacagataatccatttatactcttttagttatttttaaatgtatgattaagttattattgactatagtcatcctgttctgctatgaaatactatgtcttattcattctattttttgtactccatgttgttttcttgaataaatgcttcctagattgctgcaagcttttgtttgatttccagatttctggaaaaagatggttcttacaatttctgccagttttctcattgcttttacagaggagagaattttagaggtcttactgcaccatttgcactgatataccttcagcagatattcttgaataaatccttcttaatttgtggtatgccctttggtcaatttccagagtatttcaatggctgttttttgatacttttgtcagttttatcattgctttttgaggaaaggatttgctgagctcctcacgcagtcattctagaagtcatgcccatccattttataatttaacgcccagctaaactataaccccactcaagatatagggaaagatacatttttagacatacaaagtcaaaacacttttgccatccattaatttcactgaaagctatactagtgattatatacttcagcaggatgaaaaaaaaatccagcgggaagcaagactggatacaagaaacaataataaatgtcaaatcctctatcactgagtagtagtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctctt

SEQ ID NO: 4753 - DNA, 139698 bp, human; identical to SEQ ID NO: 4746

SEQ ID NO: 4754 - DNA, 139693 bp, human; identical to SEQ ID NO: 4747

SEQ ID NO: 4755 - DNA, 139698 bp, human; identical to SEQ ID NO: 4746

SEQ ID NO: 4756 - DNA, 135987 bp, human; identical to SEQ ID NO: 4749

SEQ ID NO: 4757 - DNA, 134863 bp, human; identical to SEQ ID NO: 4750

SEQ ID NO: 4758 - DNA, 139698 bp, human; identical to SEQ ID NO: 4746

SEQ ID NO: 4759 - DNA, 139693 bp, human; identical to SEQ ID NO: 4747

SEQ ID NO: 4760 - DNA, 139698 bp, human; identical to SEQ ID NO: 4746

SEQ ID NO: 4761 - DNA, 135987 bp, human; identical to SEQ ID NO: 4749

SEQ ID NO: 4762 - DNA, 134863 bp, human; identical to SEQ ID NO: 4750

SEQ ID NO: 4763 - DNA, 7885 bp, human
tgagaagagctgctgcaggcatttgcagagtgaatgagctctgactgagacttgacttcagaaccactgggctggcctggcctcttgacacagcaacacactgcttcttgccttccaggtaaatacctctgccttactgaccatgttatgggttttagtgggacatcagtacagggattctcctcagcctcttcctctcctgttaactatcactaaccaagtccctaacattaggaaagtccaactgataactgtcagtttcatctttcattaactgggggttttgtgacagagatcttgcaatcactacttctcgggggactggaagtagaatattagtgctctttaaaattaatgaaggctagacttgtccagtctgttaagagtatgctgtaatacccaaagaagccagcaatagtccctctcctaggcagcaatgcagccagaaggctcccaggcccaggatactatgcattagtgctcacagatcttgtttagggagctagggagcaaggggaagggacgggagtgcctcctggaaggtgaggactgaagccaacgtggaagtcactgagctgagtggcaggtgtctaacactgaaaagtggccctagccaagggctctaagtagtggtactttctaccgaggctcttccccaaggagctctagatccacagaggcagaaggattatttgatcttctttgcactcatttgatttcaggaggaggtctgaagtcccaaagcatgggcattggggtgagagagggaacatcaaagtgtgccaaaaaagattgttttattttacttattcctgatttttcttaccagagcttgagctcatacaccgcattgtaacacaaacacacaagcacacataccacacacacacacatgccttcaaactagagaaggggactacagaaagcacctggccataaaaggcatgtcaaggagtttgctgtagggtggtgatatggttgctttgtttcagttcagcagacttatctccatgaagaccttattgttttctgtgatttctcttttgtattttttaaaatttgtctttatttcttaattattaaaaccttcccttttgcccctcggagcattgatcagggtttactaactacaaatatttacttcatgaaggagcagttttttctctagtaatattaatgtggggaccctgggaaggaagacagtgtatgaaagaaggcatagattggcttcaagcacaggcagtataggtgtttgcctatatttggtgttttgatagacttagggaaaatccctcagcctactaccaaatatttttgagtgtcagtacatctgtggttgttaggtattgaaaagccctgattaaatacagataattatgagaatatggaaagaagcctttagtaccttattcgcatgtcctaggaatgatgaggtagggtgccaagttaagaagaggaaaatatattgtaaatatccaggagtaagtaaatagtgaaaagattagcacgagatttggtgggcccaatggagttcaggatgatttctttcttaacagaaggatctgcttctgttgggctcatggctgcccaaattaggcagagccagatgatgactcactgatctgagaactgagtggagtcatttggtgagaaagcgtgtgtaggggaagagggtgtaaagcaagcatttttctagttttaggaagataaaataattcctcataaacagtattttttttcaataattcattgatgcaattaacttggcatatctccgttcaagtgatctgagccagtgatattttgctatatgtctgaattatttattttaaaatatcaaactggcacctgcagtcatttttcaaatcctagcccactttctttgaggctgatgcatatagcatatttggaggtaactctgactctcatcctcatttttaaaaaggcagcatgatgccaggtgcggtggctcaagcctgtaatcccagcactttgggaggctgaggcaggcagatcacctgaggtcaggagttcaagaccagcctggccaacatggtgaaaccccgtctctactaaaaatacaaaaattagttgggcgtggttgaacacgcctgtaatcccagctactcaggaggctgaggcaggagaatcacctgaagctggggggcagaggttgcagtgagctgagattgtgccattgcactccagcctgggcaacagagggagattctgtctcaaaaaaaaaaaaaaaaaaaagcatgaaaaaaaacaaagaaaaggaaagaggaaagatgggggtggagtaggtaaaagaaatgtataaggcataatacccaagttaaaatgacctaacctaaaaattcacatagcacaaactctacccatgaaaaaatattatgtccagcagtcctgattgagccttcagttaatatatgactgtgcaagtgccaatggagcaccagagaggtaacataaaaaggaataggtttgacactagtttggtgttgtttttgtgtgtgtgtgtgtgtgtgtgtgtgtgtgtgtgtgttttctttaattttgttcattaggttttgtagagacaggatcttgctatgttgcccaggatgatctcgaactcctggactcaagctatccttttccctcagcctcccaaagcactgagattacaagtgtgagcccatatacctggccttaagctcaatgttttaatggagagtgtttgaggactaaaagagacaggatgcatttataattatttattattttcactgctccaggaagtcaaagacagctgaaaggtgaccatacaatgcctcttctggcaattactagaatcaccatagggtagaattacatttggactttcaaaaaggttttttctttttcgtttattcatttatcctgctcaaaattagccacgtacaaaattgtccccataattctggtggcaaatttcctaggaaatttttaaaaattctatcgaccttaggttattaattcagtgaagaaataagaaaaagtagttgtatgcctttgatatacttcagttagaatgagaaatacaatgaactgaagcctaatgttgtaattattatcataggaaggccttcaccatttgatagcagtatgaacacatgattaaattcaacagaatgcattttcctgtagctaaagtttttgcaagcatgagcatttcgcttccaatcctccccatgagaagaacacagcgaacacagataagaatttgtatctctactttttcttcccctactctaccaaggagcaagagtaacaaagtttgacatgcataactcaagactagatgaataaaagcacagtcttcttgagagattatattgaattaagctaaccagaagttgagggattcagtgtgagaattactttaatattaattaggccacatccctcaatttcctgaagtgagaacacagctacgagttagggtcttgtcattaacacattttatctaatcatataagaacatacacttacattgcattggtaaataccaaagatatatttccaaggatgaacttgataaaaacaggtcatgtattctagaagacatgtttcctatggatttttgaaattcaaatgtaatcttttggtttaattcactaattttatttattaaaatagtatttgaatttcttaaaaaaaaaggtggctttcctaaagactttcaaccttttgaatctgctttaggatttagccaaaagttgggggttccagtgttgatcccaaagttttccccttcgagtgtttcgcctcaaagaattcacagctgtatagttgatagaaagattagcacattcttgaaattaactcccatcatctctttaattttgaaaacatctgtgagtgcttactatgttccaggctttgtcctaagtggtttgcatgttttcttctctttttactaaactctcagatatataaacacacttacagaaacatactctatgataggagtgttagaaataatagctttaaatggttaaaacaaagaactgaatgcaaaaaaaagacttgtgtaaggtcattcagatagaaagtagagtcagaatttgaatcaggtcagtctgaatctaaagtctgtcttcttacatgctgtactgcttgagccttattcctatttattatcatagcctgaagaattcatgtagaaagtaaaatttagtcaataacataattttcctattctcataaccagtagtattgaaaaaggagaagaggtaggaagaaagaaaactagaagaagaaagtgatcttccaaattttatcaagatgagtgtatttgtcaagactcttttgtctacaagtaatggaaacccagctgaagctcacttaagcaaacaacgataatttatttcttcatgtcacttagctagtgcaggcaaagttgaattcaggtactcaaatgatgttgtggggaagctgattacatttcctgactctgctttcattaaagtgttcattagagtgttcattctaaggaggtctttcccaagtaatgacaaaaaaaaaaggccatgagtagcttgtttcagattcatgttccacaagcttggaactatgccaaaatatcttaatcatggggagtgggcaattcaaaaccaacattttactgtaaggattttcctattatcaaacttaaaaaacatattcttctttctattgtgggcatctgtgggtctcagaaacctccacatgtttcgctgcccctccattgttgaagagtctcttataaaggtttatgggtgttcatggatgaaatatagagatgccccaaagagacttccaggtgtggagaatgaattgctggcattagtacatgcgcctcaggcccccaatacctgacagcccagtgcttcagcagctgaccagactgcaaagctagttatgagataatgcaatattttccccctcagatacaagttaacaggaattaactatattttagtctagtacatacaagggagagctaagctacatatctcccagtgatgtcaacagatatatacagaaatgggaatggaaaaagttcagattacaaaaataaaaaaattctggatgactaaattacatgcatgtaataaatattaagaaagaagtttcttctaagaaagaaacttacacccaagatatgctattttcttgatttcaaaatatcacatcatatgttaggtagtctaaaatactagcacagacattgcaacaaacatcttttgctttatttttacaaaaatctatttaaaaaaaaagataccaagcaaagttgtccctttctatacaaggtaacgtcctgccttttaacaataaattgagctaaggttaaaggcaagacaacacctgtattaggagatactaacacaaatattacatggtaataattgcactctaaaattaacaaataaactcgacttttctgttttttagttgtgtattttagctaagagcatgcaataaataaaatatagatagatagagatagattagatagatagatagatagatagatagatgatacatatagatagatagacagatagatagatagatcttctgagtaagaggaaatgaacaaacactctccccccactttaatgggtgcgaaaagaaacgaatgctcagatcacatgcagatgtggctgttttccagcccaagttccttacacgaaattggccttacctgtgaggttcactttgcctgtctaggatagggacagtgtctttctcaattctgcatggtgagcagtggctaaataatgattgagccaaacccttcagcagcattcaagctgtaagtaactctttgccatactgagatttttagagtgtttaaagtcatacccagttgcctgaagatctcctccctatggctgaatatccccctaccaccaccactaccactgccatcacagtggcagggcacatttgtacctaagtagctgaaattaaaaggacacacaggtcttttactctcagattccagtattggcatattataagttatttcaagttgcatcttattttaaatgaacttggatcagctttaaatgccctttttacaaatgtgtcagaggagaataatataatttttctggaaaaatgcaaatgctattagttaagatgcaacctgcaaaagaatccaggggcacttgatttcttatttctgatgaaaagtaggagaccaaatcatatgcacacaggcagacatctcatatctgcatacgtaaacatgctctttggatgttgtagacaagtctcttcctgaaaaaaaaagaaacttgtatattcattttaaggaaaagtaaaatccagcccaagaatatattccaggagacactggaatcaattacttaatccgaacattttgagttgtgcacattcttgggagcaaaggcccttttgttgccctgctggtggacctggagtttttagactgtgtttgctgattaagtactgtgagaaaaaacaaagactatgtataggaatattgggctccagcagaggcagggcttgaagatccaagttttctctgatgcttgacagtggcattgggagactcctgcctgccctcacctcactaacagaagagagcggataaactggcacaactgctgctcacctaatttgagactccaactgcagagccaactggccccaaaagcttgtactcctttctgtttcccagtgccttcactggagagcaaaagaccctgatacatctctccggatctgcttaaagtggtccctcgtgggcaattatttcgcatgtctttgagttttataatttaatgtaaagctgtaacctgtatctcccttttctcctctctctacttccctatctatagctttttttcaacaagctccaaaacccccctccctgttagactctgaagtgtcactcactgtgttttttatgcttccaatagtttccaaaacaaacagtggaggcagtgaccggctgggtattcactggatgcaacagtaactcccaatccgagcaacctgagccgccattggcggcaggtctgctccctaaaaggccagcacttgccaatctctgctctgccaggtcctggaatcagggatttgaggactaatggtctgcacatgtgcactgggaggaagggagactagactttgaaggacatatacactagtttgatcttcctctcctttcattttgtctattcaaacaaaaaatatatatgtatataaaaaaattacacacacacacacacacacacacacacacacacacacacaattattttctttgaatacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgt

SEQ ID NO: 4764 - DNA, 16617 bp, human
ttctctgggctcttgagaagagctgctgcaggcatttgcagagtgaatgagctctgactgagacttgacttcagaaccactgggctggcctggcctcttgacacagcaacacactgcttcttgccttccaggtaaatacctctgccttactgaccatgttatgggttttagtgggacatcagtacagggattctcctcagcctcttcctctcctgttaactatcactaaccaagtccctaacattaggaaagtccaactgataactgtcagtttcatctttcattaactgggggttttgtgacagagatcttgcaatcactacttctcgggggactggaagtagaatattagtgctctttaaaattaatgaaggctagacttgtccagtctgttaagagtatgctgtaatacccaaagaagccagcaatagtccctctcctaggcagcaatgcagccagaaggctcccaggcccaggatactatgcattagtgctcacagatcttgtttagggagctagggagcaaggggaagggacgggagtgcctcctggaaggtgaggactgaagccaacgtggaagtcactgagctgagtggcaggtgtctaacactgaaaagtggccctagccaagggctctaagtagtggtactttctaccgaggctcttccccaaggagctctagatccacagaggcagaaggattatttgatcttctttgcactcatttgatttcaggaggaggtctgaagtcccaaagcatgggcattggggtgagagagggaacatcaaagtgtgccaaaaaagattgttttattttacttattcctgatttttcttaccagagcttgagctcatacaccgcattgtaacacaaacacacaagcacacataccacacacacacacatgccttcaaactagagaaggggactacagaaagcacctggccataaaaggcatgtcaaggagtttgctgtagggtggtgatatggttgctttgtttcagttcagcagacttatctccatgaagaccttattgttttctgtgatttctcttttgtattttttaaaatttgtctttatttcttaattattaaaaccttcccttttgcccctcggagcattgatcagggtttactaactacaaatatttacttcatgaaggagcagttttttctctagtaatattaatgtggggaccctgggaaggaagacagtgtatgaaagaaggcatagattggcttcaagcacaggcagtataggtgtttgcctatatttggtgttttgatagacttagggaaaatccctcagcctactaccaaatatttttgagtgtcagtacatctgtggttgttaggtattgaaaagccctgattaaatacagataattatgagaatatggaaagaagcctttagtaccttattcgcatgtcctaggaatgatgaggtagggtgccaagttaagaagaggaaaatatattgtaaatatccaggagtaagtaaatagtgaaaagattagcacgagatttggtgggcccaatggagttcaggatgatttctttcttaacagaaggatctgcttctgttgggctcatggctgcccaaattaggcagagccagatgatgactcactgatctgagaactgagtggagtcatttggtgagaaagcgtgtgtaggggaagagggtgtaaagcaagcatttttctagttttaggaagataaaataattcctcataaacagtattttttttcaataattcattgatgcaattaacttggcatatctccgttcaagtgatctgagccagtgatattttgctatatgtctgaattatttattttaaaatatcaaactggcacctgcagtcatttttcaaatcctagcccactttctttgaggctgatgcatatagcatatttggaggtaactctgactctcatcctcatttttaaaaaggcagcatgatgccaggtgcggtggctcaagcctgtaatcccagcactttgggaggctgaggcaggcagatcacctgaggtcaggagttcaagaccagcctggccaacatggtgaaaccccgtctctactaaaaatacaaaaattagttgggcgtggttgaacacgcctgtaatcccagctactcaggaggctgaggcaggagaatcacctgaagctggggggcagaggttgcagtgagctgagattgtgccattgcactccagcctgggcaacagagggagattctgtctcaaaaaaaaaaaaaaaaaaaagcatgaaaaaaaacaaagaaaaggaaagaggaaagatgggggtggagtaggtaaaagaaatgtataaggcataatacccaagttaaaatgacctaacctaaaaattcacatagcacaaactctacccatgaaaaaatattatgtccagcagtcctgattgagccttcagttaatatatgactgtgcaagtgccaatggagcaccagagaggtaacataaaaaggaataggtttgacactagtttggtgttgtttttgtgtgtgtgtgtgtgtgtgtgtgtgtgtgtgtgtgttttctttaattttgttcattaggttttgtagagacaggatcttgctatgttgcccaggatgatctcgaactcctggactcaagctatccttttccctcagcctcccaaagcactgagattacaagtgtgagcccatatacctggccttaagctcaatgttttaatggagagtgtttgaggactaaaagagacaggatgcatttataattatttattattttcactgctccaggaagtcaaagacagctgaaaggtgaccatacaatgcctcttctggcaattactagaatcaccatagggtagaattacatttggactttcaaaaaggttttttctttttcgtttattcatttatcctgctcaaaattagccacgtacaaaattgtccccataattctggtggcaaatttcctaggaaatttttaaaaattctatcgaccttaggttattaattcagtgaagaaataagaaaaagtagttgtatgcctttgatatacttcagttagaatgagaaatacaatgaactgaagcctaatgttgtaattattatcataggaaggccttcaccatttgatagcagtatgaacacatgattaaattcaacagaatgcattttcctgtagctaaagtttttgcaagcatgagcatttcgcttccaatcctccccatgagaagaacacagcgaacacagataagaatttgtatctctactttttcttcccctactctaccaaggagcaagagtaacaaagtttgacatgcataactcaagactagatgaataaaagcacagtcttcttgagagattatattgaattaagctaaccagaagttgagggattcagtgtgagaattactttaatattaattaggccacatccctcaatttcctgaagtgagaacacagctacgagttagggtcttgtcattaacacattttatctaatcatataagaacatacacttacattgcattggtaaataccaaagatatatttccaaggatgaacttgataaaaacaggtcatgtattctagaagacatgtttcctatggatttttgaaattcaaatgtaatcttttggtttaattcactaattttatttattaaaatagtatttgaatttcttaaaaaaaaaggtggctttcctaaagactttcaaccttttgaatctgctttaggatttagccaaaagttgggggttccagtgttgatcccaaagttttccccttcgagtgtttcgcctcaaagaattcacagctgtatagttgatagaaagattagcacattcttgaaattaactcccatcatctctttaattttgaaaacatctgtgagtgcttactatgttccaggctttgtcctaagtggtttgcatgttttcttctctttttactaaactctcagatatataaacacacttacagaaacatactctatgataggagtgttagaaataatagctttaaatggttaaaacaaagaactgaatgcaaaaaaaagacttgtgtaaggtcattcagatagaaagtagagtcagaatttgaatcaggtcagtctgaatctaaagtctgtcttcttacatgctgtactgcttgagccttattcctatttattatcatagcctgaagaattcatgtagaaagtaaaatttagtcaataacataattttcctattctcataaccagtagtattgaaaaaggagaagaggtaggaagaaagaaaactagaagaagaaagtgatcttccaaattttatcaagatgagtgtatttgtcaagactcttttgtctacaagtaatggaaacccagctgaagctcacttaagcaaacaacgataatttatttcttcatgtcacttagctagtgcaggcaaagttgaattcaggtactcaaatgatgttgtggggaagctgattacatttcctgactctgctttcattaaagtgttcattagagtgttcattctaaggaggtctttcccaagtaatgacaaaaaaaaaaggccatgagtagcttgtttcagattcatgttccacaagcttggaactatgccaaaatatcttaatcatggggagtgggcaattcaaaaccaacattttactgtaaggattttcctattatcaaacttaaaaaacatattcttctttctattgtgggcatctgtgggtctcagaaacctccacatgtttcgctgcccctccattgttgaagagtctcttataaaggtttatgggtgttcatggatgaaatatagagatgccccaaagagacttccaggtgtggagaatgaattgctggcattagtacatgcgcctcaggcccccaatacctgacagcccagtgcttcagcagctgaccagactgcaaagctagttatgagataatgcaatattttccccctcagatacaagttaacaggaattaactatattttagtctagtacatacaagggagagctaagctacatatctcccagtgatgtcaacagatatatacagaaatgggaatggaaaaagttcagattacaaaaataaaaaaattctggatgactaaattacatgcatgtaataaatattaagaaagaagtttcttctaagaaagaaacttacacccaagatatgctattttcttgatttcaaaatatcacatcatatgttaggtagtctaaaatactagcacagacattgcaacaaacatcttttgctttatttttacaaaaatctatttaaaaaaaaagataccaagcaaagttgtccctttctatacaaggtaacgtcctgccttttaacaataaattgagctaaggttaaaggcaagacaacacctgtattaggagatactaacacaaatattacatggtaataattgcactctaaaattaacaaataaactcgacttttctgttttttagttgtgtattttagctaagagcatgcaataaataaaatatagatagatagagatagattagatagatagatagatagatagatagatgatacatatagatagatagacagatagatagatagatcttctgagtaagaggaaatgaacaaacactctccccccactttaatgggtgcgaaaagaaacgaatgctcagatcacatgcagatgtggctgttttccagcccaagttccttacacgaaattggccttacctgtgaggttcactttgcctgtctaggatagggacagtgtctttctcaattctgcatggtgagcagtggctaaataatgattgagccaaacccttcagcagcattcaagctgtaagtaactctttgccatactgagatttttagagtgtttaaagtcatacccagttgcctgaagatctcctccctatggctgaatatccccctaccaccaccactaccactgccatcacagtggcagggcacatttgtacctaagtagctgaaattaaaaggacacacaggtcttttactctcagattccagtattggcatattataagttatttcaagttgcatcttattttaaatgaacttggatcagctttaaatgccctttttacaaatgtgtcagaggagaataatataatttttctggaaaaatgcaaatgctattagttaagatgcaacctgcaaaagaatccaggggcacttgatttcttatttctgatgaaaagtaggagaccaaatcatatgcacacaggcagacatctcatatctgcatacgtaaacatgctctttggatgttgtagacaagtctcttcctgaaaaaaaaagaaacttgtatattcattttaaggaaaagtaaaatccagcccaagaatatattccaggagacactggaatcaattacttaatccgaacattttgagttgtgcacattcttgggagcaaaggcccttttgttgccctgctggtggacctggagtttttagactgtgtttgctgattaagtactgtgagaaaaaacaaagactatgtataggaatattgggctccagcagaggcagggcttgaagatccaagttttctctgatgcttgacagtggcattgggagactcctgcctgccctcacctcactaacagaagagagcggataaactggcacaactgctgctcacctaatttgagactccaactgcagagccaactggccccaaaagcttgtactcctttctgtttcccagtgccttcactggagagcaaaagaccctgatacatctctccggatctgcttaaagtggtccctcgtgggcaattatttcgcatgtctttgagttttataatttaatgtaaagctgtaacctgtatctcccttttctcctctctctacttccctatctatagctttttttcaacaagctccaaaacccccctccctgttagactctgaagtgtcactcactgtgttttttatgcttccaatagtttccaaaacaaacagtggaggcagtgaccggctgggtattcactggatgcaacagtaactcccaatccgagcaacctgagccgccattggcggcaggtctgctccctaaaaggccagcacttgccaatctctgctctgccaggtcctggaatcagggatttgaggactaatggtctgcacatgtgcactgggaggaagggagactagactttgaaggacatatacactagtttgatcttcctctcctttcattttgtctattcaaacaaaaaatatatatgtatataaaaaaattacacacacacacacacacacacacacacacacacacacacaattattttctttgaatacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggtaagatgaggactctccagttttatgctctggtactcctctgtcccttttccccaactccctgacatacagtagaaagccatagcccctcaattgatagggctcggacttacctggccccatgtaagtggctcattcttcctttcctgtacactgtgactccaataactcacttccccgtctcctgcctgtgtagtataagacaaaaatcagactttggtcttagactgtggccagacctctcagttaaggcctctaagataaccatggacagtatcccatgtcacagttcctcgcgcccgctagacctggcccaggttattttgaggtgagccattcccatagccaccttttggcatgggacagccacttcactgcagctggttattttgtgagtctaactaatttcagccttccacaaatctgcctcacagaaagtacccttgaaaaggaggttgggacacagctttttctctcatactttctcttctatagctttttattatggttggggagggacatgaacaaagccttgtggtaataatattctgctccacttagaaattccgtacttgttcggtcaagtatgcaaccaacaatctttcctcatgtagcaaatgctattccttgctattttgaaaagggaagggtattgtgagtcccttcactttttactggagtcagcatttgtccagaaacactccctcttccaaacatttctaaaagctcttgggtcagtccttattttctttcttacaggcggatgttcccctctgttcgggtcaaggtgaaagggttggatccagggaagcagtaccatgtggccatcgatgtggtgccggtggattccaaacgctataggtaatgggccccatagaatggtactctatgcccaggctagggccagggatttggaccttcagacctgaaacctgacagcatgactttgaaaactctagcatggggggtgggagtgggggattgctctcctgtgggctttaggagttgaattttcttattaaaattggggttcccagtgaaagaagagaagccttcttcctctctctgcccccatcccctcttggaatgccgtgaattcagggcactaattagaactccaaatgtaccccaagcctctccctacccactgctctggccttggttgtgtaaactgcagagggtgtgggctctggtggtcagaagggaagcgggttgaaggaattgtgggagaaatccccaggctctatgggagcctgggcatctggggacatgctgggctctgagctttgctgctttggcagcaggaggccagaaggatgatcaatttgccactcaaggtcagtcaagcgttcctgtgtctaggcctgtcttttcgtccatctttaacctttcccctgaagtaatgtctgggtcttagagggtacaagtatcattttccctttatttaagccctcaacctacagcaggctgaaagtggcccaactgttttaaagccaaaaagcccttctgggatacaccccagacacaccagcttgccaacactttgactcaggggcttggggtccagttcagggttggaggggttggggaggtgacagctgtttacactagggctgtgagcatttgacccagaggtgggtccctggtcctccaaggagacagcccacctcaaaaccagagctagctttgaaagcaaggagaaggctctgctcagaggactgctggggctgcagtatggaaacagcagaaaaagctgtttgcttctcaaattgcagctggcttgggaataagagcaaaactgggaagttgagattggaaatagtgtgaaaatcggccagaggctgcgcagggctgtgttcctaagagttttcttgatgtgaagccttattgacaaaagggcttccacaaagagtggtgacagtggcctagacaagacatccttgtcagccctccacttcttcccagactcttcacacccaaagctagtggatttttccattatctctgtgagataaaatttgttagatcaatttctgtggtggtttctgtgagaaaatacaaatcagacttagaaatctcatgacattttactttccctgcacttcattgcattttgatgacatatgcttatttacagtttattttttgccccgaatgcttgttagaaattaagttgagtcttctccttacttgcccttgggatcactgggctaatctggagtgaagtcctcaggaacagaacacaacagctcccagctttggcctgctgcacctaatgccacagcatgtgttttttcaggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacgtacgtgagcacaatcctttaccccgaggagggaggtgccaaggctcctgcccactggtcaccctggagaggccagggaggctttttgcagatgcacatgttgtgttttttaggaactgttcaagccctgcacctgtaagtaaagtagctaacctagggctcctgaaacgtttgtttagcatctgagatgctggcgactggggatggtgaatatagggagtttgaggacagaaggagacctgtttaagccagaatgcctggtctgggagagtaggagggaaccattcagggagttctcaggcaccttagcctccttggcaatcactatgatctctgattgccttcctgtagtccacgcagttggatgggcacccagtgtatggtatgtgtgatggaaggatacaagtgggggaatctcagactgcatcctggaaatctcccaaacaacctaccctcataggtcctattgatcttgcacattctcactaggtgcaccccagcttctgtcctccccagtctggcactgtgccagctacaaaaggaaagagggaagctcccaagattaggaggtagggtatgtcaggttacccaccatatccaagcctatcagttactgccatgggaacttgtagcaggctagcagatcccagtgccacttctacaccagatggtcgccagtgtttgaagcaggaaaaggccccaatctggaaatggaatcactgctgactggtgccgctgaggtgtctttctctggaaatgtttttagctcggagcgcctctgttggaggccaaatggcacaacaaagtagttacctaagcttcatcattgcctttttgtgtgcacatggtggaggtggtcaggagagggaactagggtttgggactgaagccagtttttctaacagcattgatcatttctcctccagatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacaggtaaacttggtcatgtctcaggcgaatggaaatggctccagagggaccttggattagaggcatagaggctaactgccatcaattgcattttccacaattctaaataaaaatcatagttttattgtattgtcatccatgcaagtttgataatgaattgtataaatcttatgggagaaggcaactccagaaggtaatttataaaagtaatgatttataaataggagctaaccattctaaatatgacttgcaatatggttacatttatttaaattgtcatattaacgtgtttcaacatctcttctggtggttgtaaccactataagcaatggcaacagtgttcttactgaaagcaatgactttatctttctctctctattgaatccatagattacgaaactaaaaatagaaagaaatccttttgctaaaggatttagagatactggaagaaacaggtaagcagcatagcaatgacatctaatattgatgtagctagctattttcacaagtttttttttttttttttttcctgagatggagtctcactctgttgcccaggctggagtgcaatggcacgatctcagctcactgcaactttcacctccctggttcaagcaattctcctgcctcagcctcccaagtagctaggattacaggcatgtgccaacaggcctggctaatttttgtatttttagtagagatggggtttcaccatattggtcaggctggtcctgaacacctgacctcgtgatctgcccgcctcagcctcccaaagtgctgggattacaggcgtgagccactgcacctggtcccccacaagttttaaggataagaaaactgactcagagactcaaaagctctaagttttgtaattagtaggtggtaagaaaggaacccagatgttttgtgttgaaaacattacttcctcccactcctttgctactcactattaagaccttgcttattttagaattctaggtttgactgaattttattcagaagtctagctatataaaagagaaatatttaaaatagttacatctgaaagatatagcaaaataactcaaaatcattattttcagaaattgcattctggggatgctgaaagttgactctcttttttaggggtgtattggatgggcttttagagacctacccatggaggccttctttcactctcgattttaaaacctttggcgcagacacacaaagtaagaaaacttggaacgtttgttttatttttacatatcaattaaataacaacatccggaacccttgtaccaaatactacacaaggggatatgtacatgcaagaaaatgtgtacttatgggtaactgcgtgtacatttgcctgaatgacgaggtaagaggcataaagggagagaagctggcatgaaggaagagaatagaaatgtgataattgtagacttattgacatatgttaataagttatcttacaccctgtgattttcagatttcatctggatttttcagcctctcactgtttcacattctttaggatatgcctgtggtgcatttgcagcctgatttgcaaatatgttactattgaaatgaatagtttatcttttatgaggacctttcagtacatgttaaaatgactttcattaaattcatcactgagctctaattttcctcttttttgttcatggggaaagtaaatgttaaaaataatactaagtcttcacaatttaattgccacaagcatttaaaaatatttgcaagatatttatcctcagatggtacattacatgacaaaataataataattaaataatgcaggctttctggtggaaggataccttaatttgctctgatagttaataataaatagaataatttttatttgaaaatgacatggattttttttatccctttgtctttactccatcgaagttgcttgtctttgaccattaattcaaggttacaattgccaagcaaaaccaacattatagttaggttgagttttacatgatgccataacaactaactgaaaagggaagaagtgaagtctaatcatttggtgaaatatttcactggaatggctgtcttgatgtggtttagggaattgcatgaaaaaaaaaacacttattttacagtgtcgatttaactaatagcatctagaaagcatacttttaaatatccaagtcaaaacaaatgtgcactaataaagaaaaagttaaagatgatcatgaaatgataatttaaagtacacagttttcttaattatttaacatatccaaaatgctctcaaattgcaaataaatgagctactagtttcttaaataacttttaaatgctttattataaaagatatttgccatcttgttgatgaaggtttaggatacgtctacatacacaaaatagttaagaaaacagcaacactaaaaaagaaacaacttggtcaaatccagccaataaccaattgtttgaattcagacatttacaaaaataagctttagagtttagcgtttcctggaccttataattatccctagttttagtagatgctaggcaaacataaaaaatcagcaaacgtcattgatatgaacacttacattcatccttatatttcttaacttgcaaaattatttccaactcttaagatataatgcagtatggaaattgccccattcattgtttttgtataagaaaaaaagctaaggcttttaaatatattgctttcatttatacaagactattttcatgttcactaattttttaaatcagtggtcagaggaattttttaaatcagtgtacctttggtcagaggaatttaaaaaatcaacgtacatgaaatctatacattctatctataaactaaatctatataatcccaaacaaccaatcaatttgtgcatcttaactacttattttagtaacattttaaggttttaaaataataaaactagtttgtgtttgtaagatataattgacgctaagtcataattggacttctttgtaattctttgtacaaatgtggttcaagtgcctagcacagtatttgagcaaatgaatgcttaatacatgatacatggtagtagtgctaaaagtaatagtggtagtagtatagatcagtggtccccaacctttttggtaccaggggccagttttgtgaaagacaatttttccacgaatggtgggggttgggaggggatggtttcgggatgaaactgttccacctcagatcatcaggcattagattatcattaaagggcactcaacctagatccctcacatgcacagttcacaatagagtgtgcgctcctgtgagaatctaatgctgccgctgatctgaaaggaggcagagctcaggcaatgaggtaatgctcactggcctgctgatcacctcttgctgtccagcctgattcataacaggctacagacctgtaccagtgggtaacccaggcattagcgatacctagtatagatactatattcaactttagtcagaggaatgagcaggtcctgtctcaaagaagctaaaagaactgtgaactcacaaggaaaattaatctaaggatgaagcacagatagtgaaggatatgattactaatattgcaggaacatcaaatgtcaagttcattattcattggctgaattgtcattcacaggtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgat

SEQ ID NO: 4765 - DNA, 8700 bp, human
taagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggtaagatgaggactctccagttttatgctctggtactcctctgtcccttttccccaactccctgacatacagtagaaagccatagcccctcaattgatagggctcggacttacctggccccatgtaagtggctcattcttcctttcctgtacactgtgactccaataactcacttccccgtctcctgcctgtgtagtataagacaaaaatcagactttggtcttagactgtggccagacctctcagttaaggcctctaagataaccatggacagtatcccatgtcacagttcctcgcgcccgctagacctggcccaggttattttgaggtgagccattcccatagccaccttttggcatgggacagccacttcactgcagctggttattttgtgagtctaactaatttcagccttccacaaatctgcctcacagaaagtacccttgaaaaggaggttgggacacagctttttctctcatactttctcttctatagctttttattatggttggggagggacatgaacaaagccttgtggtaataatattctgctccacttagaaattccgtacttgttcggtcaagtatgcaaccaacaatctttcctcatgtagcaaatgctattccttgctattttgaaaagggaagggtattgtgagtcccttcactttttactggagtcagcatttgtccagaaacactccctcttccaaacatttctaaaagctcttgggtcagtccttattttctttcttacaggcggatgttcccctctgttcgggtcaaggtgaaagggttggatccagggaagcagtaccatgtggccatcgatgtggtgccggtggattccaaacgctataggtaatgggccccatagaatggtactctatgcccaggctagggccagggatttggaccttcagacctgaaacctgacagcatgactttgaaaactctagcatggggggtgggagtgggggattgctctcctgtgggctttaggagttgaattttcttattaaaattggggttcccagtgaaagaagagaagccttcttcctctctctgcccccatcccctcttggaatgccgtgaattcagggcactaattagaactccaaatgtaccccaagcctctccctacccactgctctggccttggttgtgtaaactgcagagggtgtgggctctggtggtcagaagggaagcgggttgaaggaattgtgggagaaatccccaggctctatgggagcctgggcatctggggacatgctgggctctgagctttgctgctttggcagcaggaggccagaaggatgatcaatttgccactcaaggtcagtcaagcgttcctgtgtctaggcctgtcttttcgtccatctttaacctttcccctgaagtaatgtctgggtcttagagggtacaagtatcattttccctttatttaagccctcaacctacagcaggctgaaagtggcccaactgttttaaagccaaaaagcccttctgggatacaccccagacacaccagcttgccaacactttgactcaggggcttggggtccagttcagggttggaggggttggggaggtgacagctgtttacactagggctgtgagcatttgacccagaggtgggtccctggtcctccaaggagacagcccacctcaaaaccagagctagctttgaaagcaaggagaaggctctgctcagaggactgctggggctgcagtatggaaacagcagaaaaagctgtttgcttctcaaattgcagctggcttgggaataagagcaaaactgggaagttgagattggaaatagtgtgaaaatcggccagaggctgcgcagggctgtgttcctaagagttttcttgatgtgaagccttattgacaaaagggcttccacaaagagtggtgacagtggcctagacaagacatccttgtcagccctccacttcttcccagactcttcacacccaaagctagtggatttttccattatctctgtgagataaaatttgttagatcaatttctgtggtggtttctgtgagaaaatacaaatcagacttagaaatctcatgacattttactttccctgcacttcattgcattttgatgacatatgcttatttacagtttattttttgccccgaatgcttgttagaaattaagttgagtcttctccttacttgcccttgggatcactgggctaatctggagtgaagtcctcaggaacagaacacaacagctcccagctttggcctgctgcacctaatgccacagcatgtgttttttcaggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacgtacgtgagcacaatcctttaccccgaggagggaggtgccaaggctcctgcccactggtcaccctggagaggccagggaggctttttgcagatgcacatgttgtgttttttaggaactgttcaagccctgcacctgtaagtaaagtagctaacctagggctcctgaaacgtttgtttagcatctgagatgctggcgactggggatggtgaatatagggagtttgaggacagaaggagacctgtttaagccagaatgcctggtctgggagagtaggagggaaccattcagggagttctcaggcaccttagcctccttggcaatcactatgatctctgattgccttcctgtagtccacgcagttggatgggcacccagtgtatggtatgtgtgatggaaggatacaagtgggggaatctcagactgcatcctggaaatctcccaaacaacctaccctcataggtcctattgatcttgcacattctcactaggtgcaccccagcttctgtcctccccagtctggcactgtgccagctacaaaaggaaagagggaagctcccaagattaggaggtagggtatgtcaggttacccaccatatccaagcctatcagttactgccatgggaacttgtagcaggctagcagatcccagtgccacttctacaccagatggtcgccagtgtttgaagcaggaaaaggccccaatctggaaatggaatcactgctgactggtgccgctgaggtgtctttctctggaaatgtttttagctcggagcgcctctgttggaggccaaatggcacaacaaagtagttacctaagcttcatcattgcctttttgtgtgcacatggtggaggtggtcaggagagggaactagggtttgggactgaagccagtttttctaacagcattgatcatttctcctccagatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacaggtaaacttggtcatgtctcaggcgaatggaaatggctccagagggaccttggattagaggcatagaggctaactgccatcaattgcattttccacaattctaaataaaaatcatagttttattgtattgtcatccatgcaagtttgataatgaattgtataaatcttatgggagaaggcaactccagaaggtaatttataaaagtaatgatttataaataggagctaaccattctaaatatgacttgcaatatggttacatttatttaaattgtcatattaacgtgtttcaacatctcttctggtggttgtaaccactataagcaatggcaacagtgttcttactgaaagcaatgactttatctttctctctctattgaatccatagattacgaaactaaaaatagaaagaaatccttttgctaaaggatttagagatactggaagaaacaggtaagcagcatagcaatgacatctaatattgatgtagctagctattttcacaagtttttttttttttttttttcctgagatggagtctcactctgttgcccaggctggagtgcaatggcacgatctcagctcactgcaactttcacctccctggttcaagcaattctcctgcctcagcctcccaagtagctaggattacaggcatgtgccaacaggcctggctaatttttgtatttttagtagagatggggtttcaccatattggtcaggctggtcctgaacacctgacctcgtgatctgcccgcctcagcctcccaaagtgctgggattacaggcgtgagccactgcacctggtcccccacaagttttaaggataagaaaactgactcagagactcaaaagctctaagttttgtaattagtaggtggtaagaaaggaacccagatgttttgtgttgaaaacattacttcctcccactcctttgctactcactattaagaccttgcttattttagaattctaggtttgactgaattttattcagaagtctagctatataaaagagaaatatttaaaatagttacatctgaaagatatagcaaaataactcaaaatcattattttcagaaattgcattctggggatgctgaaagttgactctcttttttaggggtgtattggatgggcttttagagacctacccatggaggccttctttcactctcgattttaaaacctttggcgcagacacacaaagtaagaaaacttggaacgtttgttttatttttacatatcaattaaataacaacatccggaacccttgtaccaaatactacacaaggggatatgtacatgcaagaaaatgtgtacttatgggtaactgcgtgtacatttgcctgaatgacgaggtaagaggcataaagggagagaagctggcatgaaggaagagaatagaaatgtgataattgtagacttattgacatatgttaataagttatcttacaccctgtgattttcagatttcatctggatttttcagcctctcactgtttcacattctttaggatatgcctgtggtgcatttgcagcctgatttgcaaatatgttactattgaaatgaatagtttatcttttatgaggacctttcagtacatgttaaaatgactttcattaaattcatcactgagctctaattttcctcttttttgttcatggggaaagtaaatgttaaaaataatactaagtcttcacaatttaattgccacaagcatttaaaaatatttgcaagatatttatcctcagatggtacattacatgacaaaataataataattaaataatgcaggctttctggtggaaggataccttaatttgctctgatagttaataataaatagaataatttttatttgaaaatgacatggattttttttatccctttgtctttactccatcgaagttgcttgtctttgaccattaattcaaggttacaattgccaagcaaaaccaacattatagttaggttgagttttacatgatgccataacaactaactgaaaagggaagaagtgaagtctaatcatttggtgaaatatttcactggaatggctgtcttgatgtggtttagggaattgcatgaaaaaaaaaacacttattttacagtgtcgatttaactaatagcatctagaaagcatacttttaaatatccaagtcaaaacaaatgtgcactaataaagaaaaagttaaagatgatcatgaaatgataatttaaagtacacagttttcttaattatttaacatatccaaaatgctctcaaattgcaaataaatgagctactagtttcttaaataacttttaaatgctttattataaaagatatttgccatcttgttgatgaaggtttaggatacgtctacatacacaaaatagttaagaaaacagcaacactaaaaaagaaacaacttggtcaaatccagccaataaccaattgtttgaattcagacatttacaaaaataagctttagagtttagcgtttcctggaccttataattatccctagttttagtagatgctaggcaaacataaaaaatcagcaaacgtcattgatatgaacacttacattcatccttatatttcttaacttgcaaaattatttccaactcttaagatataatgcagtatggaaattgccccattcattgtttttgtataagaaaaaaagctaaggcttttaaatatattgctttcatttatacaagactattttcatgttcactaattttttaaatcagtggtcagaggaattttttaaatcagtgtacctttggtcagaggaatttaaaaaatcaacgtacatgaaatctatacattctatctataaactaaatctatataatcccaaacaaccaatcaatttgtgcatcttaactacttattttagtaacattttaaggttttaaaataataaaactagtttgtgtttgtaagatataattgacgctaagtcataattggacttctttgtaattctttgtacaaatgtggttcaagtgcctagcacagtatttgagcaaatgaatgcttaatacatgatacatggtagtagtgctaaaagtaatagtggtagtagtatagatcagtggtccccaacctttttggtaccaggggccagttttgtgaaagacaatttttccacgaatggtgggggttgggaggggatggtttcgggatgaaactgttccacctcagatcatcaggcattagattatcattaaagggcactcaacctagatccctcacatgcacagttcacaatagagtgtgcgctcctgtgagaatctaatgctgccgctgatctgaaaggaggcagagctcaggcaatgaggtaatgctcactggcctgctgatcacctcttgctgtccagcctgattcataacaggctacagacctgtaccagtgggtaacccaggcattagcgatacctagtatagatactatattcaactttagtcagaggaatgagcaggtcctgtctcaaagaagctaaaagaactgtgaactcacaaggaaaattaatctaaggatgaagcacagatagtgaaggatatgattactaatattgcaggaacatcaaatgtcaagttcattattcattggctgaattgtcattcacaggtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 4766 - DNA, 9527 bp, human
caaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggtaagatgaggactctccagttttatgctctggtactcctctgtcccttttccccaactccctgacatacagtagaaagccatagcccctcaattgatagggctcggacttacctggccccatgtaagtggctcattcttcctttcctgtacactgtgactccaataactcacttccccgtctcctgcctgtgtagtataagacaaaaatcagactttggtcttagactgtggccagacctctcagttaaggcctctaagataaccatggacagtatcccatgtcacagttcctcgcgcccgctagacctggcccaggttattttgaggtgagccattcccatagccaccttttggcatgggacagccacttcactgcagctggttattttgtgagtctaactaatttcagccttccacaaatctgcctcacagaaagtacccttgaaaaggaggttgggacacagctttttctctcatactttctcttctatagctttttattatggttggggagggacatgaacaaagccttgtggtaataatattctgctccacttagaaattccgtacttgttcggtcaagtatgcaaccaacaatctttcctcatgtagcaaatgctattccttgctattttgaaaagggaagggtattgtgagtcccttcactttttactggagtcagcatttgtccagaaacactccctcttccaaacatttctaaaagctcttgggtcagtccttattttctttcttacaggcggatgttcccctctgttcgggtcaaggtgaaagggttggatccagggaagcagtaccatgtggccatcgatgtggtgccggtggattccaaacgctataggtaatgggccccatagaatggtactctatgcccaggctagggccagggatttggaccttcagacctgaaacctgacagcatgactttgaaaactctagcatggggggtgggagtgggggattgctctcctgtgggctttaggagttgaattttcttattaaaattggggttcccagtgaaagaagagaagccttcttcctctctctgcccccatcccctcttggaatgccgtgaattcagggcactaattagaactccaaatgtaccccaagcctctccctacccactgctctggccttggttgtgtaaactgcagagggtgtgggctctggtggtcagaagggaagcgggttgaaggaattgtgggagaaatccccaggctctatgggagcctgggcatctggggacatgctgggctctgagctttgctgctttggcagcaggaggccagaaggatgatcaatttgccactcaaggtcagtcaagcgttcctgtgtctaggcctgtcttttcgtccatctttaacctttcccctgaagtaatgtctgggtcttagagggtacaagtatcattttccctttatttaagccctcaacctacagcaggctgaaagtggcccaactgttttaaagccaaaaagcccttctgggatacaccccagacacaccagcttgccaacactttgactcaggggcttggggtccagttcagggttggaggggttggggaggtgacagctgtttacactagggctgtgagcatttgacccagaggtgggtccctggtcctccaaggagacagcccacctcaaaaccagagctagctttgaaagcaaggagaaggctctgctcagaggactgctggggctgcagtatggaaacagcagaaaaagctgtttgcttctcaaattgcagctggcttgggaataagagcaaaactgggaagttgagattggaaatagtgtgaaaatcggccagaggctgcgcagggctgtgttcctaagagttttcttgatgtgaagccttattgacaaaagggcttccacaaagagtggtgacagtggcctagacaagacatccttgtcagccctccacttcttcccagactcttcacacccaaagctagtggatttttccattatctctgtgagataaaatttgttagatcaatttctgtggtggtttctgtgagaaaatacaaatcagacttagaaatctcatgacattttactttccctgcacttcattgcattttgatgacatatgcttatttacagtttattttttgccccgaatgcttgttagaaattaagttgagtcttctccttacttgcccttgggatcactgggctaatctggagtgaagtcctcaggaacagaacacaacagctcccagctttggcctgctgcacctaatgccacagcatgtgttttttcaggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacgtacgtgagcacaatcctttaccccgaggagggaggtgccaaggctcctgcccactggtcaccctggagaggccagggaggctttttgcagatgcacatgttgtgttttttaggaactgttcaagccctgcacctgtaagtaaagtagctaacctagggctcctgaaacgtttgtttagcatctgagatgctggcgactggggatggtgaatatagggagtttgaggacagaaggagacctgtttaagccagaatgcctggtctgggagagtaggagggaaccattcagggagttctcaggcaccttagcctccttggcaatcactatgatctctgattgccttcctgtagtccacgcagttggatgggcacccagtgtatggtatgtgtgatggaaggatacaagtgggggaatctcagactgcatcctggaaatctcccaaacaacctaccctcataggtcctattgatcttgcacattctcactaggtgcaccccagcttctgtcctccccagtctggcactgtgccagctacaaaaggaaagagggaagctcccaagattaggaggtagggtatgtcaggttacccaccatatccaagcctatcagttactgccatgggaacttgtagcaggctagcagatcccagtgccacttctacaccagatggtcgccagtgtttgaagcaggaaaaggccccaatctggaaatggaatcactgctgactggtgccgctgaggtgtctttctctggaaatgtttttagctcggagcgcctctgttggaggccaaatggcacaacaaagtagttacctaagcttcatcattgcctttttgtgtgcacatggtggaggtggtcaggagagggaactagggtttgggactgaagccagtttttctaacagcattgatcatttctcctccagatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacaggtaaacttggtcatgtctcaggcgaatggaaatggctccagagggaccttggattagaggcatagaggctaactgccatcaattgcattttccacaattctaaataaaaatcatagttttattgtattgtcatccatgcaagtttgataatgaattgtataaatcttatgggagaaggcaactccagaaggtaatttataaaagtaatgatttataaataggagctaaccattctaaatatgacttgcaatatggttacatttatttaaattgtcatattaacgtgtttcaacatctcttctggtggttgtaaccactataagcaatggcaacagtgttcttactgaaagcaatgactttatctttctctctctattgaatccatagattacgaaactaaaaatagaaagaaatccttttgctaaaggatttagagatactggaagaaacaggtaagcagcatagcaatgacatctaatattgatgtagctagctattttcacaagtttttttttttttttttttcctgagatggagtctcactctgttgcccaggctggagtgcaatggcacgatctcagctcactgcaactttcacctccctggttcaagcaattctcctgcctcagcctcccaagtagctaggattacaggcatgtgccaacaggcctggctaatttttgtatttttagtagagatggggtttcaccatattggtcaggctggtcctgaacacctgacctcgtgatctgcccgcctcagcctcccaaagtgctgggattacaggcgtgagccactgcacctggtcccccacaagttttaaggataagaaaactgactcagagactcaaaagctctaagttttgtaattagtaggtggtaagaaaggaacccagatgttttgtgttgaaaacattacttcctcccactcctttgctactcactattaagaccttgcttattttagaattctaggtttgactgaattttattcagaagtctagctatataaaagagaaatatttaaaatagttacatctgaaagatatagcaaaataactcaaaatcattattttcagaaattgcattctggggatgctgaaagttgactctcttttttaggggtgtattggatgggcttttagagacctacccatggaggccttctttcactctcgattttaaaacctttggcgcagacacacaaagtaagaaaacttggaacgtttgttttatttttacatatcaattaaataacaacatccggaacccttgtaccaaatactacacaaggggatatgtacatgcaagaaaatgtgtacttatgggtaactgcgtgtacatttgcctgaatgacgaggtaagaggcataaagggagagaagctggcatgaaggaagagaatagaaatgtgataattgtagacttattgacatatgttaataagttatcttacaccctgtgattttcagatttcatctggatttttcagcctctcactgtttcacattctttaggatatgcctgtggtgcatttgcagcctgatttgcaaatatgttactattgaaatgaatagtttatcttttatgaggacctttcagtacatgttaaaatgactttcattaaattcatcactgagctctaattttcctcttttttgttcatggggaaagtaaatgttaaaaataatactaagtcttcacaatttaattgccacaagcatttaaaaatatttgcaagatatttatcctcagatggtacattacatgacaaaataataataattaaataatgcaggctttctggtggaaggataccttaatttgctctgatagttaataataaatagaataatttttatttgaaaatgacatggattttttttatccctttgtctttactccatcgaagttgcttgtctttgaccattaattcaaggttacaattgccaagcaaaaccaacattatagttaggttgagttttacatgatgccataacaactaactgaaaagggaagaagtgaagtctaatcatttggtgaaatatttcactggaatggctgtcttgatgtggtttagggaattgcatgaaaaaaaaaacacttattttacagtgtcgatttaactaatagcatctagaaagcatacttttaaatatccaagtcaaaacaaatgtgcactaataaagaaaaagttaaagatgatcatgaaatgataatttaaagtacacagttttcttaattatttaacatatccaaaatgctctcaaattgcaaataaatgagctactagtttcttaaataacttttaaatgctttattataaaagatatttgccatcttgttgatgaaggtttaggatacgtctacatacacaaaatagttaagaaaacagcaacactaaaaaagaaacaacttggtcaaatccagccaataaccaattgtttgaattcagacatttacaaaaataagctttagagtttagcgtttcctggaccttataattatccctagttttagtagatgctaggcaaacataaaaaatcagcaaacgtcattgatatgaacacttacattcatccttatatttcttaacttgcaaaattatttccaactcttaagatataatgcagtatggaaattgccccattcattgtttttgtataagaaaaaaagctaaggcttttaaatatattgctttcatttatacaagactattttcatgttcactaattttttaaatcagtggtcagaggaattttttaaatcagtgtacctttggtcagaggaatttaaaaaatcaacgtacatgaaatctatacattctatctataaactaaatctatataatcccaaacaaccaatcaatttgtgcatcttaactacttattttagtaacattttaaggttttaaaataataaaactagtttgtgtttgtaagatataattgacgctaagtcataattggacttctttgtaattctttgtacaaatgtggttcaagtgcctagcacagtatttgagcaaatgaatgcttaatacatgatacatggtagtagtgctaaaagtaatagtggtagtagtatagatcagtggtccccaacctttttggtaccaggggccagttttgtgaaagacaatttttccacgaatggtgggggttgggaggggatggtttcgggatgaaactgttccacctcagatcatcaggcattagattatcattaaagggcactcaacctagatccctcacatgcacagttcacaatagagtgtgcgctcctgtgagaatctaatgctgccgctgatctgaaaggaggcagagctcaggcaatgaggtaatgctcactggcctgctgatcacctcttgctgtccagcctgattcataacaggctacagacctgtaccagtgggtaacccaggcattagcgatacctagtatagatactatattcaactttagtcagaggaatgagcaggtcctgtctcaaagaagctaaaagaactgtgaactcacaaggaaaattaatctaaggatgaagcacagatagtgaaggatatgattactaatattgcaggaacatcaaatgtcaagttcattattcattggctgaattgtcattcacaggtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 4767 - DNA, 17013 bp, human
ttctctgggctcttgagaagagctgctgcaggcatttgcagagtgaatgagctctgactgagacttgacttcagaaccactgggctggcctggcctcttgacacagcaacacactgcttcttgccttccaggtaaatacctctgccttactgaccatgttatgggttttagtgggacatcagtacagggattctcctcagcctcttcctctcctgttaactatcactaaccaagtccctaacattaggaaagtccaactgataactgtcagtttcatctttcattaactgggggttttgtgacagagatcttgcaatcactacttctcgggggactggaagtagaatattagtgctctttaaaattaatgaaggctagacttgtccagtctgttaagagtatgctgtaatacccaaagaagccagcaatagtccctctcctaggcagcaatgcagccagaaggctcccaggcccaggatactatgcattagtgctcacagatcttgtttagggagctagggagcaaggggaagggacgggagtgcctcctggaaggtgaggactgaagccaacgtggaagtcactgagctgagtggcaggtgtctaacactgaaaagtggccctagccaagggctctaagtagtggtactttctaccgaggctcttccccaaggagctctagatccacagaggcagaaggattatttgatcttctttgcactcatttgatttcaggaggaggtctgaagtcccaaagcatgggcattggggtgagagagggaacatcaaagtgtgccaaaaaagattgttttattttacttattcctgatttttcttaccagagcttgagctcatacaccgcattgtaacacaaacacacaagcacacataccacacacacacacatgccttcaaactagagaaggggactacagaaagcacctggccataaaaggcatgtcaaggagtttgctgtagggtggtgatatggttgctttgtttcagttcagcagacttatctccatgaagaccttattgttttctgtgatttctcttttgtattttttaaaatttgtctttatttcttaattattaaaaccttcccttttgcccctcggagcattgatcagggtttactaactacaaatatttacttcatgaaggagcagttttttctctagtaatattaatgtggggaccctgggaaggaagacagtgtatgaaagaaggcatagattggcttcaagcacaggcagtataggtgtttgcctatatttggtgttttgatagacttagggaaaatccctcagcctactaccaaatatttttgagtgtcagtacatctgtggttgttaggtattgaaaagccctgattaaatacagataattatgagaatatggaaagaagcctttagtaccttattcgcatgtcctaggaatgatgaggtagggtgccaagttaagaagaggaaaatatattgtaaatatccaggagtaagtaaatagtgaaaagattagcacgagatttggtgggcccaatggagttcaggatgatttctttcttaacagaaggatctgcttctgttgggctcatggctgcccaaattaggcagagccagatgatgactcactgatctgagaactgagtggagtcatttggtgagaaagcgtgtgtaggggaagagggtgtaaagcaagcatttttctagttttaggaagataaaataattcctcataaacagtattttttttcaataattcattgatgcaattaacttggcatatctccgttcaagtgatctgagccagtgatattttgctatatgtctgaattatttattttaaaatatcaaactggcacctgcagtcatttttcaaatcctagcccactttctttgaggctgatgcatatagcatatttggaggtaactctgactctcatcctcatttttaaaaaggcagcatgatgccaggtgcggtggctcaagcctgtaatcccagcactttgggaggctgaggcaggcagatcacctgaggtcaggagttcaagaccagcctggccaacatggtgaaaccccgtctctactaaaaatacaaaaattagttgggcgtggttgaacacgcctgtaatcccagctactcaggaggctgaggcaggagaatcacctgaagctggggggcagaggttgcagtgagctgagattgtgccattgcactccagcctgggcaacagagggagattctgtctcaaaaaaaaaaaaaaaaaaaagcatgaaaaaaaacaaagaaaaggaaagaggaaagatgggggtggagtaggtaaaagaaatgtataaggcataatacccaagttaaaatgacctaacctaaaaattcacatagcacaaactctacccatgaaaaaatattatgtccagcagtcctgattgagccttcagttaatatatgactgtgcaagtgccaatggagcaccagagaggtaacataaaaaggaataggtttgacactagtttggtgttgtttttgtgtgtgtgtgtgtgtgtgtgtgtgtgtgtgtgtgttttctttaattttgttcattaggttttgtagagacaggatcttgctatgttgcccaggatgatctcgaactcctggactcaagctatccttttccctcagcctcccaaagcactgagattacaagtgtgagcccatatacctggccttaagctcaatgttttaatggagagtgtttgaggactaaaagagacaggatgcatttataattatttattattttcactgctccaggaagtcaaagacagctgaaaggtgaccatacaatgcctcttctggcaattactagaatcaccatagggtagaattacatttggactttcaaaaaggttttttctttttcgtttattcatttatcctgctcaaaattagccacgtacaaaattgtccccataattctggtggcaaatttcctaggaaatttttaaaaattctatcgaccttaggttattaattcagtgaagaaataagaaaaagtagttgtatgcctttgatatacttcagttagaatgagaaatacaatgaactgaagcctaatgttgtaattattatcataggaaggccttcaccatttgatagcagtatgaacacatgattaaattcaacagaatgcattttcctgtagctaaagtttttgcaagcatgagcatttcgcttccaatcctccccatgagaagaacacagcgaacacagataagaatttgtatctctactttttcttcccctactctaccaaggagcaagagtaacaaagtttgacatgcataactcaagactagatgaataaaagcacagtcttcttgagagattatattgaattaagctaaccagaagttgagggattcagtgtgagaattactttaatattaattaggccacatccctcaatttcctgaagtgagaacacagctacgagttagggtcttgtcattaacacattttatctaatcatataagaacatacacttacattgcattggtaaataccaaagatatatttccaaggatgaacttgataaaaacaggtcatgtattctagaagacatgtttcctatggatttttgaaattcaaatgtaatcttttggtttaattcactaattttatttattaaaatagtatttgaatttcttaaaaaaaaaggtggctttcctaaagactttcaaccttttgaatctgctttaggatttagccaaaagttgggggttccagtgttgatcccaaagttttccccttcgagtgtttcgcctcaaagaattcacagctgtatagttgatagaaagattagcacattcttgaaattaactcccatcatctctttaattttgaaaacatctgtgagtgcttactatgttccaggctttgtcctaagtggtttgcatgttttcttctctttttactaaactctcagatatataaacacacttacagaaacatactctatgataggagtgttagaaataatagctttaaatggttaaaacaaagaactgaatgcaaaaaaaagacttgtgtaaggtcattcagatagaaagtagagtcagaatttgaatcaggtcagtctgaatctaaagtctgtcttcttacatgctgtactgcttgagccttattcctatttattatcatagcctgaagaattcatgtagaaagtaaaatttagtcaataacataattttcctattctcataaccagtagtattgaaaaaggagaagaggtaggaagaaagaaaactagaagaagaaagtgatcttccaaattttatcaagatgagtgtatttgtcaagactcttttgtctacaagtaatggaaacccagctgaagctcacttaagcaaacaacgataatttatttcttcatgtcacttagctagtgcaggcaaagttgaattcaggtactcaaatgatgttgtggggaagctgattacatttcctgactctgctttcattaaagtgttcattagagtgttcattctaaggaggtctttcccaagtaatgacaaaaaaaaaaggccatgagtagcttgtttcagattcatgttccacaagcttggaactatgccaaaatatcttaatcatggggagtgggcaattcaaaaccaacattttactgtaaggattttcctattatcaaacttaaaaaacatattcttctttctattgtgggcatctgtgggtctcagaaacctccacatgtttcgctgcccctccattgttgaagagtctcttataaaggtttatgggtgttcatggatgaaatatagagatgccccaaagagacttccaggtgtggagaatgaattgctggcattagtacatgcgcctcaggcccccaatacctgacagcccagtgcttcagcagctgaccagactgcaaagctagttatgagataatgcaatattttccccctcagatacaagttaacaggaattaactatattttagtctagtacatacaagggagagctaagctacatatctcccagtgatgtcaacagatatatacagaaatgggaatggaaaaagttcagattacaaaaataaaaaaattctggatgactaaattacatgcatgtaataaatattaagaaagaagtttcttctaagaaagaaacttacacccaagatatgctattttcttgatttcaaaatatcacatcatatgttaggtagtctaaaatactagcacagacattgcaacaaacatcttttgctttatttttacaaaaatctatttaaaaaaaaagataccaagcaaagttgtccctttctatacaaggtaacgtcctgccttttaacaataaattgagctaaggttaaaggcaagacaacacctgtattaggagatactaacacaaatattacatggtaataattgcactctaaaattaacaaataaactcgacttttctgttttttagttgtgtattttagctaagagcatgcaataaataaaatatagatagatagagatagattagatagatagatagatagatagatagatgatacatatagatagatagacagatagatagatagatcttctgagtaagaggaaatgaacaaacactctccccccactttaatgggtgcgaaaagaaacgaatgctcagatcacatgcagatgtggctgttttccagcccaagttccttacacgaaattggccttacctgtgaggttcactttgcctgtctaggatagggacagtgtctttctcaattctgcatggtgagcagtggctaaataatgattgagccaaacccttcagcagcattcaagctgtaagtaactctttgccatactgagatttttagagtgtttaaagtcatacccagttgcctgaagatctcctccctatggctgaatatccccctaccaccaccactaccactgccatcacagtggcagggcacatttgtacctaagtagctgaaattaaaaggacacacaggtcttttactctcagattccagtattggcatattataagttatttcaagttgcatcttattttaaatgaacttggatcagctttaaatgccctttttacaaatgtgtcagaggagaataatataatttttctggaaaaatgcaaatgctattagttaagatgcaacctgcaaaagaatccaggggcacttgatttcttatttctgatgaaaagtaggagaccaaatcatatgcacacaggcagacatctcatatctgcatacgtaaacatgctctttggatgttgtagacaagtctcttcctgaaaaaaaaagaaacttgtatattcattttaaggaaaagtaaaatccagcccaagaatatattccaggagacactggaatcaattacttaatccgaacattttgagttgtgcacattcttgggagcaaaggcccttttgttgccctgctggtggacctggagtttttagactgtgtttgctgattaagtactgtgagaaaaaacaaagactatgtataggaatattgggctccagcagaggcagggcttgaagatccaagttttctctgatgcttgacagtggcattgggagactcctgcctgccctcacctcactaacagaagagagcggataaactggcacaactgctgctcacctaatttgagactccaactgcagagccaactggccccaaaagcttgtactcctttctgtttcccagtgccttcactggagagcaaaagaccctgatacatctctccggatctgcttaaagtggtccctcgtgggcaattatttcgcatgtctttgagttttataatttaatgtaaagctgtaacctgtatctcccttttctcctctctctacttccctatctatagctttttttcaacaagctccaaaacccccctccctgttagactctgaagtgtcactcactgtgttttttatgcttccaatagtttccaaaacaaacagtggaggcagtgaccggctgggtattcactggatgcaacagtaactcccaatccgagcaacctgagccgccattggcggcaggtctgctccctaaaaggccagcacttgccaatctctgctctgccaggtcctggaatcagggatttgaggactaatggtctgcacatgtgcactgggaggaagggagactagactttgaaggacatatacactagtttgatcttcctctcctttcattttgtctattcaaacaaaaaatatatatgtatataaaaaaattacacacacacacacacacacacacacacacacacacacacaattattttctttgaatacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggtaagatgaggactctccagttttatgctctggtactcctctgtcccttttccccaactccctgacatacagtagaaagccatagcccctcaattgatagggctcggacttacctggccccatgtaagtggctcattcttcctttcctgtacactgtgactccaataactcacttccccgtctcctgcctgtgtagtataagacaaaaatcagactttggtcttagactgtggccagacctctcagttaaggcctctaagataaccatggacagtatcccatgtcacagttcctcgcgcccgctagacctggcccaggttattttgaggtgagccattcccatagccaccttttggcatgggacagccacttcactgcagctggttattttgtgagtctaactaatttcagccttccacaaatctgcctcacagaaagtacccttgaaaaggaggttgggacacagctttttctctcatactttctcttctatagctttttattatggttggggagggacatgaacaaagccttgtggtaataatattctgctccacttagaaattccgtacttgttcggtcaagtatgcaaccaacaatctttcctcatgtagcaaatgctattccttgctattttgaaaagggaagggtattgtgagtcccttcactttttactggagtcagcatttgtccagaaacactccctcttccaaacatttctaaaagctcttgggtcagtccttattttctttcttacaggcggatgttcccctctgttcgggtcaaggtgaaagggttggatccagggaagcagtaccatgtggccatcgatgtggtgccggtggattccaaacgctataggtaatgggccccatagaatggtactctatgcccaggctagggccagggatttggaccttcagacctgaaacctgacagcatgactttgaaaactctagcatggggggtgggagtgggggattgctctcctgtgggctttaggagttgaattttcttattaaaattggggttcccagtgaaagaagagaagccttcttcctctctctgcccccatcccctcttggaatgccgtgaattcagggcactaattagaactccaaatgtaccccaagcctctccctacccactgctctggccttggttgtgtaaactgcagagggtgtgggctctggtggtcagaagggaagcgggttgaaggaattgtgggagaaatccccaggctctatgggagcctgggcatctggggacatgctgggctctgagctttgctgctttggcagcaggaggccagaaggatgatcaatttgccactcaaggtcagtcaagcgttcctgtgtctaggcctgtcttttcgtccatctttaacctttcccctgaagtaatgtctgggtcttagagggtacaagtatcattttccctttatttaagccctcaacctacagcaggctgaaagtggcccaactgttttaaagccaaaaagcccttctgggatacaccccagacacaccagcttgccaacactttgactcaggggcttggggtccagttcagggttggaggggttggggaggtgacagctgtttacactagggctgtgagcatttgacccagaggtgggtccctggtcctccaaggagacagcccacctcaaaaccagagctagctttgaaagcaaggagaaggctctgctcagaggactgctggggctgcagtatggaaacagcagaaaaagctgtttgcttctcaaattgcagctggcttgggaataagagcaaaactgggaagttgagattggaaatagtgtgaaaatcggccagaggctgcgcagggctgtgttcctaagagttttcttgatgtgaagccttattgacaaaagggcttccacaaagagtggtgacagtggcctagacaagacatccttgtcagccctccacttcttcccagactcttcacacccaaagctagtggatttttccattatctctgtgagataaaatttgttagatcaatttctgtggtggtttctgtgagaaaatacaaatcagacttagaaatctcatgacattttactttccctgcacttcattgcattttgatgacatatgcttatttacagtttattttttgccccgaatgcttgttagaaattaagttgagtcttctccttacttgcccttgggatcactgggctaatctggagtgaagtcctcaggaacagaacacaacagctcccagctttggcctgctgcacctaatgccacagcatgtgttttttcaggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacgtacgtgagcacaatcctttaccccgaggagggaggtgccaaggctcctgcccactggtcaccctggagaggccagggaggctttttgcagatgcacatgttgtgttttttaggaactgttcaagccctgcacctgtaagtaaagtagctaacctagggctcctgaaacgtttgtttagcatctgagatgctggcgactggggatggtgaatatagggagtttgaggacagaaggagacctgtttaagccagaatgcctggtctgggagagtaggagggaaccattcagggagttctcaggcaccttagcctccttggcaatcactatgatctctgattgccttcctgtagtccacgcagttggatgggcacccagtgtatggtatgtgtgatggaaggatacaagtgggggaatctcagactgcatcctggaaatctcccaaacaacctaccctcataggtcctattgatcttgcacattctcactaggtgcaccccagcttctgtcctccccagtctggcactgtgccagctacaaaaggaaagagggaagctcccaagattaggaggtagggtatgtcaggttacccaccatatccaagcctatcagttactgccatgggaacttgtagcaggctagcagatcccagtgccacttctacaccagatggtcgccagtgtttgaagcaggaaaaggccccaatctggaaatggaatcactgctgactggtgccgctgaggtgtctttctctggaaatgtttttagctcggagcgcctctgttggaggccaaatggcacaacaaagtagttacctaagcttcatcattgcctttttgtgtgcacatggtggaggtggtcaggagagggaactagggtttgggactgaagccagtttttctaacagcattgatcatttctcctccagatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacaggtaaacttggtcatgtctcaggcgaatggaaatggctccagagggaccttggattagaggcatagaggctaactgccatcaattgcattttccacaattctaaataaaaatcatagttttattgtattgtcatccatgcaagtttgataatgaattgtataaatcttatgggagaaggcaactccagaaggtaatttataaaagtaatgatttataaataggagctaaccattctaaatatgacttgcaatatggttacatttatttaaattgtcatattaacgtgtttcaacatctcttctggtggttgtaaccactataagcaatggcaacagtgttcttactgaaagcaatgactttatctttctctctctattgaatccatagattacgaaactaaaaatagaaagaaatccttttgctaaaggatttagagatactggaagaaacaggtaagcagcatagcaatgacatctaatattgatgtagctagctattttcacaagtttttttttttttttttttcctgagatggagtctcactctgttgcccaggctggagtgcaatggcacgatctcagctcactgcaactttcacctccctggttcaagcaattctcctgcctcagcctcccaagtagctaggattacaggcatgtgccaacaggcctggctaatttttgtatttttagtagagatggggtttcaccatattggtcaggctggtcctgaacacctgacctcgtgatctgcccgcctcagcctcccaaagtgctgggattacaggcgtgagccactgcacctggtcccccacaagttttaaggataagaaaactgactcagagactcaaaagctctaagttttgtaattagtaggtggtaagaaaggaacccagatgttttgtgttgaaaacattacttcctcccactcctttgctactcactattaagaccttgcttattttagaattctaggtttgactgaattttattcagaagtctagctatataaaagagaaatatttaaaatagttacatctgaaagatatagcaaaataactcaaaatcattattttcagaaattgcattctggggatgctgaaagttgactctcttttttaggggtgtattggatgggcttttagagacctacccatggaggccttctttcactctcgattttaaaacctttggcgcagacacacaaagtaagaaaacttggaacgtttgttttatttttacatatcaattaaataacaacatccggaacccttgtaccaaatactacacaaggggatatgtacatgcaagaaaatgtgtacttatgggtaactgcgtgtacatttgcctgaatgacgaggtaagaggcataaagggagagaagctggcatgaaggaagagaatagaaatgtgataattgtagacttattgacatatgttaataagttatcttacaccctgtgattttcagatttcatctggatttttcagcctctcactgtttcacattctttaggatatgcctgtggtgcatttgcagcctgatttgcaaatatgttactattgaaatgaatagtttatcttttatgaggacctttcagtacatgttaaaatgactttcattaaattcatcactgagctctaattttcctcttttttgttcatggggaaagtaaatgttaaaaataatactaagtcttcacaatttaattgccacaagcatttaaaaatatttgcaagatatttatcctcagatggtacattacatgacaaaataataataattaaataatgcaggctttctggtggaaggataccttaatttgctctgatagttaataataaatagaataatttttatttgaaaatgacatggattttttttatccctttgtctttactccatcgaagttgcttgtctttgaccattaattcaaggttacaattgccaagcaaaaccaacattatagttaggttgagttttacatgatgccataacaactaactgaaaagggaagaagtgaagtctaatcatttggtgaaatatttcactggaatggctgtcttgatgtggtttagggaattgcatgaaaaaaaaaacacttattttacagtgtcgatttaactaatagcatctagaaagcatacttttaaatatccaagtcaaaacaaatgtgcactaataaagaaaaagttaaagatgatcatgaaatgataatttaaagtacacagttttcttaattatttaacatatccaaaatgctctcaaattgcaaataaatgagctactagtttcttaaataacttttaaatgctttattataaaagatatttgccatcttgttgatgaaggtttaggatacgtctacatacacaaaatagttaagaaaacagcaacactaaaaaagaaacaacttggtcaaatccagccaataaccaattgtttgaattcagacatttacaaaaataagctttagagtttagcgtttcctggaccttataattatccctagttttagtagatgctaggcaaacataaaaaatcagcaaacgtcattgatatgaacacttacattcatccttatatttcttaacttgcaaaattatttccaactcttaagatataatgcagtatggaaattgccccattcattgtttttgtataagaaaaaaagctaaggcttttaaatatattgctttcatttatacaagactattttcatgttcactaattttttaaatcagtggtcagaggaattttttaaatcagtgtacctttggtcagaggaatttaaaaaatcaacgtacatgaaatctatacattctatctataaactaaatctatataatcccaaacaaccaatcaatttgtgcatcttaactacttattttagtaacattttaaggttttaaaataataaaactagtttgtgtttgtaagatataattgacgctaagtcataattggacttctttgtaattctttgtacaaatgtggttcaagtgcctagcacagtatttgagcaaatgaatgcttaatacatgatacatggtagtagtgctaaaagtaatagtggtagtagtatagatcagtggtccccaacctttttggtaccaggggccagttttgtgaaagacaatttttccacgaatggtgggggttgggaggggatggtttcgggatgaaactgttccacctcagatcatcaggcattagattatcattaaagggcactcaacctagatccctcacatgcacagttcacaatagagtgtgcgctcctgtgagaatctaatgctgccgctgatctgaaaggaggcagagctcaggcaatgaggtaatgctcactggcctgctgatcacctcttgctgtccagcctgattcataacaggctacagacctgtaccagtgggtaacccaggcattagcgatacctagtatagatactatattcaactttagtcagaggaatgagcaggtcctgtctcaaagaagctaaaagaactgtgaactcacaaggaaaattaatctaaggatgaagcacagatagtgaaggatatgattactaatattgcaggaacatcaaatgtcaagttcattattcattggctgaattgtcattcacaggtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 4768 - DNA, 138180 bp, human
gcaacgtacaggcaggggaaatgtctcttccaaggttgtaagtcctctttttaatatttttttagtattttaaatagccaatatgctcaatttagttacaaatgtatatgtttaactgtaaagaatgtttctttcatagtcgttttatttatgaattagaacttgtattttaaacagagatatgaaattttcaataatatcttagatgttttgctttgaaatttcactagtgcagtcttgtttacaaaatacctgcgaatcttgactgtttgatctctctgagtctcagtttcttataactacatcttgttttaggaatcatggaaagaataaacttatgtgaaagcactttaaaatgtaaagcaggatacaatgtagtaagactttgtatgctagtttggtaaacttaattgtatgtgtaggcaaaattagaccattctatttttctgataaatacattattatgtccaagaaagtgcagtaagtttattttttaaagacttcattaagtagaagataaagtattattcatatggaattaaacagttttctgaagtctttagttgctgtagtgttgttttttattttaaaagtcaatttcctcttaaagaatatttctgaaagtagtttaaaaattaagataatgtaagccatgctaacttacacctaccagataatatcccatatatattaaattgaactatatgagattgcttatattaaactattttgacctacaaaaatggaaatttctcatggtacaacctaataaaaaacacttgtaaagtctatgaaaaaaattcaattaatgtggaataaaaatatgggtatatgaccaggcaatttataggaaaaaatcttaattgccagtaaactttaaaaagtgcacaaattcgaaataaaaagaaaatttagaaaatatttcactcagaaattcaaattttggagaattattccctagaaaggaattgcagacattttccctctttaaatgatacatgtctgtaatgttcatatttttttctattagtgtgtattacttttagaaaatgaaaattcaataagtttgaaagaaagaaaaagagtgggccgggcactgtggctcacgcctgtaatcccagcactttgggaggccgaggcgggtggatcacgaagtcaggagatcgagaccatcctggcgaacacggtgaaaccccgtctctactaaaaatacaaaaaaaaaaaaaaaaaatcagccgggcgtggtggcaggcgcctgtagtcccagctactcgggaggctgaggcaggagaatggcatgaacctggggggcggagcttgcagtgagcagagatcgcgccactgcactcccgcctgggcgacagagcgagactccgtctcaaaaaaaaagaaaagaaaagaaaagaaaaagagtgatttgatctagaaattaaaattgagctccccaaagtgagcgtctcaaatcactagcgcttttacaaagacatttctaatttgattctgcctacatctgatcttccctcttagatcacaaagaccttaggtttatgtcaccattaggcattatctctttgaaactcactgtcatcagcaacaccctctatgtcctcctctgactccaatctgaatgataactctgtcctcttgctgtatctgaaacccaactctctctcaaattcattgcttttcctgcagccttcaagagggggtgatgttttccttcctacatcctctcctaccactgaacccaaaaatgcaataaagtctgctttattcctcaatgctatttccaggtcattctcctttcttacttccaaaaatagccaactttgaatctcatgtcatcaacttatatcacctgtgacctttccttgtattcatcacctgactcctagtactctacttcattttgtgatgattttccgtctggctatcactttctccaaaagtacctttgtcttaattcctagtaattttactattaggtgatcaatctcatatctaacattttaattatttgactttctcttctccagttattttgtcttacatcctactttagtggtttactactgcacatatccctccaaaatctcaaattcaaacatttcactctccaactgatatgtcaggtacctctaataaccccattccaacaactctacctctaagactgatcattgattctactaccttttccctgttccttgctaatgacctttctgtggcttttcttctgttgcccaccataaatccttacctatcttagatttttacaggctcatggtgaattagcacaaatatttccttgcatacatcctcagttccctttatcccactctattttttgacatctttgctgaaaaaaacacttaatttttagtaaatttaaacctctaatcatgccacacacctttgcaagataaatgagcatgagaaaaaaaatgtgtaaccataataattatcttcaatttaaatataaaatgacaaacttcaagtgggccattaatgctacctggcaattacatttctccaccagaaaatataatagtctgcattcatctttaccccaacaccacaccttcagtcctgttagagcagatgctttcttcttgctgcatttaactcctctaactgggcatgctagtttcctaaggctactgtaagaaactaccagaaactgattggctaaaaccatcatatattgtctcacaattctggagactacgagtccaagatcaaggtgtcagcaggattggtttactccagaggttctaagggagactctgttccgtgcctctctctcctagtctgactgttcctggtattgtgtggcttgtagatgcattacaccaatatctgccttcatcatcacatggcatccacgttttgtctatgtctgtttctccctttgttcttataagaaaaagatttccttttcttataagaacactagtcacttagattagggcacaacttaattcagtatgatctcatctttatttgattacatctgcaaagatccaattccaaataaagtaatattcacaagtaccagatgttagaacttaaatataaatttgggggacataattcgactcataacacaggattggattttgttcactatttatgcatatagcttttttgttaactcatattcttccatatcatcattttttcttaactctttgtagattttgtcccatcagtgttcaaaaaaagtagtaactcctaccacttaaaaatcccttttccacttaaaaaatcccttttccttcacagcctcttccagctcccaccccattttctgtcagctttatatagaaaaacttcccaaaataattattcatattatctctacttccttttctccaattaacaatctctttttaaactagattttaattgaaaaattgaatgcatatatatggtggataattcaaaaagaacaaaaggagagttggcaaaattcattctcctatactagattcccagacccattactggagataatcactattactagtttcttttctctcccaaacttatttcagatttttgtccttaccattccatggaatggctttcacatttacaattccactagcagcacttgatacaactgagccccttcatgaaatattcttctcttggttatcatgtcactctgctttcttggttttccttctatcatattatctattccttctcagcttctgttgctggtttctctttacctcttcagtctttaaatgttgaatagcctaaaaacttagatcttggacctctttttttcttatctgcacacatttagtatacaatatcatccattccaatgattttatatgccatctaaatgctgatgaattctaaatttatatctctgttccagaccacacctctaattttcagatttatatgtacaactaatttattgacaattccactttgatgtgtaatagatatctcaaacttaatatgtgcaaaacaaaattcttgttttataccccttctaaacctgctcatccataagtattctgcatctcagaaattggcactactattcactcagttgtttaagcaaacataaacatgcatacacacacacacacacacgcaccaacatagctttggcatcatcctcgattgccctctttctctagcagtgaacatccagtacatcaccaaatcctatagggcttacctttaaaatatatctagaatttagtctcaacatcagttctgccaccaactctaaaccattttgatctcttatttagattattgcaaaaacctctgtgcatgttaccttgattagtttcatattgcctctgtaacaaattaccatatactttgtggattcaaatgatagaaatttaatctcttacatttctggaagacataagtacaaaatgagtcattcagagctaaaatcaagttattggaagggctgattctttctgaaggcatcagaagctattgtattccttgccttttttagcttcttgtggctgctagcatgtcttggtttttgactgcatcattctaatctctgcaatgttgtcatattgcatttcttctgtaatcaaatcttcttttacctatttcttatatgcacaattgtcataacactgaggacccacctggataatctaagattttaatcgcacctgcaaattgtcatttgccatgtacggtaagattcaaaacttccagggattagaaaattgtatctttagggtatattattcagcctaccacagtctgtcttgaaccccaaatattcatgtctatcccacatgcaaatacagtcactcaaaactaaactaacatctacaaaactatcacctcatttcggtattaactcaagtccaacatcatatccaaatatcatcagctctaaagtcccagttgctatagtgtaaatcatctaaatcagatatagtgagattctgtaagtgttccatcctggggtgaaattaccctatatctgtagaactgtaaaattaaaaaacacattttctgctccaaaaatacaatgattgaacatggatagaataacaatcatagacattttaactccataaaatgggaaaataaaagaaaaatggaatcattggcctcaagcaatttctaagtcaaactgagtaaactctgttagatatcaatgtctgtgaatcatctactgcggcttgagattccactaccttggcccatggctccacccctgggctttcagctctatcctcagagttagccatcatttttcttaaagtatagcacatgtttgcaactgagtcactctgccagcctgattcctgcctgtatagatttgtccgtttaattctttcatccttcctctctctgtccatttgcatcccaaactctcagtgtttctgctggtataacattctcagaaactcatgcttctcttgtgtatattatgaggattccagccattaaaaaaaaggttcctccacagatgtttgtacacaaaatattttatatatttagtctatattcctggcttttgctgagatggttgatcacatccataagtcacatgctttatcttccaacactagcaaaatattgtccagccccactcagcattctctctggagaacacttccctgacagtgaaccttaatttatcatcttttaaaatctgcataaagtgagaatttcctaaataattaagtcctggtgattgtttgcatagcaattctttccttaattatatttattttccttcttattttactataggcagcaagaagaaactgcattatacattcaatgctttccttgaaaatctcctcaactgaatatccaagttcattactcaagttatgttcttcacataactgtagaacacagttcagctgtttctgccactatacagctggaattatctttcacccagtcttcaataacatgtttttcactacctcctgaattcttaccagcaacatctttaaaatccatatttcatcaagtctttttatgatgatttacgtattctcaaagatgatttaggctttcttctacaatgttcctcactttctctgagttctgaccaacaaagtcttcaacaaccatattttctagcagttttattcaaggcagtcaaggctttttctatcacactcctcaaaattattttaatctcttcccaatgccaagttccaaaaccacttctacatctttaaatatatgttacagcaacaaccactcctggtaccaacatttgtattaattttctattgttgttgtggaaaattgtcacaaacatagtagcctaaacaacatagttttacagttctggatgtcaaaaacctaaaatctatttcactgggctaaaatcaaggtgttagcaaggctggtttcttctaaactctgaggggaaaatctatttctttgccatttttagcttccagtggctgctcataatttttgactagcccccattcttcctccttcagagtgcaccactccagtctctgctttcataatcactttgccttctcctcctctgatcctctttccttcctcttgtaataattttggtgattacattttgtgccctcttgaacaatccagaataaccttccagtatcaagattctcaactgaaccacttatgcaaagtcccttttgtcatataagataacatgcaaaggtcctagaaattaaaatacggatattttttattattcagccttcaataatacttaatgtttaattgttgaatgaaaaatttagagaaaactacagcataatttcttgtctaagtttgaggattaaattcatttgattatcaggaaataaagtttaaagaaaaatgatgaattaaacataaatggtgcaaaaacaataggacaagaagaaagttatgtttataaatagtagatttgaagtagagagtgcataaactgaaaaggaataaaatattttaagagcaggatttcactccagatcaaatcaagcaaatataattattcaactatattaaaaaattgcaaatttgaaagtttattatgaacactgaaacactataaaagcacaatgaaaatattacctattattcatattgttgtcataaccatgctatttctctaaagaatctttgtcatgatgttcaaagaaatgtgtattttcttctatttagttatttattttctatttccattattagaggaggaaaaactggtacagtttgtaataactagataacgggagctcaatatatcactatatttcattatggttatagattttatgcccagtttaataaatatgtgtctactctactatcattaagatattctcctctgttacctcctagaagttttattattttacagttcagctttaggtcttcagtctatctgagactgattctggtgcttattgtgaaatggtggtcaagaatcacacttttccccttgtagatacttaattgattaaaatcatttattgaaaacaccatgtttccccagcgcatgaaaactttggtataatttgtgtgactttatctatataggtctcttattttgctttctattccacataattagttatgtttctttgtatctatattccattatcttaattactgtcactttaaaataacttggtatattaatatgtggcattatatatctttcacgttattttacttccaaattgtcttgtatattctcgaatcctttatttccatataaaagctagaatcactagacagtaatcacaaaaacatttaaaaattattgggattgcattgaattaatacttgaatttgaaaataattgctacattttgtattactgagcctttcacactctaacatggtatatatttctatttgtgtattttttaaaattttatcttaaaagtttctactgttcagtataaagctattatacatatatatttttatatttatttctgggtatttgctattttttatttgatttcataaatggtattattaaaatattttctaaatgttttttcactggtatatagaaaggtaattatagtttatctttttgttaaattttaaagctcaggagtacatgtgcacatttggtatataggtaaacttgtgtcatgggggttcactgtacagattatttaatcactcaggtattaagcctggtacccattagttattttttatgatcctctccttcctcccaccctccaccctctgatagaccccaatgtgtgttgttccattctatgtgtccatgtgttctcatcattcagctcccattcataagtaagatcatggtggtgtttggttttctgttcctgctctagtatgctgaggataatagcttccaactccatccatagccctgcaaaggacatgatctcattcatttttatggctgcatagtactccatagtggatatgtaccacaattggtttataatagggagattaatacgaattaaaggtagacattctttaaaaatggagataagagaatgaataaaattttttgaagtgttgcaattgaagaatttgttataataatgagtgacaataagacagttccaaatcactgattaaacatagcattgggctttgtttttttagaaataaaggatagattacataaaaaaatagttatttttatttattgcccataatacaaatttaattaaagcattttcttcttttaataggctaaaagtaaacatcagaacatatgataattccattccaagtaagaatttagttaatgaagtttaatatttcttagattggaaaacaattttaggaactaatgacaagtatattccattaaatgtgataaagcagaaactgctatgaatttttataaaaattttataaaagcatgtatgcatgatatttatatatgtatgttggtaggtgtgtatgtgtgtgtatatctctggccttgatgtagatttgcactcactggttttgaagaaagatttatttagtttgttctccttcataatacaaaccaattttacttgtataagattcccttgtgtttagaattcataattacagtaaagaaggcaaatatagtcagagagatgaaaacagttaatgaacagcccatttgttaaacagctgcaactttaggaacgtttacgttaatatactgagctgaagtctgcctgcactgctataaatattacccattggttctagcccacccctcaggatacatataaaagaagcctataacaatgtgattaagagcatgggctctggggccaaagtacctgtgttcaaatcaactctgctacttactagctttaaataataaataattaataagctagcaattaatttaacctctccctctctctgtgctttatttttccatatctgtaaaatggagacaattacattatctaattcaaagcattgttgtaaagattaaacaagtttactaaaatgcttagaacacagtctggcacatagtaaacactacataagtgttagtggttgcagctatgctgttattactatgactactttttgccaatgtagcagctctttaaaaatctaaatatagtaaccgtatctctggttagtctctccatctccaagagagctatgttgagtttcgttaccagttccacttttgacatagttttcagatagtttgatcttcctgatcaccctattcttgtcctcaagtatgtatatggccttctttaaatagaatccccaaaatggaatgcagtatttccacctagggccctaattcctgtggttcgggatgccactgaggtcagagaggtgctaaaagaaacactcagatgtaatcaatcaagacttttactgactgttgtcaacaccgtgctagttattatgaagactatagcagaagttatattgtctgcaatctaactaaagtgacataaagaaaaaaaaacaggatagacgagatgatgtagatattttcaaggaaacagtaaatctctattttctattcctactgtctgattatataattttaccatcatgatttaaatatctgtgaaaattagtttaatgtagaaaataaaattacaaatttcattttaaataaaattcaatgataaataagaaaaatggtttttattttctctgattgctatgcaaataaactaggaactctgaggaaaaaatctatattttaatgtataacttagtttaatttaaataatatgtttcttactcaagaataattcaggtctgtggaaaatctgacattaactccaaattgtttattatcctttctcatttagtcagtgaatcaagcagaaaatcatggaatcaaaaacactttgctttgacatttcccaaaccactccagagaggtacaaatgataaatcaagacctttgaaatcacaaataacagttactgtaagtatagaaaaagtcatttttaaaaacgaaatctaagttggtaaagcatatataaatataagtaaggcctatataacttgaattttactacctgttggaagatatttttaaatttgtaattctctgtacaacagactgcccctacctgctttagattaagctcatatttgtacataattatccacatcaaagacattatctaagcaagctggagaacctaatactgcacctggcaagttctatcaggacatgtttaccagctgcaaaaagcagctaaaatttaaatattagagcagaaactgatcttgatgaggtttcaaggcctccttattttacaaaatatgaaattcagagacgatattaagagattcaagttttctactgtttctctaaagtcgagttatcctatcaattagcaaaaggaaaaataagcatatataggtcacctattatgatatcaaacaatttttaaagcatctcccagagcaaagttacagtcaatgcatttattcaagggtcatttattacatttttagtgatccaactttcatgtttctcttcaggtcatcttttaattccatattaccatttgcttgttggcacctctactgaataattgagggaaaataagaagtaattttaaaatcagtctttatggttatttatgactacaagatttggcaaatatttgggtgagatttgaaaataaattacaccactgctgcacaagttaatgtgaatcaagcatctgtttatttcattcagtttatgcctttgtttcttttttttgtgcagtgcagttggggtcacagactctcaatttgacaagacactttaaaagcaggagtagaaattaggctagggttttacaactattacaggaactgtcataacaaacttcaagtggatcagtttatttctgatttaacttggggataaacagtgttcaatattttccaaaagattctccccatatagaagtcccaaaagcctactgttggtatttgaggacaagtcctggaatgtcatgagtcactgtgggcctgctctaatctcaatatgaatcattaatggaatcataaaattcccactaaagtcattttatttccaaagtggagttatatgtctctttctgtctctctcttacacacacacacacacacacacacacacacacacacagacacaaccttgaaagagaaaaaaactaagtttaaatagatggttaataaaaatataaacttttttatgtttcaatatagaaagataaaactcattcacaaatgcttattattctaaccaatcttttcagagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttggtaagtttactactgttttatatttaggctgaaatggatataaaatgaaagactttttaaagtttgaatttatgttttctccaaataatagttatcttttactagaatattgacaactttgtgactcgaaggtaagaaaaataaagaatacctcacaaggatgcaaaatactgcaaaaagttataaatttaagagaatagaaattatttggactagagaagagagaaatgacttgtgatttaagaaaacgtgaagttatgtataaagaaggtcattttgcaaaaaaaaaagtggttaagttttatacttggaaaagaacaaaaatgaaaattgactaaaacttctacaggggcagatttaagcgagatataaagacatttcctgagaagttgctgaatacagtaaaagctagattaaccaaaattcatacatagcaggtggaatacatgccaagattcaactgtgcaaaaaaattaaattatttaatccatatctcaagtggattttttatgagccctcattataactgatatcaggaaacaaaagttaacttttcagaaataactatatcttctctaatttataaacctcatgttaactttatctatttggaggtaaatactctgtcaacttaaagctactacttctctcatccaggagtctttcccttcaatcccttccccaatagtctgattgtaagggaaagcataaatagacatattacattagacagaggagttctggattagttctcacactgctgataaagatatacctgaaactgagaaatttacagaagaaagaggtttaattagactcacagttccacatttctggggaggtctctcaatcatggcaaaaggcaaggaggagcaagtcacatcttacttggatggcagcaggcaaagagagcttgtgcagagaaactcccgtttttaaaaccatcagatcttttgagactcattcactatcacaagaactgtgtaggaaagacctgcccccataattcaatcactttccactgggctcctcccacgacatgtgtgaattgtggaggttacaattcaagatgagatttgggtggggacacagccaaaccatatcaagtccctattctacatgtttcctccctttctgtctctatgatttttggttgggtgtaactcatttacatgatttctgggcatcaatctttgtttcctatgcttgcatggtattcattgtttattctaagcatcgtaggactgctgccctctgacctgttaaactcacggcttctgtagatacagctagttcttgaccctaaacttctcatttttattaatttcctcctccctttcttctcctcatttctcccccttgtcaccttcttgttcttctaactcaagaaatttatatttcctcttttaggctcagagagatctattttatcttatattccaaatattttctatctttggtttataataaaactttacatatgtacatcaatttacttctcatatattaatattttttggaagataaaaacatcttttatcactctcagaaagcctgggtttcaagtctagctttctcccagcagaccccaaaactctgctttgagactcaaagttgattaatgacccccttgctctaggtgatatcttctttctccaccagattgagttaatggatggctaaccactagtgtgacaatacttataagaaataaaagtacactggggaataatttttaagataagtaagaagaaagactctcaaatagctagactcttttccacaggcagtttttaggaaaagtaaataaaatataagaaaaaaattgaatacaaggattaattttaattaaaaaattatctttcagggtatgttctaggcttgtacaattcatgccaagtctctttaataaacttccatatgctttgccaccattcagttaggcttttctgtctctactactccactgaaacttttcctttaaaggttaccaaataccttcttgtggccatatctataggcttttcctccctcctcatcttatttcataattcaacagcatttaaactaacctttctgtctggaaatacttccattacttcacttctatgactgtgctctcctgtttttatttctacatactggtagattttaaccacctttattgtatccttctctgcctcattattaaaaattggaatgatcctgtctttgtcctggacactctttatttacagtcctccctttgtgagtatatagcgttaaatggctttaaatattatctatgtattgatgattccaaaattaatatctccagttatgaccttctaattgagctccaaaatctctccacttgaaatctccactatagtatctactgggcatctcatacttaaaatgtttaaataatatttttaaccccacactaaattctattcctcccttagctgtcttcatcttatcagatggcaccaccatccagccagttgatttttttaagcctggacataatctccttctcacttctttttctcaccctacacaggtaatccatcagcaagacttgtttactctacctccaaaatatgtcctgactgaatccactttccttatctccattactaccaccttcgttgctccagtcatcaccatcattagcatctagctatccattaactcattatgttgcccaggctggtcttgaactcctgggctcaagcaatcttccagccttggcttcccaaagtgctgggattgtaggtgtaagccaccatgtctggcagaataaaatttcttaccctagcttccagtgtctacaatctttagcccctacccatttttcaccataatcatgtagcacttcttctcttttctcttgtcatctagccaaactggcattctttttgtttctcataaacaccaagattgttttcttgcaaagccttctcatgtgctgtttcctctgattggaatattcctcccacagatctttgcatgtctattccttttcattatttagtttttcagcttaagtgttctctttagagaagccttccctgactaccttactttatgttaccctctcatccaccactatgcagtcaccctccgaacactgcatcatacattatttggcttcactgaatttatatttatataaaattatattttattcatttgtttgttaattatattcaacatcagaattcaggttctatgcaggcagtgaatctagcctgttttttcatatatatatatatatatacaaatatatataaatatatatatatatataaatataaatatatatatttgtatataaatataaatatatatatttgtatataaatataaatatatatatttgtatataaatatatatataaaaatatatatatttgtatataaatataaatatatatatttgtatataaatatatatataaaaatatatatatttgtatataaatataaatatatatatttgtatataaatatatatataaaaatatatatttgtatataaatatatatataaaatatatatatttgtatataaatatatatataaatatatataaatatatatataaatatatataaatatatataaatatataaatatatatataaatatataaatatatataaatatataaatatatatatataaatatataaatatatataaatatataaatatatatataaatatataaatatatataaatatatataaatatatatataaatatatataaatatatataaatatatataaatatatataaatatatatataaatatatataaatatatataaatatatataaatatatatataaatatatataaatatatatatattttcatacatgtccacagattcaaaaacagcagctatatatatgaaaatatatattttaatatatgtccacagattcaaaaacagcacctatgttatatttagttggttgagaatttggtccctctaaagagctacatatcacagtaggagacattcggatatccctttttccaagcatttttcctctagatatgtcattaaaacaagtatttttttaagtgagggtagtcacaaaaatgcactttatattctaattggatgtctggaagagaatacctatgtatcctgctcaattgtgtatggggaacttatgaacaaactttgttattgaatcttatggagttttctccttccttttttttttttttaatatgggcttgaagaatgatggcttttctccttttctcctccactggagtcctagtgattctcacagtagcacataagcacgtaagaaccacataagcagtgctgtgtttcagggtcagcactgtttacactcctggattaagattatttacatttgatattatgtttataaatcttagcaatattctcaaacgtaagtgaagaattctttatattccagatgctaaggtagaaaagtagggtgttatgtttagggtgttttgttttccattctgtatgtgtatatataatctttattaacaaaaatacaaatacaacaacagaaacaatataaaatacgtaaagaaaagctaatcatttagatcctcatgtccactttctgatgccaaatccccctattttctcatcttctagaggtaaacaatgttagcagcctggggtccatttttctctcttacaccatttccttgtacaagcaaatgtaaggagggagagagagagggagagagaattacataatttgttttgaccaaaatacaatcatgcacatgcagtaaagtacaacttattttctcacttgacaatatcatggtcatccatataagtcgttagacatacatctattgttattgttcttatttccaacttgcttgtgaaaacacacacagaattttgtgtcaataccatacattgtgatttgttttccttccatcttttatttttgcttatctctctacttctcattcccactttcacccatcgctttttttctcctttctaggtaacacttatcaacaacttactatgtttcattccatacgtctttctaaggttcactttaccatatcaaacattcaaacacacacagacacatacacacacacacatgcacacagtggtagcatctggcagcagaagagaaagtgtatggcagctgggagcaggaggaagtgaggttttcttattgttttattttaaaataaagaaataatacatctttgcatcttggtcagcaatagttgttacagctcctcctaacttttgccattctaatggatgcataatgatatctcattggtactttaatttgcattctcctaaatgctagtttgtttaaatatcttttgaatgtttgtcgtgccatacgtttgatcttttgagaattatttctttgtattctttgtccatttttcacatgggttatttgtatgtttcttgcatttattaaagtatctttgcatattataggtattactccttcatctgtcttccttgttgtattttccctagctttcatgtctattaattattttgcagtgtattttgctgtgcacaaatactaaatttttacataatcaaatacgtctataatttatttggttgtttcttggctgtccgtattagtgaaaattatcttctccacagagtagtttttaacagggactaaaacaaaaactagtccttagtaaataataaactgtcatcgatgtccaaattgagcattgtgacaatcaaggttttattgcactgaaatgagttaacaaaggagatgtcttaatgtctttcccaaaagaattaaatacattatttgaaaaatcagaagtcccatgcaagttgtataatctagtggctactgcatacagctttggagtcaaataatttggatttaaatccttgctctatcacttactagcaggatacttttccccaaaagtatcttaatcacttgaaatattaagtgatttctttcttaatcacttgaaatattattttttctcaagtataaaatgggatattaataagaccttccctataggaaaatgaaacatgtaagatgtttagtatattatctgctattttattatgcacattcagggagcaccactcctatcaacatccctcaaataacaatgcatgtggcttttaatttcatccaggttatatgagcacaatgtaaaagaaaccaacgtattagaacatgtttagttcaacaaataaaccaatcaatatttttaactgccaccctctcctcaataaaattaattaattgatagcatatttcattttccaggaggaattatcattttctgagcatgcagaggttacatgacattatgctcaatactgggcaattgattaaaaagcttatctttcaatttctatagttaattaggagtcaaaagaagacagactaaataatcagaaaacccaaactaaggagactacaagttgattcactgttgctattcaaggaaagtgggtgttgttgttgttgttgttgttgttgttgttttgtattaaactggaaagcacttcaaggaagtacttatttcaggtgaaatcagtcaaaacgcaaattgaagtaaaacacataagaaccgtcgaacttggttcactttatactttttatttttttctgggacacatgttccttcataataaaataaagcaagtaaatccctctcttattctgggcctgatttctcatctctaaaatgaaaaattgaactaggtgagctgtaatttcaaattgtatggctagcatagtgggatgaatttgtcatttcttagttgtgcctgcctgaaagatatcggtcatatgtctgcccataacagtgatggactacggatagaatatgaggctaactagatagtagaagtgactgacacactagagcacaaaaaaaataatggtaacattggacggagattattaccacaagaaattattcttaggaggattcatgaattattgggtaccactgatttctaaaggtttttgaaacattttcgagatctttgtacaatatataatcatgattctggaggtaatttatttttgaaactgtcattacctgatttttttttttttttgagacagagtctcgcgcgatctcggctcactgcaacctccacctcccagtttcaagcgattctcctgcctcagcctcccgtgtagctgggactataggtgcccaccaccacgcccagctaattttttgtatttttagtagagacgggatttcaccgtgttagccaggatggtttcgatctcctgacttcgtgatctgcccacctcagcctcccaaagtgctgggattacaggcgtgagccaccgcgcctggtcacctgattttatctattgaaaagaatactggagttgttttaatttgaagccatcccactgtatttgataaagttacagtcaagtaccagtgtaactgaatgccccagacagacagaaagatataagtgcctactgatatgtttctgtttttatttcctctgctggttatttccatatctctgaataatatatttatatgactacttctcaattttacacattttccattggttttcttccataaaagataaagatataggttgtgtacatcatcctctcttcttctctctaattgagtcctacatttgtttttaatatatttgccaattacctttataacattaaatattatatttgtaacctttttcctaccctttttccctacttttctcttctgttcttcatttctgtaccttttctttagttcttttttaaaaagtgctcttttaatagttccctgcaatgacctttcactgaatattatggtcttgtctgtacctacattaacttgtaatctcttgcctttataaaaactatctcttcccttaacttccctgagtttctactattgtggttttctttcttgctactacttttctttttcctctcctactactgtttccatatcttcaattcttacacttcttcctcttcctacatccaactcaaagttgttttctatggctcagttattagacctcaactcttctctatatactctgggagcattagtctaccactatggcttaaattttcacttctttgtagacatttcaaactgtatatccctagactattttctcatcctaaattttgtctattagctcctatattcaaacactttctaagctccaagagatcagaaaaaaatgaattttttaaatttcatttttaatttaaatttaatccaccattggggccttttctgttattctggtaaagtcatttgcaaatgagaaatatagtacctaacctacccattataacaaattgttcttaggttcaaatattaaaaaaaggtgtgaaagggttttataaatgacaaatcattatacaaatgtaagactttattactactattactgccttatgccttcatttatattgcccctcttttttcttgcaattggtttctccttcttctccagttgtcttcttcaaagcttgactttccctcaaaacactgtaacacttatattgctctctatttgttgggttgatattaatattgtgttctaattctttccaactactgtcacactcagagtatcattctgcatgtagaagataattaacaactatttgttgactgattaacttaaaagtttggtaataagttgaaagtttatatttggaattttgtcatatttaggagaattatcaatctttattactatgttttatctatcaataaatattccttgagcaaatattccgtgtcaggcactgttcaaatcaatgaagatataaaatgcatatctatttctttcaaggaagttaaagttttcacctagggaataaaaattctagcagcttttgttttagttgtcctctctaaataaaataaccttctctgaaaataggaacactcaaaatattatacaaaaccaagaagctttacattcttttctcatctatgtaatttactcagttattattatggttgtgcattgtatctatcttctgctaaaaagtaagctgcatgatgacaaagctctttaatttgtttactaatgtatttgaaattcccaagaaagtgggcactcaatatttgctgaaaaattgaatgtggcatttgttagaggactaccaaaaaatgaatgaaagaatttcttggcagttgtataaacacagctggagctaggtaatatcaaatttaagtatgttcagttcataaattttttattcataccacaaagctgaagtaatatttcagcttggttatataagataagcaagattttgacagagacaatggagaagtttatattcaaaaattaccaactaattaaaagcagaaccaggctgtgaaattatattatgagatgcaatattatagcatgatgcctaagggtgaaactaactgaaggagaaaacagtttacagcctagaagccagtcaaagtggatggtgggagaaagagttggcaagtggcatgataagcatgatgacaggctaaggaaaataaaagcagcagagaatattgtgatgcctcttcacaacaagttttttttagaagaatgttattcatgttcttagcctactttttgatgacattgtttggttttttccttgttgatttgtttgaatttggtgtagattctagatattgttcctttgtcagatatatagattatgaagaatctctcccactctgtgggttgtttgtttactctgctaactgttccttttgccatgcaaaagctctgtagtttaattaagtcccagctatttgtctttgtttttatttcatttgcttttgggatcttggtcataaatccttgcctaagcccaatgtctagaagggtatttccaatgttgtcttctggaatgtttatagtctcacaaataaccactaaagaacttactcatgtaaccaaacaccacctgttccccaataacatatggaaataaaaaataaaataaaaaacaaacactaaattataaaataggtgggaggaatttctggtttgttctatgatatgataacatttttatgcatttttaaattgcatgcactttgctaacaattttttttcctattttttaactgtgttactgtgttgctactttgctgtgcccaagcatagagactccttcatcaccagctgtgagatttggtgtcttctcattgacctctgactgtcaataataatttctaattccaaactctgtctttcttagaaaatgtcttattttctagacattacccaaactctttcctatatggaaaaaaattctaccagctactaccattctctgagctatgaatctaattcctcactaaggtattaagtttaattttggttactctttccataataactatggtttaatcgaggcctctaaagatcttaaactcaaaatctaaatgaatgaattttaaatgtttgaatttggggtaatgtgaaatgttctagaatgtgacatttctagtgcctctcccaaatcacaatatacaggtagaagttattccacatatatttaaggataaaacaagccaacattttctttcaattatttgggatacataatgatatagaaaaaaagaatgaactgtgaatcaagagtgctatgataagacatatttctgagaatgaaaacaagatctgtataataaaaaaatcaagaaatagaaatagataatttatacaggaggaaataaatatgaggcaaaatcataaaaatatattgacgatgattagtaatcagagcaaccccaagagatcattttgcacctagtaatgcgactattatatatatataaatcttatgtatattaactatatcaatacataaaatataatttttatatgtgttgtatatataagatatatcttacaactgttgaagcttcagtgacagcagtacatttattcactgctgacttcagaaggggaccaatataaaccagcttaactttcctctgggcctatatgggaatatgtaggaagagtcataaatgataaaataatatttgactcaataatcccactgctataaatataataaaaatttttcagaagaaaataagaagaaaaaacaaactatgcataaagagcatgattgcaatactgtctataagagaaaaactttggtataaatgtataatatataaaactatgtatacttataaattaatgtatataatatatttgtataatgtataaaattagaggggggttagtaagatctgaaacagattagtatgcattcattgaaataataatgatggagcctaggaaattagagggaaaagtttgtactataaggctaagagaaataagcaagaaaaaatactatgggattgcaactaaacagaaatcttcatttttgtggataaaaagtatgcattaatatgcaaattcgaaaataattgtgttagtgtggtgtaatttggggtgaatacaagatattttaaatgcattttcattttttacattatatttttatttttaaaagttctaatccattaatgtagttgtgaaagtttaggctaatggtgtaacattgctgggccttggctcctgtacaaacactgatgattggactaccattcagtacttctcactctttagtgtccattaagattattcagggagcttgttgaatgtgcatactgctagactatatcttcccagattttgacttggtaggtctggggtggagaccagggatctgcgtttttaataagaaataataaaaatgatatccaagttccctttcaactatgacagtctgtgctttcgtgtgatccttaacacatcatagttgtcttgattaatagacaaataaagcctttctttttatttgcatttttctactttgctcctcagcctgaagcaccgtggattcataagctgctttaaagaacaactgagcacttggtttcacagaatggccttaccacagtaagcaccacctactctcaaatgagcatttctacctctgtggaactgaaataaaaacaagtcttccatgagtatcaagagttgcttttttgcatataatttacagaagtgatttatagacatgttttttattatttatcaaatgtctcaattattcataccaaaataatttagcattttaccccatgttctcaagcttcagtctggaaactatttctgagtttgggttcaaatgtactctgcttcaatactcttaccatatttcattaaatttctcttttacttagcattcaaaataaaagtaaatagagaatgaaagggaggaagcagatcttccacacccttaagagaaatagagaatatacatagatattaacccctgacaaaaattttttgtttggccaaactttcatcatactcctgaaccatatcctaggcctatctaggcatttcccttgtaaaatccgttttagcaaaaaagctgctaaatcagtttatcaagagtcttacacccttaataactgatccttcaatatgtgatcgggtttctcatcatccatcatcttccaggtgatttctcatcaccctagaatcctgttaagtcagtatagccagaatccccccttatccccgatgttacctctcagtaattttccatccactgactagcaccctgctttttgactataaattcctacttgctcattctatattcagagttgagcccaatctctctcctccagtgaaataccccattcccatggtccctacacctatccaatgatagcttccctttgaagaaagtctgcttaccatcttcaatgagtgtcagtgaatatgtttttctttaacaccttacctcctctacacacatacacatatagaattctaaacttaattatttacttttatttctttttctccttatttatttatttactgataaactgcaaatgttcatgagataataacacacatatctcaatcattttacatatttctgtgaatatgcttgtcacattatttcctgagaacaggatactggtatggaaggaaagagagagagaaatagacagagataagtatggcagcctcctttacttcacccagtctgctttgtaccttttggttataatcttttttttattattatactttaagttctagggtacatgtgcacaacgtgcaggtttgttacatatgtatacatgtgccatgttggtgtgctgcacccattaactcgtcatttacattaggtatatctcacttcagtttgctctcagaaatgacaacatttcagatccaattcttaaagaggtgttatttttctaagccatttaataactttacatatgtctatataacatatactttaaaaagttataagaaaagtttagaaacaatccaattagccctcaataaatgatttgctgaatatatgacagttcttcaacacaatgtaatgccttgtgaatgtgaaaaagaataataaagctctctatgtagtgacctagaaagagcttcaatataaatttaagtgaaaaaaatcaatgtgcaaaagagaggatatgctatgttatttatagggtttttaaaagaagggaagagctgacatatatttgcatttgcctatatttgcataaagagactctggtagtataaaaaataaaataataaaagtggttacctataatagaggagtggtatttgaagaaatgacaggttagagaaacagatgaagtttcgacctaatactaatattcagccagtacacattgaatgagccgtaatggttgataaaatactacaatatttctaaatcatttggtaaatggcaactacactgttcaccaccccttcccctcgacaccttgaatgctgctcagtcttctctcttggaacatcagggatcctccaggaatcaaaagcaaagacataattacaagtataaaagacgtattcagtgaaacacttgtgaaaggtaaaaggagagagagccgaagtaggtaagaagagactgtagactgccatgcaagctggcatccatgaaaggagaaaggaaacaaaagagcctcagctgtattgaagctcagggaaaatctcaggcaggccaatggggagcccagagcaaagactgctctttagaggaatctgtgttgggcagaaatagccaggccttagtactgtcacagtgcttaatcattgtctgggagaagtccagtgggagtgtagccgcagcttgaatattggtgaatctcaaatgagcacaggctgtcagctgatgctattcctcagaaaaatctcccctgaagtgagatctgagcagcaatttcccttgaccatcacagcacaaatccatttctttatccgtattcactcctcaaaagttctatgggcttctcctccttagggaaaacttaaaagaggaagggtagaggaaaaaccatagtccttatccttccagttgatcttagggccacaactggtctggtctggtctcctacattgttcatcttaaattcctctcattctcctatgtgtcttacctggtgttataatctgaaatttcatttctgaagggtctgaacccttagtaattgtaaccttctcgggttccattcacagttaaaattgggcaagggattcaaagagaagcctaaatggatcatgtggcttccaccaatatcctttcctttccacattgtaaaaagcaactctacctcccctctgcttatcagattaaattagccttctcaaaatggtgattcttttcaacatctggtttctaggtataaggagtccaaagatccctagcaacagctgtaacttgtccttcaatgggactcttgtatgtcccttggcaagctttatgtcccccttttgggataaggacttataactctgtaaagcccagagctgctgtgacaagaagcacatgggctcccagtgagtcattttgagaatggtggcaagtggggccactcttgattctatcccttttggcatatgtgtttttcctattgaggataaaacaccatatagaaatatctgttttaattcttatactgcatctcacggacagcactccatcttgcagagtattgcatccgagctcatacttcatcactgtgacttcagtaggccattcaagctctctgtgaagttggctgcttctcaatggtgcagtatgtagtatgactgtgtacatcatggtcatgggcccacttccatacctcctttacagtttaataccctggtcagatgttattcttcctcaaggatacccctgagtttggctgtaatgcaagtgctgttcattttcagctagaacccacatactcagccgaaatatttataaaccaagctcaggcatatttttcctccttcatatggccataggtgcaagctgaagaaggatgctggagccagcacagtagatgatatggaggtctgtagtacctgctcatgaagcttacttatactctctagtcctactcacaaatgatcccagagtgaccatattccacttttgggtatctttacagcagcatcacactcctggtaccaatttactgtattagtctgttctcacattgctaataaagacatatccgagactgggtaatttataaaggaaagaggtttaatggactcacagtttcacatggctagggaaacctcacaatcatggccagagacgaaggaagaacaaagacatgtcttacatggtagcaggtaagagagcttgtgcaggggaactcccgtttataaaaccaacagatctcatgagacttattcactatcacaaaaacagtatgagaaggacctgccccataattcaattacctcccaccaggtccttcccatgacatgtgggaattatgagagctacaattcaacatgagatttcggtagggacatagccaaaccatatcaacaaataatgagcacagtgtctgataggtaatttttcaatcctcattctccccccaccctccactctcaagtagtccccaatgtctgctgttgccttctttgggtccatatatacttgatgtttatctcccacttataagtgagaacatgcaggatttagttttctgttttcatttaattcacttataataatggcctccagctccaccatcttgctgcaaagaacatgatctctttcttttgtatggctgtgtagtgttccatggtgtatattaccacatgttttatatccaatctacagttgatggacatttagttttatttcatatctttgctagtgtgaatagtgctgtgattaacataggcatgcatgtgtatttatggtagaatgatttatattcctatgggtatatacctaataattggaatgctgatttgaaaggtagttctgttgtgaatgctttgagaaatcacagcaatactttccacaaaggctgaacaaatttacaatcccaccagtagtgtaaaaccgttccttttctctgcaacctcgccagcatcggttatttattgactttttaataatggctattctggctggtgtgagatgatatctctttgtggttttaatttgcattactctaatgattagtgctattgagcatttattcatatttttgtcagctgcatgtatgtcttctttaaagaaatgtctgctcaagtcttttgcccactttttaatggggctgtttgtttttgctcgtaaatttgtttaagttccttatagattctggatgttggacttttgttggatgcatagtttgcaaatactttttcctgttctgtaggttgtttactctgttgacagtgtcttttgctgtgcaaaatctccttaattaggtcatatctgtcaatttctgtttttgttgcaattgcttttgatatcttcatcggtgaaatctttgacagttcctatattcaaaattgcatttgctaggttatctttcagaaattttgtacttttacattttacatgtaaatctttaatacatcttgagttgatttttgtatatggtgtaggaaggagttcagtttcaatcttctgcatgtggctagccagttatctgagaaccatttattgaatagggagtccttttcccattgcttgttctcatcaactttgacaaagatcagatgattgtaggtgtgtaggattatttctggactctcagttctgttcattggtctatgcttctgtttttataccagtaccatgctgttttggttacttagccttgcatgatagtttgaagtcaggtaatatgatgcctccagatttgttctttttgtttaggattcccttggctatttgagctgttttttggttccacatgaattttaaaatagtttttttttaattctatgaagaatgtaattggtactttcataggaatagcattgaatctgtaaatggctttgggcagtacggacattttaacaatattgattcttcttattcatgaatatgaaaagtttctccatttgtttgtgtaatctctgatgtctttgagttgtattttgtaattctcattttacagatctttccctacctggtcagttgtattcctagctattttgctctctttatgcctattgtgaattacattgcattcttgatttggctcttagtttggatgttgtttgcgtgtaggaacgctactgatgtttctacattgattttttttctcttcaaatatcttctttttaatgacttaaacaccagcgtggagacttacggtttaaacactctcgtttctttgctccgtgctttggaagggatagggactgcatttcccaccttgtctgagtgaagttaaaactttgtcttgtaaataaataaataatttcctaactaacaccacaaaatacaaacgagacctagtttctctcaaggggcaggtcgtttccaggtacccactgtcgctgctcctcttgagggcctggccatacctgccacgaggagaatgcggcaagaatggcttcccttcttctatttgctgctctctagaagggccgagaatctgcttgggcctgccggggctgatggcgtctcgctcttgagaaaaatcttgctggggcaggtcctccggcagcaccagcactttaccaagagtgatgggaaactgagactttgtacaaaactgcgctggcactcaccgtcttaggtagcagatttatagagtgaatactgtgcttgggcctttttcatgaagacttggatcccagttcttggagcagctgaaaaaatcggctcgggccaccagtggatacactcacaatgaaatgagaggccgtgtaaggtttgcaaggcggaatggcctgtagttttaactcggaaactgtggtgacgcaaacccaaaccaactgtgctacttcttgctgggaggcaaactgttatcaggctttgttttcactcctttggtgcttgacctgattattttgaatcctgaaacgttgctgagttatttatgcgatcaaaaagcctttggacagagactatgggattttctagttaaagaatcatatcttctgcaaacatgaataatttcttcttcttttcctttttggatgccttttatttattgtccttggctggttgctcttaccaggacttctagtattatgttgagctcttatatattctggttattaatcccttgtcagatgggtagtttgcaagtattttctcccatcctgtaggttttcccattactatgttgtttgtttcctttgctgtgcaggagctttttaacatgatttgattctcctcaatttccttcatcagtgtcctagagttttcattatagagatcttttactttttggttaattcctaggtatttaattttatgtgtggtattgcaagtggggttacatttttatttctttttcagcttgttgtttgttggcatatagaactgctagtgatttgtgtatgttgattttgtatcctgcaatttttgtgaattcatcacttctagtaattttttgtggagtctttttaggtttctccaaataaaaaaaaatatcatctgcaaacaaggatgatttgactttttcctttccaatttggatatcctttatttcttacttgtgtctaattgttctggctatgacttccagtacaatgttgaataacagtagtgaaagtgggtgtccttgtagttttccagatcttagaggaaagccttccactttttttccattcatgacactagatgtgggtctgtgacatatggcctttattatgttgagatatattccttctaacccagttttttgatggtttttgccatgaagggatgttgaatttgattaaatgctttattcagtatccatttaaatgagcatatgatttttgttctttattctgttgatgtgatttatcacattgattgatttgcatatgtgaaaccatccttgcatcccagggataaatcctacttcttcatggtgaatgaactttttaacatattattgaatttggtttgctggtattgtgttcaagatatttacaacagtattcattagagacattgcccgctagatttttttttttttgtctttgtatggctttggtttcagattaagagtggcctcatagaatgagtttggaagtatccctttctcctgttttttttggaataggttgagtagggtcagtattagttgttctttgctttgtagaattcagcagtgaagccactgggccccaggcttttctttacagagagattttttgttatggtttctatctcattacttgttattggtatattcaggttttggatttctttctggtacaatcttggtaggttgtacgtgtctaggaatttttccaatttcttcagattttccaatttattggcatattgttgcacatagtggccactaatgcttcatttaatttctgcagtggcagttgaaatgtctcctttttcatctctggttttatttatttgactcttctttcttttttcttagttagcttagataaagtttcttaaattttgtttaacttttcaaaaaaaaccttttagtttcattgatgttttctattttattcatttcaaattcatttattttttctctaatcttttttatttcttttcttctatttattttagttttggtttgctcttgcttttctagttctttaagatgcaccattaaatatttttatttgaaaattttcttctttttttcatgtaggcaattatagctatacccttatgtcttagtactgcttttgcagtatcccctaggttttggtatgtggtgtttccattagttttttcaagcagtttttcaattgtcttcttaagatttttcattgacctactagtctttcaggagcatattgtttaattttcatgtgtttgcttactctccaaaattcctcttgtaactgatttttagttttattccactgtggtcagcaaagatcagagaagatgcttgatgttattgtaatttgttttaatattttaagacttgttctgcagcttaacatatggtatatctttgataatctatgtgctaagaaaaaacaatgtgtattctgcagctgttggttaaaaatgctctttaaatatttatttgatctatttggtctacaggacaaattaactctgatgtttcttgttgattttctgtctggaatatgtgtccagtgctaaaagtggggtgttgaagtctccagctattattgtattgggacctatctgtatctgtatctttaataatatttgctccatatgtctggttgctgtagtgttgggtgcatgtatatttaaaattgttacaccctcttgctgaattgacccctttatcattagtgacatttttgtctatccttatagtttgtcttgaaatcaattttctctgatattaatatagctactcctattctcttctgctttccattggcataaaatagctttttcaatacctttatttttagtttatgtgtatctttataggtaaagtgtgtttcttgtagacaacaggttaatgagttttgtatttttatccgttcagcattctatgtcttttgattggagagtttagacaattacattcaatgttattattgacaagtaaggacttactgttgacatttttttctttgttttctggttgttttgtggtctcgtcttccttctttttgttccttttttacttcctttagtgaaggtgattttctctggtgatataattttgtttcttgctttttattatttctgtatttattgtatattttctggttttagggtactttgaagtttgtaaatactatcttaaaactcattattttaacctgataacagcttaacactgttcgcataaacaagccaacaaacaaccacaaagaaaactaataaaaatgctacaccttaaaatcatcctcctgcttttcatctttttgttgtttctatttgtatcttattgtactatgtcttgaaaagttgttgtagttattatttttgtatggttaattatttagtctttctactttgcacaaaagtaatttacacaccacagttacagtgttataatgtcctgtgattttctgtgtacttactattaccagtgagttttataccttcgggtaattacttattgctcattaatgtcctgttctttccaattaaagttctcacattacaagtaggacaggtctggtgtttaagaaatctctcagcttttgtttgtctgaaaaagtctttatttcaccttcaggtttgaagaatagttttgccagatgtactattctagggtctttttttttcttcagcactttaaatatgtcatgccactctctgctgacctgtaaggcttccactgaaaagtcttctgctagacattttggatatccattggatgctatttgtttcttttctcttgctgcttttatgatttttctcttcattcctgatctctggaagtttgagtattaaatgtcttgaggtagtctttggttaaattggtttagtattctataaccttcttgtagttggatatcaatatttttctctaggttttggaagttctgtgttcttctctcttggaatacactttctacacctatctttttctctacctctccttcaaggtcaataattcttaactttgcccttttgaggatattttctagattctgtatgtgtgcttcattgttttttttcttttgtctcctctggctgtgtattttcaaacagcctttcttccagcttactgtttctttcttctgcttgatcaattctgttattaagggactctgaggcatttttcattatgccaatttcaattttcagctccagaatttctgcttgattctctttaattattttaatctttgttaaattcatctgatagaattatgaattcttttgttatcttgaatttctttgcatttcctcaaaacagctattttaaattctcttcataagtgaaagagaaataaaatcctttacagacaagcaaatgctgagagaatttgtcaccactaaacttttggtttcattgattctttgtattcttttcagtctctgtttcatttaattctgctcttatttggttatttctcatcttctaatttggggtttggtttcttctcgcttttctagttctttgaggtgtgtcattagattgttaatttgtaacctttctaactttttgatgtaggcatttaatgctataaacttcccttttagcactgcatctgctttatcccacaggttttggtatgttgtgttttcatttttatattttactctttatttttacttttcttgttaatttcttgaatgactcaatggtcattcaggagcatgttgtttagttttcatgtatttgcatattttccaatgtttctcttgatactaacttctggttttattcaactttgatctgagaagttactttatttgatttcatttttgtaaaactttgttgacacttttttgtgccctagcttatagtctaccttggagaatgttccaagcatgggtctttataaaaggccaataacacaataaaatataagcataagacatgaaaagaccacctacaaaaataaaatgtaaacatccctataacatgtaaatgtgttacttatgaggaagaacaaattaaaataacagcaaaatgcaattttaaaaagtaccattttaataaaaatcttaagtttgacaacagattccattggtaaggctgtggaaaagtaggcactctcatacactgctggtgggcatataaattggcataacccccaaaaagggcaatttgtcaccatacgttcaaattgcacatgcccttttttttttggcccagcaaagctacttatatttgttccacagatatattcacagacaaaataatgacagggaacatttattagttaaaacattatcagaagtggtcataaaccactcaaataaccaccaatagcctactggcttaatattatggtacacaaagtcagtggaatgcaatgcagttataaataagaatgacaaaactgttaacatgaaaaaattaaagtgcatagcaatgtgtacaatatgatagttttatatcataaatataatggacctagggatgtgtatttatatgtgcctgtatttgtaaaccaaactctagaaagaatatatacaggaatctaattagtgtgattctattaatggaggttctgcagagaaacagaaacaataggctgaatatatcatatgtatgtgtgtattatttatatacatataatatatatgatttattatatataattgatatttatgactgctatatatgatatatgagatatatatagagagaaacaaagatatacagagaaattattatgagaaatatttcatatttcactcaaaagtcttgattattttattttctccaatgtacaactaccctggcaaaaattagtaagccatttggggaagatggggagaaacagtaacagtataaactttcagtggtgagaaaactgaggaaaagtggcaaataggagacaggactaaactacagctccaacttggacaatcagaacagagtgtggggactcacatcatgaacttttgctctaagaactactgcaggaatatactagtaaagccaaaagaatccacagaccctttgatggaagtggattgctcctgcaggatgtggagacagcccaaatactgtaattgcccaaactgtgaaggtgggaaaaagggaccatccattcccgaatacacatccttactaaagaacttgaatgtccaaatcatgggagaaggatttgaccttacctaaagctgagacaatttatagagccgagtgaaatataggggtagaggaaaatcggcaaaagccctgtgggatctctgggtccccaaggaagtcatttcttacttctctcacagaagtccttggggaaggctgcaagaaaaactggaaaaagaccacagggagaaggaaacctagagctagacattgtaacaatttcaaccaaacacgaagtttcctggccagaactcgtgggaaggcatcaatccagtgtgcagactcgacaggcagggagatgctaaagcactgcttgttttcttagctgggatgctggtaacctggagtaagttctcagccctgctgacccactgtctggtaacaacttggtgctgttgcggggagcagagttaaagtgagaccagccttttgggttgcatgggagtttggtgaagactgtaactgctggttttcttccactttcttgacaacctgcatgacacagcagatgcagccgtaatcctcctgaaaacataactccattgacctgggaaacacaaacccatcccccacaacagtggcagcaagccccaccaaagagtctgagcacagacatgcctaacactgaccctatttgatggtccttctctacccaccctgatagataaagaaaaaggtaacttcctcttggaagttctagggacctacccgctgcctgatcctcccctatactaccaaagctgatgctctcttgaaagtaccacctgctggcagtaaaccaaccagcacaaaactactgcactaaacaactacaaataaggaccctcagagtccattttactcccctgccacctcgaccaaaacaagtgctgatatccgtggctgagagatctgaagatggttcgcatcacagaactctatgcagacagcccccagtaccggcccagagcctggtagccctgctgggtggttagatcaagaagacaaataccaatcactacaatttggctttcgggaagccacattcttagaaaaagaaaaagaatactacatcaagggagcacctcattgggcaaaagaatctgaacagcagctttgagccccagatcttgcctctgacatagcctacccaaatgagaaggaaacagaaaaacagttctagttatatgacaaaacaaggttttttaacgcccccaaaatatcacactagctcaccaccaatggatacaaatcaagaagaaatccctgaattgcccgaaaaagaaatcagaaggttgattattaagtgaatcaagaaggcactagaaaaaggtgaagtccaacataaggaaataaaaaaaaagatacaagatatgagaagagaaatcatcagtgaaatgggtagcttaaaagacacacaaagaaatgcagaatgtatggaatctctcagcaatagaatcgaagaagcagaagaaaaatcctcagagcttgaagatgaggtttttcaaataatccaatccaacaaagacaaagaaaaaaaataaaggacacacgcaaaaaaatgcagaatgcatggaacgtctctgcaatagaattgaagaagaagaaagaacctcagagctagaaaagaaggtttttcaaataattcaatcagaaacaaaaaaaaattaaaaataaacaaagccttcaagaaatttggaattatatcaaacaaccaaataattggcatccctgaggaagaagagtaatccaaaagcttggaaaacatatttgggggaataattgagaaaagctttcttagtcttgcttgtatttggatctagacatccagacacaagaagctcaaagaacacctggggaattcattgcaaaatatcatcacctaagaacatagtaatcaggtgatctgaggtcaaaatgaaggagagaatattaaaagctgtgaggcaaaagcaccaggtaacctataaaggaaaacctataagattaacagcatatttatcagcagaaaccctacatgctagaaggtattagggccctatcttcagcctcattgtacaaaacaattatcaggcaaaaattttttatctagcaaaactaagcttcataaatgacggaaagatacagtctatttcagacaaacaaatgctgagagaacttggcactaccaagccagcactacaagaactgctaaatggagctctaaatcttgaaacaaatactgaaaatacatcaaaaaagaaccctttaaagcatgaatctcacaggatgtataaaacatgaatacaataaaaaattttaaaagcaaggtattcaggcaacaaatagcatgatgaatgaaacagtacctcacatctcaatactaacgttgaatgtaaatggcctaaatgctccatttaaaagatacagaattgcagaattgaccaaccaagtgtctgctgccttaaagagactcacttaacacattaagactcacacaaacttaaggcaaaggggtgaaaaaagacattctatacaaatggacgccaaaaatgagcaggagtagctaatcctatgtcagacaaaagaaactttaaagcaacagcagttaaaacagagacattatataatgaaaaaaggtcttgtccaataggaaaatattgcaatcttaatatataagcacctgagaggggagcgcccaaatttataaaacaattactactagatgtaagaaataaggtagacagcaacacaataatagtgggggacttcaatacttcactgacagcaccagaaaggtcaccaggccagaaagtcaacaaagaaaaaatggatttcaactatactctagaacaaattgactaaacagatatttacagaacattccaccccacaactgcaaaatatacattttattcactggtgcatgcctttgtctttggctacaagtgcaggtagagaaagaccatcaggtgggggcagggttaggtatgtctaaactcaaactctcttgagacagggcttgctgccactgctgtataggatggggtgtggttttaagtggttttaaggccattagagttatgttcccaggaggattatggctgcctctgccgcatcacacaggtcaccaggaaagtggaggaaagctatttgatccagcaatcccactactgggtatctactcagaggaacgaatgtcattatacaaaaaaaaaatattgcacatatatgtttatagtggcataattcacaattggaaaaatagggaaccagtacaaatgcccatcaatcaacaaatggataaagaaaatgttagatatatatatgttatatactatatataatatgtattattatatatatagtaaaattagtaaaaaaaaaagatcaaagcagaaataaatgaaactaaaatgaaaataaacaatatcaaaaatcaatcaagaaaaacttgttttttttgaaagttaaacaaaattgacaaaactttagccagacaactaaaaaagaaagaaagaaaataaaatcagaaatgaaaaggcagacatcacaactgctactgcaaaaattcgaaggctcattagtggctactatgagtaactatatgccagtcaattagaaaatctagaagtgaaacattcctagatgcatacaacctactaagattgacccaggaagaaataaaaaacctaaacagataaataaataacaaggtaaaaggctgtaataaaaaaagtctaccactaaagaaaagctcagggactcatggctttactgctgaattccaccagacatttaaagaaaaattaataccaatcctacttaaagtatttcaaaaattagaggaggagggaatactgccaatctcattctacaagaccagtattattctgacaacaaaaccatcaaagacatatcaaaaaaagaaacctataggccaatatatctgatgaacattgatgcaaacatcttcagcaaaatacgagcaaactgacttcaacattttgaaatgaatagttcaagatttgcaaatttatcactgtgatacagtgtatcaacagaatgatgaaaactatatgatcatttcaattcgtgctgaaaaggtgcttgataaaattcaacataatttcatgaaaaaaaaccctaagaaaactgggggtagaagaaacatacatcaatataatagaagccctatacgacagacccacagctagtatcatactggatggagaaaaaactgaaaggctttcctctaagatctggaacactacaaagattcccattttcaaccattgttattcaacatagtactggaagtcctagctagagcaatgagacaagagaaggaaagaaagaggatcctaattgaaatggaagaagtcaaattgtccatttgcagatgatatattttgaaaaacctaaaaactccacaaaaaactattagaagtgataaacaaattaaggaaagttgcacgatacaaaatcaacatacaaaaatcagtaccatttctgtataccaacagtgagcaatctgaaaatgaaataaaaatataatcacatttacaacagccacacataaaatcaaacacataggaattaacttaaccaaaaaagtgaaagatctttataatagaaactataaaacactgatgaaataaattgaagaggacatctaaaaatgaaaaatatatatatattttatgttcatggattggaagaatcaatattgttaaaatatccataccactcaaagcaatagacagattcaatgtaaaccctatcaaaataccaaatacattattcacagaaatagaagaaaactaccctaaaatttatatggaatctcaaaagacccagaatagacaaagttatctgaaagaataagaacaaaactagaggaatcacattacctgacttcaaattatactagagatctatagtaatcaaagcagcatggaactggcataaaaacagacacatagaccagtgtaacagaatagagagcccagaaacaaacccatgcactcacagttaactcacatttgacaaaggtaccaggaacatacactggggaaaatagtctcatcaataaatggtactggaaaaatagaatatccatatgtagaagaaagaaactagacctaatgggatcacatcaaattaaaaggcttctgcacaacaaaggaaacaataaacaaagtgaagagacaacccacagaatgagaaaaaatatttacaagctacccatctgacaagggattcataactagaatatataagaagctaaaacaactctataggaaaacatctaatattctaattaacaaatgggcaaaagatttgcatagacatttctcaaaagaagacaaaaaatggcaaacacacatatgaaaagctgctcaatatcattgatcatcagagaaatgcaaatgaaaactatgatgagataccatctcacctcggttataatggcttgtatctaaaaggcaataacaaatgctggtaaggatgtggagaaaagggaacccttgatcactcttggtggaaatgtaaattagtataaccactatagagaacagtgtgtaggttcctcacaaaactaaaaacagagctactatattacccagcaatcccgttgcttggtatatacccaaatgaaagaaaatctgtatatcaaagtggtatctgcactcccatgtttgttgctgtactgttcacaatagccaatatttggaagcaacctaagtgtccatcagcagatgaacaggtaaaaaaaatgtggtacatacacacaatggagaactatttagccattaaaaagaatgagatcctatcatttgcaacaacatggatggacccggagattattatgttaagtgaaagccagaaaaagaaagacagacattacatgttatcacttatttgtgggatctaaaaatcaaaacaattaaatttatgaacatagagagtaggaggattgttaccagagtctggaaagtgtagtgggaaattgtgggaggtggggatgtttaatgggcccaaaaaatgataagtagaaagaatgaataaaacctattattagataacacaacagggtgactatagtcaatagtaatttaatggtacatcttaaaagagtgtaattgaattgtttgtaacacaaaggataaatgcttgaggggaaagataccccattctccatgatgtgatttttatgcattgcatgtctgaattaacacagctcatgtactccataaatatatacacctactatgtaaccacaaaaattaaaaattaagaatttttaaaaatagaatagaagaggggtggtagggttggaatctgagaagaatcagcagtatcttgcaggacaactaccttaggtgagaccattataatgtcattagtcaatgcagagttaatctcttcaggaggtggaaaggccaatatcattgtgagtggagaggctgatactgctggatatagacaggcccctaccactaagagtgaagatgttggggttggggagcctgcttctgctgggcatagggtgatcaactctgttggaggaagaagcccattttcactggaggtggaaaggcctcttccactgacaaagaagactcatcaggatctaggggcacaatagttccagctatatcagggtcttccctcccattctcatcccaccttaccagatctttttttttttttccaatcagtgccttcactttaacaatagatatcctgcaaggctgggagttcaacttgagttataaatcagccagtgtccagattaagtctgtacttgatattcagcaatctaagctctgcaactctacaagatcagagttttttttcagggcagacatagaagttcttaagtcatttgtgtgccacttaacgcttggaattcaaactttttagcttaccgttttcttgttttatccggtgacattaggagagcatccaaccaatgtcatcatactcattggttctccaaaaatgtttaaaagtatcatatccaaagtcatgtaggtccttgcttattataattatttgattatgagtatcaaatgcagatattttgcatgtctacaaacagttcacaccatggactatcaatgtgtctttactactggaagcagagtcattaacatctttaaatctactcagattagagaaccaataccggaaactcaagaaccaattcagaaaatttatttttgaaattccactcctctaggatgaatttagatctttagactactctagatgtacaatttttgaggctgagacgtcccacaatctgctttttctgcgctagagacaaaaggaagccagtgacataatttagcctgagttgaaaggtttgagaatcgggggaatggatgatgtaaatctcagttcaagagcaggagaagatgagatgagatgtcccagctcaagtggcgaggcaggaaaaaaaaaaaagagcaaatttcttcttactccaccttttcttttatttaggacctcaacagattggataatgcctaaccacatggaagcaagcaatctactaaatcaccaattcaaatgctagtatcatcaaaaaacatcctcctcgcagacacattgataatcaatgtataatctgggcattccgtggcccactcaagttgacacataaaattaaccatcacagtgattatttgtggttggaaaactaagcagttagagaacaaaagggagattaagcctttttactatttaccttttaataattttaaggtatcacctattcaaaaatgtaaatatacaatcatgtaacacatataagttttaattataaaaagataaaaaatcattatgaaaataaagatttttaaaataatataccctttaacatagtattttcagttctagtaatcaaagtcaataattaggtgcagacaaatagttgtgcacatatttattcaccatgaaatcatccataataaaatatagaaacaccctaatttttctaaaaatgaaagattggctaaataaatatctaccatggatcatgtacagataataaaataatcacttgtatctatacttaatagcctggaaagatgttcattatgtatcgtcgaatgaaaatataggtcagaaatagctggaacatcatgggtttttaataattgttgtatatataaaatatgtatggtattccattttttgcatacacaaaccatgcacatatttgcattgggtaaaattaataatgactaactatgagtggttaaagtcttacagatatttactttcctgcattcgtaatatatctacaatgaactggactatttatataaactcaaaaaagcaaaaaatgtaaaaaaaacttatttctcatctcacatatatttatttcttctccaaactaccctataaaatctccttttggttttaaaaatcagtaattttataacaacaatgatcgcaccaataacaactatttttatatgttaagcagtgtatttagtcctacacatgcattatctcattgaatctttaaaataaccctatgaaatgtgtattcttgcctccttatataagtgaaaatgactcagagaagttaaaaacttgaccaagtctaaaccactggtaagtgtcatgtctgagttttgaatccagttgaccaactttaaatcttctgagcctaaatactatgctatttttcgcaaaaccatctgttgcctcctcaaagttcttttgttttgttttgttttgagacagagtctcgctctattgcccaggctggagtgcagtggcgcaatctcggctcactgcaagctccgcctcccgggttcacgccattctcctggctcagcctcccgaatagctgggactacagccgcctgccaccacgcccggctaattttttttgtatttttagtagagacggggtttcaccgtgttagccaggatggtctccatctcctgacctcgtgatcctcctgccttggcctcccaaagtgctgggattacaggcgtgagccaccacgcccagcctgccacctcaaagttttaaggttgggagttcgccatccctgagtcagcaaagcactgcaacaaaaattgttttaatgcatttatataactccttatattctgactttgaagaaatcttcaagctgactaagtaagtaaagaattgtattatctaatgccgaacatattttatgttactggcttgaatacagtttaaaggacaaataatttcttttgatcttttcagtgggggaatataggtggttttatggagaaaggaatagatgtggccattataatggtaaaatcttggaaatcaagttatatataactttagacaagtaacttgtcattttttccccatataccagatgctagtttttttctctaaagttcctaaggccctttatttataaaaaaagaaaaaaaaaagaatctttgatgtgtgagctaccaatgccattgaattgaatccacatctgtgtgagttcccttgactgagcttggccctatgctgtcaccagcaaatctaatttattctttttttttttttttactatacttcaagttttatggtacatgtgcacaacgtgcaggttagttacatatgtatacatgtgccatgctggtgtgttgcacccattaactcatcatttagcattaggtatatctcctaatgctatccctgccccctccccctaccccacaacaggccccggtgtgtgatgctccccttcctgtgtccatgtgttctcattgttcagttcccacctatgagtgagaacatgtggtgtttagttttttgtccttgtgatagtttgctgagaatgatggtttccagcttcatccatgtccctacaaaggacatgaactcatcatgtttcatggctgcatagtattccatggtgtatatgtgccacattttcttaatccagtctatcattgttgcacatttgggttggttccaagtctttgctactgtggatagtgccgcaataaacatacatgtgcatgtgtctttataacagcatgatttataatcctttgggtatatacccagatccaggcctttgacaaaattcaacaacccttcatgcttaaaactctcaataagttaggtattgatgggacatatctcaaaataataagagctatctatgacaaacccacagccaatgtcatactgaatggacaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaatccccatcgtctcagcccaaaatctccttaagctgataagcaacttcagcaaagtctcagtatacaaaatcaatgtgcaaaaatcacaagcatccttatacaccaataacagacaaacagagagccaaatcatgagtgaactcccattcacaattgcttcaaagagaataaaatgcctaggaatccaacttacaagggacgtgaaggatctcttcacggagaactacaaaccactgctcaatgaaataaaagaggatacaaataaatggaagaacattccatgctcatggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaagtctacagtaaccaaaacagcatggtactggtaccaaaacagagatatagaccaatggaacagaacagagccttaagaaataatgctgcatatctacaaccatctgatctttgacaaacctgacaaaaacaagaaatggggaaagcattccctatttaataaatggtgctgggaaaactggctagccatatgtagaaagctgaaactggatcccttccttacaccttatacaagaagtaattcaagatggattaaagacttaaatgttagacctaaaaccataaaaccatagaagaaaacctaggcaataccattcaggacataggcatgggcaaggacttcatgtctaaaacaccaaaagcaatggcaacaaaagccaacattgacaaatgggatctaattaaactaaagagcttctgctcagcaaaagaaactaccatcagagtgaacaggcaacctacaaaatgggagaaaattttcccaacctactcatctgacaaagggctaatatccagaatctacaatgaactcaaacaaatttacaaggaaaaaacaaccccatcaaaaagtgggagaaggatatgaatagatacttctcaaaagaagacatttatgcagccaaaagacacatgaaaaaatgctcatcatcactggccatcagagaaatgcaaatcaaaatcacaacgagataccatctcacaccagttagaatggcgatcattaaaaagtcaggaaacaacaggtgctggagaggatgtggagaaataggaacacttttacactgttggtgggactgtaaactagttcaagcattgtggaagtcagtgtggcgattcctcagggatctagagctagaaataccatttgacccagccatcccattactgggtatatacccaaaggattataaatcatgctgctataaagacacatgcacacgtatgtttattacagcgctattcacaatagcaaagacttggaaccaagccaaatgtccaacaatgatagactggattaagaaaatgtggcacatatacaccatggaatactgtgcagccataaaaaaggatgagttcatgtcctttgcagggacatggatgaagctggaaaccatcattctcaacaaactatcgcaaggacaaaaaaacaaacaccgcgtgttctcactcataggtgggaattgaacaatgagaacacatggacacaggaaggggaacatcacacaccgggcctgttgtggggtagggggaggggtgagggatagcatttggagataaacctaatgttaaatgaagagttactgggtgcagcagaccaacatggcacatatatacatatgtaactaacctgcaccttgtgcacatgtaccctaaaacttaaagtataattaaaaaataaaaacatttaaaaaatgaaatttaactaatacaaaagtgattaactttaaccatatatttattacttccagtgctctcatcttctggtgcggattagaatttccatatgatattagctgaggccaacgtccttctgctttaacacgttttgtactcaaaatttctttgtgatacattctttcagcccttgtgtgttttttaaaagtttttattctttcttcatctttaaaagatacttttatggagtacagatttctagagagagtgacattaacatgatggtggatatattcggggctgtagggtgttgtattagcccattttgcgttgctataaaagaatacctgagactgggcaatttatagacaaaacaggtttatttggctcatggttctacaggctgtagaagaagcatggcactggcatctgctcagtttctggtgagagtctcaggaagcttttattcatggtggaaggcaaatggagctggcatgtcacatggcaagagaggaagccagacagagtgtaggtgctaggctcttttaagcaatcaggtctcatgtgaattaatagagcaagaactcactgattgccatgggcagggcaccaagttgttcatgtggaatctgcccccatgaaccaagcaacttccattaggccccacctcaaacatttgagatcttatttcaacatgagatttggagagacaaatatccaaactgtatcaggttttccaattataccctcccacagcaacaataaaatggcaatcatcatgcataaaagtgcttttgtaggagctttgagatccaggcaaaatattgcgaaaccctggtggagtacaagaccaaaaagaattcttcttctaagaagggcccaggtcctggtggcaggcttgttggccatggtcctagccacaaattcagaaatagctctttccacctgcagattcacctatagccttgtttggtcttggttttgccacaagtaacacccttgtagagacccaggaggcactgtgtcttcccataccttaggtaataggcctgccaacttcagtctgagttgtgaactctcaagcagcccatgatctagcttcagcctctctcagcaatggttagtcctgcccacaccaggtagaagatgcacaccaggtagaagatgcatctgtttatgctcctacaggcgggctggtaaattccagtttaactgcagatcccaaggagtccctttaacgaagctctagcccctcctcattgtgatctggaagaagtgctgcctacccaggaatctgccaggagaaatgcttgtttgtatacctagaggcaggcacactgagcttagaagattctgaagcaaccctgctacacagctccagtgtcactcagccacggtgagtgagtaacctggcagaagatgaactcatccattcctccaaagttggacttaaaaaccttgaaatgggataacatatttgcaaatcatatatctgataaggagttaatattgaaaatatataaggaatgcaatagcaaacaactcaataccaaaaggaccactaatgtgattaaacaataagcaaagggacctaaatagactttttttccaaagaagacatacaaatggccagaaagcgtatgaaaaaatgttcaacattactaattatcgtaaaatgcaaatcaaaaccatggtgacctatcaactcacaactgttaggataattataatgaaaaagacaaaaggtatcaggtgttggcaaggatatggagaaaaggggactcttgtatactgttggtgggtatgtaaaataatgcagccactatgaaaaacaatataaaggttcctgaaaaaattcaaattgtatctactatatgatccagcaatcccacttctgggtagataacaaaagaatataaaattaatatctcgaagagatagatacctgtactcccatgtttattgcagcattattcacaatagccaggacatgcaacaacttaattgtccatcaactaatgaatggaattaattaatatattaaatattaacaaaattaaaatggaattatttatatattaaaattaatatataagtatatattcatataacatacatattacattaacataattatatatgtacacatatataggagattatgtcatttgtgacaaaatgggtgaacttgaaagatattttgctaaataaaataagtcagacaaataaatacaaatactgtatgatctcaactatatgtagaatcccaaaaatcagtcttatagaagcagagtagaaagataattaccaggagctatataagagtggaggagaaatggggagatgttgatcaaagggtacaaattttcagttataagatgaataagttatggtgatgtaatttacagcatgttgagtatagttaatactgtattgtacacttgaaattttcttagagaattgatcttgtgtcttcaccacacacacacacacacacacacacacacacacacataaatggtaactatgaggtagtggatgtatttattggcttgactgtggtgatcatttcacaatgtatacgtacacataaccatcaattcatacactttaaatatatgaaattttatctgtcaataatacctcaatggccatactgcccaaggtaatttatagattcagtgccatccccatcaagctaccaatgactttcttcacagaattggaagaaactactttaaagttcatatggaaccaaaaaagggtgttatcttttatttcctctcacatgaaaattacactcattttcttcccagcacatcatagatgtctaatttaatcatggcattggctaaactcaggatctcttgatctgtgtcaggtggctactctttttttttttttttactttatacacatttttatatgattataaactgtttctttttcttagttaacatattctaattgtacaattttatggggtaaaatttggcgtttcaatacatgtatatgttgtaatatgatcaaatcagaattgttaacaccagtatcttatgcattcatcatttttttgtggtgagaacattcaaaggactctcgtctggctattatgtcatataatgtcttactgttaattatagtcaccctcctgtgcaaaaaaataagaaagttgatattatagaaatggagaatggaataggaaactttttaaacaatgcaatttaaaggtcaattttcaaaagaaaaaagcgaggtaaaacatttgcaaaatgaatgtaaacatatatttacagatttgctaagagggtagatcttatgtttagagtctttaccacacagtcatgtgcatgagtgcacccacgcgcacacacacacacacacacacacagagatagagagaaaataaaaaaaatacaaaaagcggtaggagattttgttttcttttacatgttctgtgctaagaatataatactttcacaataagaaaataaaaccaaacaattttttaaaacattaaacatcatacaaataatgaaggaaagtaaatatttactattagcagttatcaggcttttttggttattttgtttttaaattttttatttccataggttattgggaaacaggtggtatttgcttacatgaataagtgctttagtggtgatttgtaagattttggttcacccatcacccgagcagtatacactgcacccaacttgtagtcttttactcctcacccccttccaatcctttccccctgagtccccaaagtccattatgtcattcttatacctatgcattctcataccttagctcccacttatgagtgagaacattggatatttggtttttcattcctgagttacttgacttagaataatagtctccaatgtcatccaggtcgctgtgaatgccattaattcattcgtgtttatggctgagtagtattccatagtgtatatatatatattccacagtttcttcatccactcattgatcaatgggcacttgggttggttccacatttttgcaattgtgaatcgtgttgctataaacgtgtgtgtgcaagtatcattttgtataatgacttcttttcctctgggtggatacccagtagtggggttgctagatcaaatggtagttctactttcagttctttaaggaatctccacactgttttccatagtgattgtactagtttacagtcccactggcagtgaagaagtgatccctgttcagcatagccacaccaacatctattattttttgatttgttgattatggccattcttgcaagagtgaggtggtatcgccttgtggttttgatttgcatttctctgatcattagtgaggttgagcattttttcatgtttgttggccatttgtgtatcttctttagagaattgtctattcatatccttagcccacattttgatggtattgtttttttctttgctaatttgtttgggtttgttgtagattctggatatttgtcctttgtcagatgtatagattgtgaagagtttctctcactctgtaggttgtctctttactctgctgactgttccttttgctgtgcaaaagctttttaaatcagttaagttccagctatttatctttgttttaattgcttatttttcatctgcatctcctctttattgaagtatctatttaattatttgattcatttatactgggttatttgttttgtcattattgagctctgagaacttgattttcatattctggatgcagatcctttataatccatgagtttgcaaacactttatctccatatatggcttctctttttattctatcaacaatgtctttcaaagagaagtcatttttaattttgataatgcccaatttgtcattgtatcttctaacagataatgctattggtgtcatatatgaaaatcctttgcataattcaagataagaaaaactttttctgttatattttagaagttttatggtttaagtttacatttataactatgatttatttcaagttaatttttgtatatgctataaggtgacggtcaaggtttatatttttcatacaaatattccagaatcactatttgtatgtaaaaaaggtattcatctgaggttcctttgcacctttgtcaaaaacagttgcctgatcagcaagatgacagactaagtagctccaggtctttattccccccacagaggcaccaggataacaactaaatgtagacaagaatacctttttgagaattctagaaaacagctgaaaagctaaggcacacaagttgacacaaaactaacaagaaattttagtgaaaggggtagaaaactttacaactggaaggaaatctcccatactagggcccatctttcaggatgaaaacaaaagagtggaccatgtatccaatgttctggtttgtctagggattactagagtgattgctttttattttgcctgacacagtactgaatagattggagacctagtttgggagtcattgaaaacagttgcgcacccagcaggttaggactgcagctcctcaggcaaacaccagagggagcaagagattacaccagaagaagcaagggcagacagttcaggaaatttgagtctgttaaaatcacatgcacaagcccaaaaatgacacattttcagaaaatatttgagagttcatagaacctctaacaggctgattagcgaatgttgtcccctgtacaaagctatactttaaatactgggagagatggtggttttctaatgcccaaatctcaacaaaagattataaggtatacaaaaaaaaaaaaaaaaaacaaaaaacaaaaaacaggaaaacatggatcaatgaaaggaacaaaataaaactcaagaaacctacctaaagaaatgcagctctatgagctacctcacaatagatgtaaaataactgtgttaaagatgcttgacaaggtaaaagaaaacattttttttgagttaatatacattatatgtaggctgtatttttttaattttattattattatactttaagttttagggtacatgtgcacaatgtgcaggttagttacatatgtatacatgtgtcatgctggtgtgctgcacctattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggggtttggttttttgtccttgcaatagtttactgagaatgatgatttccaatttcatccatgtccctacaaaggacatgaactcatcagtttttatggctgcatagtattccatggtgtatatgtgccacattttcttaatccagtctatcattgttggacatttgggttggttccaagtctttgctattgtgaatagagccacaataaacatacgtgtgcatgtgtctttatagcagcatgatttatagtcctttgggtatatacccagtaatgggatggctgggtcaaatggtatttctagctctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttttttcttgtaaatttgagttcattgtagattctggatattagccctttgtcagatgagagaaatctaaataaaatcatataaagaatgcaaaagccaaaattacaataaccgacaaagagatggaaactatcagtgcatggtggtgggctatgagatagtctttctttcctcaacaaagataaacaatgtggcaactattcatgaagaaaaataaatctgaaagtgcagaggacccacttaaaagattgttttaaagaaactcagcaagttacaagagaacatgtataaaaaacttaataaaatcaggaaatcaatacaaaaacaaaatgagaaactaaacaaagagattacaaatattaatattttttaaaaagcagaaatttgggggctgaaggagaaaatggctgaattaaaattgcaatagacagctttaacagaagactagatttagcagaagaaataataaacaaactcaaggaaatgtcatttgaaatcatttagtcagaggataaaataaaaagaattgaagaaaatctacagggtttatggcacaccatcaagagagcaaacattccaataataatatgtttttccccttgatatccatgtgaaattggcttcagaatgcctcagagatactgaatcctatggatgcttaagtctcttatataagatattatagtatttgcctataacctgagcacattgtcccatatactttaaatcatctttagaatacttacaatacctaacactatgtaaatgtcatacaaacacttgctgtactgtatttttttattttttattgatgtattgttatttttcctttttttaaatattttttgtccatgattggttgaatatgttgatgtagcacctgcaaatatagagagctaactgtatttacatgaggagaagagagataatttgtaccagaaagcttatttaaaggaataatagctgaaaacttcccaaatctgggacatgatgtaaatatctaggtataggaagctcagaattctccaataaaatttaacccaaagaagagttcactaagacatattataatgaagctatcaaaatccagagacagataagaattctgaaagcaccaagagaatataagcatatcaaatattaagggagcaccaatatgactattggaggatttctctgcagaaaccttgtaggccaagaaattgtaagaatgtgctaaaagcaaaacaagactgtaaaccaagaatactttgaacggcaaagctgttttacagaaatgagggagaaataaagaatttttcagacaaaaacaaaacaaaacaaaacaaaaaaacagctaaaggattttatcaccaccagtcctgccttataggaaatgacaaaagaagctatttttctgcaagaaaataattactaattagttccatgaaaacaggaaagtttgttctcagatgcataatttgcaaatattctctttcattctgtaggttgactctttatttggttgattatttatttcgctgtgcagaagcttttcagtttaatgaagtctcatttctctacttttgttttcattgcatttgcttttgagatctcagccataaattcttgtcctaggccagtgttgggaagagttttttctaggttttcttcaagaaattttagtttcagatcttacatttaagtcattattccattttgagtttaattttgtatatgatgagagatagagatccacttttattcttttgcctatgactatccaacttttcaaacaccatatattaaatagggtatcctttctccattgtttttgcctactttgtcaaagatacgttaagggaaggtgtgaggcattatttctgaggtctctattctgttccagtgatctatgtatctatttttatatcagtagcatgcagggtttttttggtggtgtggtggtgttgctttttttttttttttttttttttttttttggagacagagtctcactctgtcgcccaggctggagtgcagtggcatgatctcagctcactgcaagctctgcctcccgggttcacaccattctcctgcctcagcctccgagtagctaggactacaggcgcctgcccccacgcccgggtaatttttttgtatttttagtagagacggggtttcaccatgttaaccaggatggtctcaatctcctgacctcgtgatccgcccgcctcggcctcccaaagtgctgggataacaggtgtgagccaccgcacccagccgcatgctgttttgattactatacgcttgtgatataatttgaagtcaaataatgtgatgcctctggctttgttctttttgcttaatactgattcggctatatcagctcttttttggttccctataaatttgagaataattcttttctgattttgtaaaaaatgacactggtattttgatagcaattgcattgaatctgtacattactttcggcagcttggtcattttaaccatattgattcttctaatccatgagcatgagatgttttcctctctgtttatatgatgtattatttctttgtttggttttttatagtttttcttttagagatgttttacctcttacattaattgtactgtgaggtgttttcgattttttgcagctgttgtaaatgggactgattccttgatttgaatctcagcctggtagttattggtgtatagaaatgctactaattttgtatgttgattttgtatctgagactttacttaattcatttatcaaattcaggagtcttgtgaggattctttagagttttctaagatcatatcagccaaaacaaatctttcattttctttccatttagatgcattttttttttctttctcttgtcaaatagttctggctaggacttccagtactatgttgcataggagtggtgaaagtggatagccttttcttgttccaattcttagtggaaatgctttcaactattctccattcagtataatgttggctgtgagttttcatatattgattttattcttatcaggtatgttcattctatgctgacttgttttgggtatttattatgaaagaatgttaaattatatctgatgcttttctgcatcaattgagatgaccacacatttttttttcagtgctgtttatgtggtaaattatttattgacttatgaatgttgaaccatcctcacatgcctggaataaaatccatgagatcatggtattttatgttttcaacaggtttttggatttggtttgctagaccttgttgataatttttgcaactatcctcatcagggatattgatctttaattttctttttagttgtgtcctttactggttttggtaccaaggtgatattggcttcatataatgagtgagggatgatgtcctcctcctcaattttttggaaaagtttcagtaggattggtacaagttctttgcatgtctggaagaattcatatattcccaagtacatgaaaacatgtgaatacatgtactcatgagtagtgggattgaatcagtaataaaaaatctcccaacaaagaaaagcctgggagtatgttgttgggtgattttttattacttattaaatctcactagtcactattcattattggccttttcagcgtttctatgtattcctaatttaatcttagcaggttgtatgttttcaggaatttattcgttttctttgttttcttgtttgtgagtgcagagaatttcatagtagtctctaatgatcttttgtatttctgtgtaatcagttgtcatgtctcctttttatgtttatttgtatattctctcttctgtattttcattagtctagtgttttatcaattttgtattttttaatgaagcgaatttttgtctatttatattatgtattgtatttttatatcaatttttctttatttcatttctgctgtttgtgatttcttttcttttactagctttgggtttggtttgattttctttttccagttctttggagtgcaatgttagagttataatttctggtttttctctccttttaatgtaggaatttaatgctataaactctccctgttagcactgtttttggtgtatttcagaggttttggtatgttgtgtctatttttatgcttttcaaaacactttttaatttccatcttaatttcatatggacacaaagatcattcatggtaaggtttactgtcatgtattttatagttttaagactttctcttggtatttacttctagttttattccaccatagtgcaagaagacactcgatgtgattttgatttttcagaatttattgtcactattttttgggagtatcatatggtctattttgcaaaatgttccatgcactaatgagaattatattctgcatttgtttaataggatgttctgtaaatttgttagattaaattaagttaaattaaattgatctggagtccaatttaatctagtatttctttgttgatattctgcctctgtttttctagtgtgtcagtgggctgttgaagtcccccactattagtgtattgatgtctatatcttttcctaggtccactagtacttctatgaatctgagtgctccagtgttgggtacacgtatatttaggatttttatattttcttgttgaatggattaatttatcattatataataaccttgtctttttttactgttgttgatataaagtctgttttatcagatgaaagtgtagctactcctgctctcttttgtattgttatgtttttcaccactttaccacgcatctatgaacatctttaccagttagatgtattttttttttgtaaagagaatatggttgaatcctattttttagtccattctgttagtttatatcttttaagttgggtattgatttaatttgtgttctaagttcacattgacatgtaaggtttggttcctgtcatgatgttaactgttacctagttactttgtagccttaattgtataattgttttataagatctgtgagttttatacttttatgtgttttgatgatggttaatatagacttttcagttccatgtttagaagtcccttgagcacttcttgtaggaccagtgtagtgcttttaaattcccttagcatttgtatgtctggaaaatatttcattttattttattttttcatttgtaaggttatagtaggatacaaaattcatggttggctttttacaaagtctaaaaagatacctcaatcttttctggattgtaagttttctgatgcaaaatgtgctgttaatctagtgggatttcctttatttgtaattagacaattttctcttgcagtaagtccatcttgcaatgtatcttactcaagttctctgaggttcttgatttttttcccttcatttttgtttcagttaatttgaaaaacctgtcttcaagtgcgccaagattctttcacttgatctgttgttaagacttgcacctgtattttgtaattcctttaatcttttttatttccagaagtgttattttttaaataaatatctatctcagtaaattttccatttaaattctgatttttttatttgtttgtgttggtttggggcttcttaatattcaatgtctcaaattctttatttggtatttcaaagattttattatggctagaatccattgttacagacagtgtgattctttgtcagtgttttaacactggtttctgtacttccagaatggcttaacttatttatcctcaccttgatcaactatctcttcttattattgttgaatttacttgcatttggtcttgtttttttctccttgagaatgtgactctaacatactttgcacagggtcatccggctctggttctgggtcttttcagaggcaaaaactctctctgagtttcttgattaaagatagcatatatttggtggctttctcaatagctgcttttagtagcaatacaccaagtataggagcagccccacagtctcctgcaaggccaggatggttagaagtctcaggaagcttatctcattccccagtactgtgtatttgtgtcagcagattttttgttgggatatgtagttcaacctccaggccagtaggtaggggttacaggtaagacccagttgtggcagaagcaaatgtgtatgtgcttgatctttgtttaccagtagaagctctctgttgctttatgctataggctgatttgtgaaatgcaaagtggtgtgagctccctgctcacctcctgaggggcacataaatctgggtggagttgcactgccaagtccgcccttggatacctaaattgtaagcaaaagcacctgctgttatgggggtagtgcaaggatctcctggtgaaatgcacctaggtctccacagctgatggaggcagctgcaacagcaccactccttgggcaggctggaaagcaatatgcttccctattatgccccgtcccagcattcaggacactcagattggacagacaccattgtctatctccaggctgcagtgtatccaagagccatgaaagatgcctgctccacagctcatcaacataatgtctttgacatggaacatccttcctcagcctaaaacaaacagctttgtggctcttctgttctccactgcaggaacattgctgctcaaaaaagagagggatagagctacacttttcatgcaagatctggcctagtggatacactgccaatgtggacacagctgcccctaatagccttattatagccatcctctgttctgtctatgccaacctcctgcagaagcaaccacagctgtgtctgtggcagtgttgggggaggtgaagtccctctttctatgtatgtccatgcctgagcactgaggccacctggctgctgagatgaaaccatgctcctctcttgtgaagcagagtatagttcccaggtctctgctgagagtggtgcaatcactctcaatcagctagaggggtactcttgggcacagcaatctatatgctctgatctcctttttcctagagggtgcccacttggtgaactgcactattcattcccgtaggatcagcactccccaagggctagactactgagtaccttgaagctcctctgggtccagccaaccactggggttgctgcaacccaagaaagtcttgaggaatgtctgcaggggctgcgatgatgtgaaaacacaaggactgatgttccccaggcaggacactgtcccacaataggtgcaccacaagtatggcaccaaccactgcagctcaggtctgctgggagaatgaatgattgttttgtaatctggtagtcctgtgtaatgccctcaggaagttcccaaattaccatagacaccagtgcccaaatttgggagggcagaggagctctgttacagtccagatactggtggtctgctgcaggtgtaaagggagcaaaaaacacactcacctaccctttcgacaaaataccaagtcccttgaggctactagctgatttctgccaatctctgttttcttctttttctgtaccctggcttcttctcatgtgtttttcacacctttcccttgatattctattcaaggtgtaattattcacctgcaactttgtggttctttctgagaactggcatttggcatctctaggcagccatcttgaaacaaaggattaagacatatatttatcatgaggaattgtgtcatgtaattatcaaggatgaaaagtccctcagtctagcatctgcaagctagatacacaggaatgttcacaatgtaatttagtctggatccaaatgcctgaaaaccaggggaattgatagtgtaaaccctatcctgagtgcagaagataagatattccagttcagttaggcagaaaataagggaggtaaattctttcttacttttgccttttgttctattcaggccctcaacagatgagatgatgccaacccacatgagaaaagcaaactgctttactgagttcatcaactcaaatgctaaccttgttcagaaataacctcacagacacaaacagaaacaatgtttagtctgggcacaccaaggtcccctcaaattgacacataaaattaatcacatacataaagcatcctattgtatgattatatttacataaaaatttagaattggaaaattcatagagacagaaagtagactgtcatcgccacagtagaaggtagaaagtattggggattaatgttaatgagtaaagattttttgagagggagattcaaacattctagaattatatagggttaatgctcacaaactctgtgaatagaccaaattatcactgagctttatacttttttttttcctgtttccactttttttatattttcagtttacttttaagttctgggaggcatgtgcagaacgtgcagatttgttacataggtagacatgtgccatggtggtttgctgcacctatcaacctgtcatctaggtttttagtcccgcatgcatcaggtatttgtcctaatgctctccctcccctttccctcaaccccctaacaggccctggtgtgtgatgatcccctccctgtgtccatgtgttctcattgttcaactcccacttgtgagtgagaacatgcagtgtttagttttctgttcctacattactttgcagagaatgatggtttccggcttcatccatgtccatgcaaaggacataaactcattattttttatggctgcatagtattccatggtgtatatgtgccacattttctttatccagtctatcattgatgggaagttaggttggttccagtctttgctattgtaaatagtgctgcaataaacatacatgtgcatatgtctttatagtagaatgatttataatcttttgggtacatactcagcaacgggattgctggatcaaatggaatttctggttctagatccttgaggaattgccatactgtcttccacgatgggtgaactaatttacactcccaccaacactataaaagcatttatatttctccacagcctcaccagcatgtgttatttccagactttttaataatcaccattctaactgacatgagatggtatctcattgtggttttgatttgaatttctctaatgacctgtgatgatgagcttttcttcatatgttttttggccacataaatgtcttctctcatgaagtgtcttttcatatttttcgcccactttttgaggaagttgtttttttttccctgtaaattttaaatttgtctaagctccttgtagattctggatattagacatttgtcagatgggtaggttgcaaaagttttctcccattctgtaggttgcctgttcactctgatggtagtttcttttgctgtgctctttagtttcattagatcccatttgtcaattttggcttttgttgcagttacttttgtttttttagtcatgaagtctttgcctatgcctgtgtcctgaattgtattctctaggttttcttctagggtttttattgttttgggttttacatttaagtctttaatccaccttgagttaatttttgtttaaggtgtgaggaaggggtccaaattcagttttctgcatatggctagccagttttcccaacaccatttattaaataggaaaccctttccccattgctttttttgtcaggtttgtcttagatcagattgttgtagatatgtggtgttatttctgaggtctctgtgatgttccattggtctatatatctgtttcggtagcagtaccatgctgttttggttactgtagtgttgtagtatagtttgaagtcaggtagcatgatgcccccagctttgttctttttgcttaggattgtcttggctatatgcgcttttttgggtttcatatgaaatgtaaagtagttttttctaatactgtgaagaaagtcaatggtagattgatgggaatagcattaaatctataaattactttgggcagtatggccattttcatgatactgattcttcctatccacgagcatagaatttttttctatttgtttgtatcctctctcatttccttgagcagtggtttgtagttctccttgaagaggtccttctcgtcccttgtaagttgtattcctaggtattatattctctttgtagcaattgtgaatgggagttcactcataatttggctctctgcttgtctattgttggtgtatagaaatgcttgtgatttttgcacattgattttgtatcctgagactttgctgaagttgcttatcagcttaaggagtttttgggctaagacaatggagttttctaaatacacaatcatgtcctctgcaaacagagcaatttgacttcctctcttcctattttaataccctttatttctttttcttgcctgattgccctgatgagaacttttaacactgtggtgaataggagtggtgagagagagtatccttgtgttgtgccagttttccaagggaaagcttccagcttttgcccattcagtatgatactggctaggggtttgtcatacatagctcttattattttgagatatgtttcattaatacctagtttattgagagtttttagcatgaagggatgttaaactttatagaaggccttttctgtatctactgagataatcatgtggtttttgtcattggttctggttatgtgatggattacatttattgatttgcataaattgaccagtcttgcatcccagggatgaagccgactttatcgtgttgaataagctttttgatgtgcttctggagtcgaatccctgaatagaccaataacaagttctgaaagtgaggcagtaattaatagcctaccaaccaaaaaaaaatcccaggagcagacggattcacagccaaattctaccagaggtacaaagaagagctattcccattccttctgaaactattgcaaacaaaagaaaaagaggaactccaccctaattcattttatgagaccagcatcatcctgataccaaaacctggcagagacacaaaaattaaagaaaatttcaggtcaatattcctgatgaacattgatgagttttagacgtttaaaatgtgatttttatggcatgtgaattatatcacttttttttttttgaataggcaagtccagctcctgacagaattctatggaaatgaccttctgaagaagggcccccaagaagaataaagttgctgtttcattaggcctacctgtgtatctaacaggatgggccaatttggtaactaggtctgctccctataaacttacctaatcatccataatctatcttgaatactcccagattttactgattatagtcagaaaatatgttggttacattggaactgaagttttatctaacttcagatctcagatttcactgaccagtaatccacattaaaaagtggcttctcctgcaatatgacttttctacccatctatttattcctttgtaaaatatttatggtgtatttatcactttctgcggatacaatgaaagaaaaaatctgatctctgtgcttttggagtttatagccataaatgctaaatgtagtcattgtatgtcattttctgacagatcttggaattatgacttggcaggagaacggtgcctatttctggcagagtaaaaggatagctgtaattggtatacccttttcacttagatgggtttatttaaaatgctcccaaaagaatttatgaatcatgaagtgaaatcaaaaatttatggatttgaaattttgtttagaagacaggattgaggaaatatttattgacagaatgtcgtgattaagcaaagggagatacaaagatgatatctagatttttgtttgatcaagaacataaatggtgatgtcactcctctgttgatcttaacttcatgatgtctctgatatacattctatcctctctattcttaccatcactgccctagtataggtcttcagcttccccttcataaactattacaacagtttcctgcatccagtattgatttcctctaattcatatgctatactgctgccaaagctatctttataaaacagaaactaaactacgtcactcttttttcagaaaaatttcaatgctcctgtattagtttgttttcacgctgctataaatatactacctgagactgggtaatttataaacaaaagaggttgaattgtctcacagttccacatggctgtggagacctcagggagctttcaatcatgggggaaggtgaaggggaggcaagcaccttcttcacaaggtggcaggagagagagtgatagtgcagaggaaactgccacttttaaaccatcagatcttgtgagaactcactcattttcataagaacagcgtggggaaaacttcccccatgatcctatcacctccctccctggacacatgggcattacaggtccctccctaaacacttgaggattacaattgaaaatgagatttgggtggggacacagaaacaaaccatatcagctcctataataacgtccaatggtaacaagaaaacataatagcctgtctagagctactgggttgctgagaagacagacctaccattttcctcaactggacaaaaaatgtactttctcaagacacttggcaaatggaaataaacatgattgtctataaagaattgcagctgcacttacacgaatagtttttgtttatttactcccaaacttctcataaatagcatagaagaataaggcaaggtatacttctaggtaatggtgatgagtttcaccattatttatgctaattgagcagaaatgcatacatccatttatgatacgttctcctttctcctctgcttttcacagagactcttacaattattggttcaccagagtgactaacttcctttttcataatacgctatggctatcatgaccaagatattagccaagtaagagaataaatattaagattctaacgtagctgattggatcagggcctcacctacctagggaagtccagagtgggaagagcaagaggaatgagaaagctaacacaatttagggaaactagagtcaaacactgaagagactgatatggtttggatttgtgtccctgctcaaatctcatgtggaattgtaatcctcgatgttggagaaggggcctggtggaaatgtgactggatcatggaggcagattttctccttgctgttcttgtgatagtgagtgagttctcatgagatgtggttgtctaaaagtgcatggcacttcaccctgttctctgttttcctcctgctctggccatataggatgtgccagcttcccctttgccttccactatgattgaaagtttcctgaggccttcccagccatgctacctgtacagcctgtggaaccatgagccaattaagcctcttttatttataaattacccagtctcaggtatttttatagcattgtgagaatggactaatataaagaccaaaagcaaaagacagtagtaaataattttaaagatgggattaatgctgggatgaggacctgcaaatttagtaagctaggtatatgtatttttttctcattatgttttcagtgatacactatttagctataattaagacacaaataatatttcactttataaataaagctgtaatttgcaaaagtatatattctatatacaaacagatatactgcatataggcacataatagtgtatgtgattttaaacttttaaagagcaaatctacatgtatagttttattactcaggctacacgccaagtattaatagtgaatatgtctggagaataagatttgagaaaagaaggtttacattttctcttttatacattgtctgtttctatttgccataaatatacgctattattttatttaacttttaaattcaggggtacatgtgcaggttcgttagataggtaaacttgtgtcatgggggattgttgtacagattattttgtcactgatgtattaagcctggttcccattagttatttttcctaatcttcccgcttctcccaccctccaccctctgataggccccagtgtgttgtttccctctatgtgtccatgtgttctcattatctagctcccacttataagtgagaacatgcagtatttggtgttctcttcctttgttagttagctaagaataatggcctccagctccatccatgttcctgcaaataatataatctccttttatatggctgtatagtaatccatggtgtatatgtaccacattttctttatccagtttatcattaatgcatatttaggttgattccatgtctttgctgttgtgaatactgttgcaatgagcatacacatgcatgtgtttctataatagaacaatttatattcttttgggtatatacccagtaatgggattactgggtcgaatgatatttctctttttaggtctttgaggaactgccacactgtctttcacaatgggtgaactaatttacacttccacaaacagtgtataagtgtccctttttctctacaacatcaccagcatctgttatttttggctttttattaatagccattagtgtgagatggatcatctcaaaagcttctcaaactgatgaacaacctcagcaaagtctcagaatccaaaatcaatgtgcaaaagttactgatattcctatgcaacaacagttaagctgaaagccaaatcagaaaggcaatccctttcacaatttccacaaaaaaaaaaaacaaaatacttaggaatacagctaaccgggatttgaaagatacttacaagaagaactacaaaatactgctcaaataaatcagagatgacaaaaacaaatggaaaaacattacatactcatggataagaagaatcaatattgttaaaattgccatactgctcaaagtgttttaatagattcaatgctattcccattaaaccaccattgacactattcacagaactagaagaagctattttaaaattcatatgaaaccaaaaaagagtccgaatatcctaagcaatcctaagcaaaaagtaccaagctggaggcatcacggtacctaacttcaaactatactgcagggctacagtaacgaaaatagcatggtactggcacaaaagcagacacctagaccaatggaacaaaacagagaacccagaaataaagccacgcagctataactatatgatctttgacaaacctgacaaaagcaaacaatggggaatatattccctattcaataaatggtgctgggataactggctagccatatacagaagatagaactggagaccttccttacaccatatacaaaaattaactcaagatagattaaatacataaatatgaaatccaaatttatgaaaactctggatgacaaccgaggcaatatcattctagacatagaaataagcaaagatttcatgatgaagatgccaaaagcaattacaagaaaagcaacaattgacaaatggaatataataaaactaaagagcttctgcatagcaaaggaaactgtcaacagagtgaccaagcaacctatagaatcagataaaatttttgcaaactattcatctggcaaaggtctcatatccagcatctataaggaacataagcaagtttacaagaaaaaaaaataaccataaaaaagtgggcaaaggacataaacagacacatttcagaagaagacacacatgcagccaacaatcatataagagaaagctcaacatcatcgatcattagaaaaatgcaaatcaatacattatttttaatgtaagtacattatcataataaatataaatatttctacccctgaaataaagaaattgtttttgaataaggagtagattctaagcaaatactgggtgattaatatactatatttatccatggcatttcatgcctcccctggaaatgagagaagttaatatatatgtttaatgactttttattatttttagtatatttgtaaaaagttacattatctgctctcatcccaatcttggaactagacattaactcacttttgtgaaaaaattacattatctgctctcattacaatcttggaacaagacattaactcactttggatcattgatcaaattaaacacacacagtcaatcactagtttagcttatatattacaaaagaggactgaatcctaatataaacacatttaattatgtctattagggagcagtttggaggggggagggaatgagtcttttcatcaaggaaaaactcagactttacttaatgtttaaatctgaattgtgagtggtttcagaaagtgttctagtttaaataaatccagaatcttcgaactttcctgatttagtaaagtaggggctaagaaacaacttgagcaatcagttgctgcttattattattttttatttgcgatttaactgtagatgacaacagtggaattagactgtgctgcaatatcttagggaatgctaccatcttatggtcaagagtggaaagtccagcaaaaacaaatgctttgagaacaatctaggtggaaggaaagataattcaatttttaagaaggtggtacagcatataagagacatcagttcaaactgaagtgtaccaatttggcaagcttcaagggaaaatgaagtagatacaaatatgtaaaaaatatgcttacatacaaattaagaatgggtcacagctactcaatgacctattaagtaggcaacagatgttcatttataacttcatgactcagagcctgctcaaagtggatgttcctcagatggctactgacttacttatgaactcttattttattttaatttattattttattcatgttttaatttttacaatttttttctttcaacttgtattataagttcaggggatatatgtgcaagtatgttacatgggtcaattgcttgtccctggggtttggtgttaaaatgatttcatcacccagtaatgaacatggtagtcaatatgaagtttcttgacccacaccctttgccaactcttgaccctcaagtaggccatggtgtctattgttcctctctttgtctccatgtgtactcaatatttagctcacacttacaagtgagcgtgcagtatttggttttctgttcctgcataaatttgcttaagataatggccttcagctccatgtttgagaaaggaacatgatttcattccgttttatggctctgtagcattccatggtgtatgtataccacatatcatttatccagtataccattggtgggcaaactaggttgaatccatgtcttcactattgtgaatactggtgtgaatactattgttaatggaacatatgagtgcatataccttttgggtagaatgacttatattcctttgggtatataccaaataaagagaatgctggattaaatggtaattctgttttaaggttttttttgtttgtttgtttttctttctttcttttttttttttttttaaatctccaagctgctttctatagtggctaaactaatttgccttcccactaatagtgtataagtgctcctttttctctacagcctcacaaacatctgttatttttttgacccttcagtattagccattctaattgatgtgagatgatacctcattgcagtttttatttccatctctttaacgattagtgatgttgtacattttttcatatacttgttgactgtgtaagtcttcctttgagaattatctgttcatatcctttgctcatttttaatgcagttgttttttgcttgaagttttgttaaagttccttgtaaattctggacattaggctttgtaagatgcatggtttgcaaatattttattttattctgaaggttgtctgtgtactttgctaataatttcttcttttgtgcagaacttctttggtttaattagatccctcttgtaaatgttcctttctgttggaattgcttttggtgaattgatcatggaatctttaccaaggcctatgttcacaatgatatttcctaggttttcttgtagggttttcaaaattttagatcttacatttaggtctttcatcaattttgagtttttttctttatagtgaaaggaagggattcagtttcgatcttctgcttatggctagctagttatttcagcaccattgactgaatagggtttccttccttattgcttctttttgtcagcttactaacagatcacatggttgtaggtgtgcagctttgtttacatgctctctattctgatcgattggcctatgtgtctgtttttgtaccagtaccatgctgtttggttactgcagccttctacttgtttgaagtcaggcagtgtaaagcctctgcctttgttctttttgcttgggatttctttggctatttgggctcttttttgaattcatatgaattgtagaataatttttccccattctgtaaataattaccttggcagtttactaataatactattgaatctgtaagttgctttgggaaatataggcattttaacaatgttgattcctcctatccatgagcattgaatgttttccatttgtttgtaaaatctattatttttttcagcagtgttttgtaattctcattgttgtgatgtttcacctccctaattagctgtattcctagatattttattctttttatggctatagtgaatgagattgcattctgatttggctctcagtttagacgtcattggtgtatacgaattctagtggttttctgtaaactgatattttagtgtaaaactttatggaagttgtttcttagttctaggggcctttggatagagactatggggttttctaggtatttaatcatattatctgtgaaaatagatagtttggctttcattgtgcctatttgaatgcgttttatttatttattttttctgttaccagattgacttggctgaagacttcctgtactatgttgaatgggagtggtgagaatgagaattcttgtcttgttccagttctcaaataaaatgcttccagttttttcccatttatcttgatgtttactgtgaggttttcatagatgactcttactatgtttaggtgtgtttcttcaatgtctaatttgttgagggtttttcacatgaagggatgttgaattttatcaaaacccttttttgcatatattgagatgaacatgtggttttgttttttagttatgtttaggtgttaaatcacatgtattgattgaaccaacctcgcatttaaggaatataagcctacttgatcatggtgtattagctttttgttgcccttctggattcatgctagtaatttgttgaggtttttgtgtctatgttcatcaagaatgttggcctgatgttttccttgtcattgggtctctgccagattttggtatcaggatgatgcaagcctcataaaatgagttagggaggactagcttcttgtcattttttttttgaatagttgtagtagaattggtactagctcttcttaatatgtcttacagaattcatctgtgaatctgtctgatccagggctttttctggttgttaaatatttaattactgattcaattacagaactcatcattggtctattcagaattttaatttcttcctggttcaatattaggaggttgtatgcttttaggagtttatctatttgttctaggttttctagtttgtgtgtatagaggtgtttttgatagcctctaagagttttttgtgtatctgtggggtcagcgaaatatgacatttctcatttatgatcatgtttacttggactttattaataaagtgagttgtctattgattttatttattctttcaaataaacaaactttggttttgttaattgttggtatggattttcacatctcagtttcattctattaagctctgattctggttatttctcctcttctgctacctttgggtttggtttgctcttctttctctacttcccacaggtgtgctgttatgttgatattttaacctttattttaggttcaggtgtacatgtgcagatttgttgtacagattattctatcacccaggtattaaacctagtaccctataatttttttctgctcatctctttcctcctaacctccaccctcagataagtctcagtgtctgttttttgtttttgtttttgttttgcctattggtgtccatgagttttcattattaaactctgacttataagtgtgaacatgtggtatttggttttctgttcctgcattagtttgctaagaataatggcaatcagctccatccatgtttctgcaaaggacatgatctcttttatggttgcatagtattccatggtatatatgtaccacattttctttagccagtctaaaattgatggacatttaagttgattccatgtctttactattgtgaataatgctacaataaacatatacacacatgtgttttcataacagaatgatttatattctttggggtatatatccagtaatgggattgctgggttgaatggtagttctgtttttagttctttgaggaatcaccacactgctttccacaatggatgaactaatttacactcccaacagtgtgtaaatgttacttttatgtgcaacctcatcaggatctcttgttttttagcttttaaatattagccattttgactggtgtgagatagtatctcattggagtttcaatttgcatttctctaatgattagtaatattgatcttttttatatgcttgctggccacaagcatgtcttcctttgaaaatttactgttcatgttttttcttcaccttttaatggggtagcttgtcttttttttttttttttttttttttttgtaaatttaagttccctatagatgctggataacagtcttttatcagatgcacagtttgcaaatagattctcccattgtgtaggtgtctgtttactctgttaatagtttcttttgctatgtagaagctcttaagtttaattagatcacatcactctgttaatagtttcttttgctgtatagaagctcttaagtttaattagatcacatctgtcattttttcttttgttgcaattgcttttggtgtcttcatcatgaaatctttgccagttcttatgttcataatgatactgcctaggttgtcttctggtgtttttatagctttgggttgtacatgtaagtctttaatttattgtgagttgatttgtgtatttcatggtgtaataaaggggtccagtttcaatcttttgcatatggctaggcagttatctcagaaccatttattgagtaaagagtcttttccccactgattttttttttgtcagctttattgaagttcagatggttgtatgtgtgtggccttatttctggacattctgttccataggtctatgtatctgtttttgtaccaataccaggctggttttttgttgttgttagggcagccctgtagtatagtttgaagtcagatagcatgatgtcttctaattaattctttttgcctaggattgccttgcctatttgtggtctttttttttggtaccatatgcattttataatagtttttcttttctaattctgcaaataatgtcattaatagtttaatagcaatagcattggatctgtaaattggtttgggctatatggccattttatcaaaattaatttatctattcatgagcatagaatgtttttctatttgtttgtgtcatctctgatttcttcaatcagtgttttgtatttctcatcgtagagatcttttacctccctcattaggtgtatttctaggtattttattcttttcttggcaattttgaatgacattgtgttccttattttgctgtctgcttggctgtttttggtgtataggaattccattaatttctgtacactgattttgtattctgaaactttgctgaagttgtttactagctaaaggagctttgggaccaggactatggtgttttctagatatagaattatgtcatctgcaaacaaggatagtttgactttccctcttcctatttggattcctttatttatttctcttgcctaattcctctggccaggtcttccaataatatgtgaaataggagcggtgagagagggcatccctgtcgtgtgccagttttcaagacgaatacttccaacttttgttcattcaagatgatgttggctgagagtttgtcatagatggcttctattatttcaatgggcgttccttcaataactactttattgagaattttaaacataaagagatgttgaattttattaaaaactttttctgaaaactacatgagatgatcatgtaattttcgtctttagttctgtttatgtgatgaaccacatttattgattttcatatgttgaaccaaacttgacactcaggaaaaagctctactttagtttggtaaataaggttttctatgtgcttctggatttgatttgctagaagtgtgttgaggatttttgcatcaatgtttatcaaagttattgacctaaatttttattttgtgtgtgtgtgcctgccaggttttggcttcaggaggatgctggtctcatagaatgagttagaaagaagtccttttttcttgaatttttggaatagtatccatagaaatagtaacagctcttttttgtaaatatggtggaatttgacatgaatccaccatgtcctgggctttgattggtaggctacatattacagatggaatttcagagctcattatttgtctattcagggattcaatttctttgtggttccatcttcaaaaggtgtatgtgtccaggaatttattcatttcttctaaattctcaagtttatttgcataaaagttttcataatagtatctgattgttattagtatttctgtagggtcactggtaatgtcccctttgtcatttctaattttgtttatttggaacttcactcttttcttctgtattaatctagctagcagtctacctatcttattaatatttaaaagaacagcttctggtttcattaatgtttgcatgaatgttgtgcatcaatcgatttcagctcagcaatgattttgtttatttctcatcttctgttagcttccaatttgatattctcttgcttctctaggttttcagtgataatgttaggttgttaatttgcgatattttaaactttttgatgacagcatttactgtgataactttctctctaaacaatgcctttgcctttcctggagattctgatacgttgtgtttttgttctcgctagtttcaaaaaacttcttaatttctgcctgcattagtttcattatttactcagaagtcacttatgggtaagttgtctaatttacgtatgattccatggattttttagtcttgaattctatttttattgctctgtagtctgagaaagtcgttggtatgatttcagttattttgaattatttgctgagcgtttttttgttggatatatggtcaattttagagtatgtgccatgtggcaatgagaagaatgtgtattctgctggttttcgctggagaattctgtagagctctatcatatccatttaacccaatcttgattttacatcctgaacgttattttcaaacttgatgatctgtctaatactgtcagtggagtgttgaaatctcctagtattgtgttggatgctaaactctttgtaggtttctaagaacttgctttatgaatctcggtgctcctatgttgagtgcatatatatttagaaaagttatgacttcttgccgaattgaatactttaccattttctaatgacattctttgtctattttgatctttgttcatttaaagtctgttttttttctgaaattagtattgcaatccctgcattttttctgatagccatttgtttggtagatttttctccatccgtctgttttgagcctatgagtgtcattgcacatgagattggtctcttgacgacagtatacctttgggtctttcttatttattcagcttgccactctgtgcctttcaattggtgcatttagcccatttaaatacaatgttagtattcatatgtgtggacttgattctgccattttgccattagctggtttttatgcagacttgattgcatggttgttttacggtgtcactggtctgtgtattgaagtatggttttgtaatgactgctagtgttgttttccttccatattttgtgctttttttatgagctcctgtaaggaaggtctgggggtaacaaattccctcaacatatggttgtctgaaaaatatcttatttctcctttgtttatgaggtttagtttggccagatatgaaattctcctttgcaatttattttctttaagaatgtcgaatataggcccccagtttgttctggcttgtagggtttctactgagaaggctgctgttagtttgatggacttccatttgtaggtgacccaccctttgtccctagctgcccttaacattttttctttcattttgaccttggacagcctgatgattatgtggcttggagatgatctttttgtgaagtattttgcagagtttctctgcatttcctgaattttaatgttggcatctctcagtaggttggggaagttctcatgggtaatagtctgaaatatgttttccaagttgcttccattctcctcatctctttaagagatgccaatgttttatagattttgtctttttacacaagcccatatttcctggaagtgttgttattttctattcattttttaaaatttttcatctgactattttagaaagccagccttcaagctctgagattctttcctctgcttggtctattctactattaatacttgcaattgcattatgaaatttttgtagtgtgttttcaaactctatcagtttggttactcttttttctgtactggctattttgtctgtcagttcctttatcattttcttgtgattcttatcatttttacattgggtttcaatgttcccctaatctcaatgatcttcattcctatccacattgcgaattatacttctttaggccatcttggcctggttaaaacaactactgtggttgtttggaggaaataagacactctggatttttgggttgctaaagtttttgcactggttcttcacatctttgtgggctgaggttcctttaatctttgaaattgctgtcctttggatgagttattttttttttcattttgtcctatttgatgtccttgggggtttcattgtagtataatttgggtccattcaactggcttcatttctggaagattttatgaggttacacctcagttcaggactactgtgctgcaagctctaactctgggggactggtactgggccccggctttgttctctggctcctcaaggttggaaacctcctgttctggaggggctaaggagctcttggatcactggtcagaacacttaaatgggtggtgccatgcaatgcacttcatagggcagtggcagtgggatccatcattgttcacatgtgccaggagtagtggcaaagtcagctgcagcagggtgttattgggtgttgaggtaccaatctctttgtgggtgttcatggcagtgacagagacaactcagctaggggggaaaggggcctccacaagtgactatctgtgttcacatcagttgtgatgttagcatgggggcaagacacttgtgagcacagaactgtgtgtgccttctgtgcctgttcacacaggcagcagtggcaggtcaatgcagaggcaggttcactctcttccatgcatagttttgtgctggtaacagtgtatatgcaggtgtgggtgctggtggggcttgggctggtgggctccatggtggtacaggaatggtgttatagcagtgggagagaggtgggatgcactcatgcaagcagcagtggtacagcagggtgcatgtgcacaccctcactggcagaaaagaaaagacaaggtccacccgcacacatatgtgccagcagagtgatgctgggggtggccttgggtgagtgcattcagacaaagcagcaaagagaaggctgcagtcaggaaagggtgaaaacaggctggtgtgtgtgtgccactctgctggagaactctgccagtcaggtgtggtcaacctgcgcaagagctatgatacaaggatccagaaggtaggtacctggggattgcactgtgagcagatgcaacaaggctggggcctcaggacaggccaacaggccaagtggttctcagcttggactgggcctgtctcatgggcaagactaccatgcagagttcaggtctgacagttgctctagggctaaactctcctatggaggccagttaagcctgggtttatgggcatccctggccgtgctccactatagatgctccaccatcaaaccctctgggcttcacatggaccgaagtttgctgccaccacttctctaagcagctctgcctgccaactcaattatccatagtggtcaacaggtctcctcttactgggattctagaggcccataagagtgtgttgctccttgcctcttcagctcattccttccataagagtcactggaggccaagaacaagtccaattgtgcagtagcaccgtgctgggttcctagctttctcccccttcagctccacatctgtggtttttctctgtctgctctctatgcattccctctgaagaactgctaggagagtgccagtcttcatgatgtcctgatctctcagtaagaaatgttatccctggttttgtatagtcagccatcttgtgaaaagaagtttgttatgttgtagatttgatatctttcaaacttctttatgtaggtcttgagcattaaaatttttcctcttaacattgctttagctgtgtcataaaaattctggtacattgtatctttattttaattcgtttcaaagactttttgatgtctgcttaaattttctgttttcttgtttgtttgtttgacagagtctcactctattgcccaggctggagtgcaatggcgtgatcttggctcactgcaacctccacctcctgggttcaagccattctcctgccttaggttcctgagtagctgggattacaggcatgcaccaccatacctggctaatatttttgtatttttagtagagatgggatttcaccatgttggccaggctggtctcgaactcctgacctcatgatctgcccacctcggcctcccaaagtgctggaattacaggcgtgagccaccgcacccggctaattttcttctttacccaagagtcattcaggaggagattgttcactttcaatttaattgtatgcttttgagagatctcctttgtatcaacttcttttttattgtgctctggtccttcactgtggttggtacaattttagtgttgttgttgttgttgttgttgttgttgttgagaattccattatggccaggcatgtggttgatcttagagtgtgtcatgtgcacatgagaaaactgtatattctgttgttgttggatgaagtatcctgtagacctctattaggcccatttagtcaagtgtcatgtttaggtcctgaatatctttgttagatttctgtgtggataatctgtctaacattggcaatggagtgttggggtctcccactcctattgtgtgattatctaaatctcttcataggtctctaaaaacttgttttgtgaatctggctgctcctgtgttgagtgcaaatatatttagaatagttaagtcttgtcattgaatttaacactttaccattatgtaatgcaatgccctttttggttttgttttgttttgagatggagtttcactcttgttacccaggctggagagcaattgtgtgatcttgggtcactgcaacctccgcctcccaggttcaagcaattctcttgcctcagcctcccgagtagctgagatgacaggcgcctgccaccgtgcccaactaatttttatatttttagtagagacgaggtttcaccatgttggccaggctggtctcaaactcctgacctcaggttatctgcccacctcaggttatctgcccacctcagcctctcaaaatgttgggattacaggcgtgagcacccagcccactttttgtcttttttgatcattgtaggttaaagtttgttctgtcagaaaatagaatagcaacctcacttttttgttttctgttttcttggtagatttttctccactcctttactttaagcctatgggtgtctttgcatttgagataggtctcttgaagacagtatacagttaaatccaacttgccactctgtgccttttattttgggcagatagccctctgatattggaaattaatattgataagtgcagatttgatcctctcattgtgttgctaactgtttattatgcagacttatttgtgatttgtgtcgttttttgtttttttttgtttgttttgtttgttttttttttttgtgtggagttttgctcttgttgcccaggctggagtgcaatggcgcaatctcagctcactgcaacctctgcctcccaggttcaagtgattctcctgtctcagcctcctgagtagctgggattacaggcacatatgaccacacccggctaattttgtatttttagtagagacagggtttcatcatattggtcaggctggtcttgaactgcttacctcaggtgatgcacctgccccggcctcccaaagtgctgggattagaggcttgagccaccgcgcccgacctgtgtagtttcttgatagtgtcaatggtctatgtatttaagtgtgcttttgtggtggctggtaacagtgtttcatttctgtatttagcactcccttgaggatctattgtaaggtatgtctggtggtaaaaaaaaaaaatcttagcattcgtctgtctgaaaatcatcttatttctccttccttcctggagttgaatttggctggatataaaattattagttgagggttttctttaagaatgctgaatataggtcttagtctcttctggcttctaaactttctgctgaagggttcactgttagcctgatgagtttccctttgtaggtgacttacccttctttctagctgtctctaagattttttctcattaactttggagtatctaatgactgtttgccttgggtatagccatattgtatagtatctctcaggtgttctctgaatttcctaaatttgcatgtcatctctctgaaaacattgaaagaattttcatgaaccatactctcaaatatgttttccaagttgcttgttctctatccctctctttcttaggtttggtttatttacacaatctcatatttctcaaacatgttattcacttaaaaattttgcttttctttatttttgtctgcctgtgttgattcaaagaaaacatctttgagttctgagattcttttctcagcttggtttattctgttattaatccttccaattgcattctaaaattaatgtagtaataattttttattctaaaagtttagttttattgtttcttaaaatggctatgtcacctttaaactcttagaccattttactgttttccttggattagctttcaacctcttcctatattccaatgcgctgccttgccattcagattttgcattctatgtctttctttttagacattttagtctggttaagaaccattgctggggagctattgtggtaatttggaggtaacaagacattccggcctttagagttgccagagttcttgcactggttccttctcatctgtaagctgatgttcctctcaacttagaggtagctgtcttttgaacttggcattttgcttttataccctttgattcctttgagggtttccctgtggtacaagttgagttagttgattggctttatctctacatgctttcacaggaccaaggctcaactcagcatttcacagctgcatactctaaccctagtggactgagattaagcccatggctttgttctctggttcctcgaggttaagcaccgattgcacttgaggagccaaaaattttttagtctgctgtcaacagtactccaacagtggctgttggcaaaaagtgctccagtgttgcagcagcaggtaccactttgagtgtgtgccagtgggacagaaatgtatccacatgcatgtgcaccccactaaggcagaagcagaggttgcaagcaagtgcatggaggtaggggaaggctgtgggcaggtgctgctgttgggagtctgtctgctaatgtgcttcaacctgtaagtggggtctgttggtgaaagagctatggaattggccactggaaagcactttggctggccagctgaggctgtactgcaagtgaatgttgccaggtaggatctctgggattatccaatagatatggtggtgcttgggtcagaattgcactgttccatgggcaagacaattatgctgtgtccagttcccacagctaacaaagtctaaagccacctagaagagtatgaagagtgttggagggttcgcactccaggtcttgctccactgcagccatttatgtgccaaatattctgggctgcatgcaagctgaagtcctgtgtctgccaactctctgagcagttctcttttccagttcagatgtccatgggtgtcatggagtctcccacagctgggatcgcagaggtccatggtgagagtgggtcacttcacttctatttaactcaacccttccccaggagctgttcagggccaggaacagctcacatgcccttgatctggcaagtcttccactggcagccagcctctgtgaacaaggcaaaagagtactctgaatcccaagaaggctgtttttatttcacaaaattgccccaggccatgagatcccctgcccaggataaaatctgtaggtcccaggacacatccttcctggtacagttccatgaagggtggggtgcccaactcctataccacagcatgaacccacaccagtttcctctcatttatggccatgggaacttctctctcacttgaaattagactgcaaatctcaaccccaggctcctggatggagtgtatgattcctggggtgcagaatcaggccagtggacttgtcctcagacccactgggttcaggcactgattgtgatagggaaaacttggctggccccaagctgtcagcataatttttaggcaggggcagcagcagctgcccactgggactggcaccaggaagggcagcccttctcagcaggagcagctaggcaggtagctgaggggtgaacaggcaagtgtggggcatgttgttcatacctcggtcttactgaagtttgcacaagtggcagtattcagctttgagttgtgtagaaacaaaaagcctcacctacccctccctggtctgtccagttcccacagctaacaaagtctaaagccacctagaagagtatgaagagccttggagtgttcacgctctaggtcttgctccactgcagccatgtggcagtgcagtggcagccctggggttggatgcagagctttgagggatgagttttcagaatgggaccctgctgcatctgctcaaggtctagaagcctctgcgacttcatgtgagcttaagcgctgcttatgcacaatctccaggcaactccctatgccaatcttgaggcacacaaaggtttaggggcttcccatagctaggattgtaacagtccatgatggaaatgtggagtcctagggttctctcacttaccaactccaaaaacaccttcaaaaccatgcaaatacttagaaattaaataacctgctcttgaatgatcactgggtcaacaatgaaataaagatggaaatttaaacattttttgaactgaacaataatagtgacacaatctatcaatatttctgggacactgcaaaggcagcgctaaggggaaagttcatagcctaaatgcctacatcaaaaagtctgaaagagcacagacaatctaaggtcacacctcaaggaactagagaaacaagaaaaaaacaaacccaaactcagcagaaaaaaataaataaccaagatcagagcgcaactaaatgaaatggaaacaaacaaaaaaatacaaaagatatataaaacgaaaagctggttctttgaaaggataaataaaattaatagaccattcacaagactaaccaagaatagaagagagaagatccaaataagcttaattagaaacaaaatgggagatattgtaaaagacattacagaaattcaaaagattattaaaggctacaacgaacacctttatgtgcataaactggaaaatacagaggagatggtttaattcctgaaaagattataaccctcctagcttaaatcagaaaaaaaatagaaatcctgaatagaccaataacaagcagcaagattgaaatggtaataaaaaattacaaacaaaaaaaagtctaggaccagatgaattcacagccaaattctatcagacattcaaagacaaatcggtgtcaatcctactgaaactatcccacaagatagagaaagagagaacacttactaaatcattgtatgaaaccagtatcaccctaataccaaaaccaggaaaggacataacaacaaataaacaaaaataaagaaaaatacagaaaaatatccctaatgaatataaacacaaaaatcctcaacaaaatattagctaaccaaatccaacagcatatcaaaaagataatacaacatgatcaagtgggtttcataccaaggatgcagggatagtttaacgtacacaagtcaataaatgtaatacaccacataaacagaattaaagacaaaaaccacatgattatttcaatagatgcagaaaaagcatttgacaaaatccagtatccctttatgattaaaaacctcagcaaaatcggcatgcaagagatattcctcaatataataagagccatttataacaaacccacagccaacataatactgaatggggaaaagctgaaagcattccttctggaaactggaacaagacaaggatgcccactctcaccacctctattcaacatactactgaaagtcctagccagatcaatcagtcaaaagagataaataaagagcctccaaatttgtaaagaggaagccaaactgttgctgtttgctgatgatatgattgtatacctagaaaaccctaaagatgtcttcaaaaaccttctacaactaacaaatgaattcaacaaagtttcaggatacaaattaatatacataaatcagtagctctgttatttaccaagagcaaccaagttgagaatcaaaacaagaacgcagctccctttacaatagctgcaaaaaaaaaaaaacttaaaaatttacctaaacaaggaggtgaaagacctctacaagacaaactaaaaaacactgctaaaagaaatcatagaaaatgaaaataaatgtgaaaattaccatactgccaaaagcaatttacaaactcgatgcaattccaccaaaataccagcatcattcttcacagaactagaaaaaaaattctaaaattaatatggaaccaaaaaagagctcacatagccaaaacaagactaaacaaaaagaacaaatctggaagcattacattacctgacttaaaactatattatagggccacagtcacaaaaacatcatggtactggtataaaaataggcacatagaccaatggaacacaatagagaacacagtagtaaacccaaatacttacagctgactgatcttcagcaaagcaaacaaaaacataaagtggagaaaggacactctattcaacaaatggtgctgagataattggcaaaccacatgtacggaataaaactggatcattatctctcaccttatgcaaaaatcaactcaagattaatcaaggacttaaatctaatactggaactataaaaattccagaagactagaagataacattgtaaaaagccttctagacattggcttaggccaagactttatgatcaagaacccaaaagcaaatgcaacaaaaccaaagatgaatatgtggaacttaattaaactaaagagcttctgcacagcaaaagcagaaacagtcagcagagtaaattgacaaaacaaagagtggaagaaaatctttacaatctatccatttgacaaatgactaatatttagaatctacgaaaaattcaaacaaattagcagaaaaaaaacaattctatcaaaaagtgggctaaggacatgaataaacaattcactacagaagatatacaaatggccatcaaacatatgaaaaggtgctcaacatcactaatgataagtgaaatgcaaatcaaaaccacaatgtaatacaactttactcctgcaaaaatggccacaatctaaaaatcaaaaaaataagagatgttggcctggatgtggtaaaaagggaacacttctacactgctggtgggaatgtaaactagtgctaacactatagaaaacggtgtggagattccttaaataactaaaagtagaactaccatttgagccagcaattccattactgggtatctacctagaggaaaagaagttattatacaaaaaatatacttgcacacacatgtttgtagctgcacaattcctaattgcaaaaaaaaatatggaaccagcccaattccaaatgcccattaattaatgagtggataaataaactgtagtatatatgatggaacactactcagccataaaaagaaacaaattaatggcattcatggcaacctggatggaacaggagactattcttctaagcaaagtaactcaggaatgaaaaacttaacatcgtatgttctcactcataagtgggagctaagctttgaggatacaaaggcataagaatgatgcaatggactttctggactcagggaaaagggttggggggtggtaagggataaaagactaaaacttcggtgcagtatgtactgtttgggtgatgggtgcaccaaaatctcacaaatcaccactaaaaatcttactcattaaactaaagacatgtatttcccaaaacctatggaaatacaaaattttaaaagggaacataactcaaaataataaaggctatatacaatgaactaacaaccaacattataataaatggggaaaaaagtaaaaaacatttccgctaagaactggaaccagtcaaggtaccatttcatcagtcctatgtaacatagtactggaagtcctagccagagcaatcaggaaagataaaagattgaaattggaaatgagaaagtcaaattttcttggttggctaatgttatgatgttatatgtagaaaattttaagactcctagattttattcataaattcaaaagagtttcattatacaaaactctgtacaaaattagtagcatttttataaccagtaataatctttctcagtaccaaatcaagaagacatatctacataccatagctatgaaaaaacccctaggaatacaattaacaaaggaagtgtaagatctccaaactacaaaacactgatgaaataaatcatacatgaaaagtgtctcatgctcagtgattgtaagtatcaatattatcaaaatgatcaaactactgaaagaaatatacagattcaatccaattcctatcaaaatataccaatgttatttttttctgaattacacacaacaatagtaaaattcatatggaaccacaaggagacaaaatagtaaaggaattctaacccaaaagaactaatttggaggcatcaaatttccttcatgatacaccacagggcaacagtaactaaaacagcaggttactggtataaaaatacacacatattttacttgaaaagaatagaaaactcagaaatgaattcgcatatttttagccaactgatctttggcaaagtagaccaaaacctacactgaggaaagaacacttgtttcaataaatgatgctaagagaattggttagctataagcagaagaataaaactggactcatctctctgaccatatacaaaaattaactcaaagttttaaatgtaacacctgaagctattacaaatagatgtgaaaatttacttttgacataagtgaaggcaaataatttacaactcatgcataaaaaacacaagtaccaaaaacagaaatggacaaatgagagttaattaaacaaaagatgctgcacggacaaagatataatcaacagagtgatcaataatcaacagaattagagataatatttgtaaactatgcatctgaaactaccaactcaaagaatcttcaaagaacttaaacaactcaacaatggcagcaacaaaaaacaaataatccctttgaaaaggaggcaaactcctgacttggagacaaccaccatcaggggtcgatagaaacctcatacaggagacctccagctcgcatcaggtgggcgccccaatgagatgcagcttctagaggaaggagcaggcagcaatctttgcagttctgcagcctccgctggtgatacccaggcaaacagggtttggagtggacctccagcaaactcccacagacctgcagaagaggggcctgactattagaaggaaaactaacaaacagaaagcaataacatcaacatcaacaaaaaggattcccacacaaaaaccccatccaaaggccatcagcatcaaagatcaatggtagataaatccatgaagacaaagaacaagcactaaatatatatatgtatatatatatgtgtgtgtatatatatgtgtgtataaatgtatatatatgtgtgtatatatgtatatatgtgtatatatgtatgtgtatatatgtatatatgtatatatgtgtgtatatatgtatatatatgtgtgtatatatgtgtgtatatatatatacacacacacacatatacatatacacacatatatatacacatatatatacatatatattttctacctctggtagaattcagctgtgaatctatctggtcctgggccttttttaattggtaggctattaattactggctcaatttcagaacttgtgattgttctattcggggattcgatttcatcctggtttagtcttgggagggtgtatgtgtccaggagtttatccatttcttttagattttctaatttatttgcgtagaggtgtttatcatattctctggtggtagtttgtatttctgtgggatcagtggtaacataccctttatcattttttattgtgtctatttgattgttctctctcttttcttctttttttagtctggctagcaatctatctattttgttaatcttttcaaaaaaacagctcccggattcactgattttttggagggatttttgtgtctatatctctttcagttctgctctgatcttagtcatttattttcttctgctaacttttgaatatgtttgatcttgcttctctagctcttttaattgtgatgttagggtgttgactttagatcttcctactttctgatgtgggtatttagtgctataaattttcctcttaacactgattttgttgtgtcccagatattctgtcactttgttctcattggtttcaaagaacttctttatttctgacttaatttcattatttacccagagtcattcaggagcagcttgttcagtttccatgtagttatatatatatatatatatatatatatatatatatatatatatgtatacatatgtgtgtatatatatatgtgtgtatatatacatgtatatatacatgtatatatacatatatatatacatatatatatacacacacacatatatatatacatatatatatataaaagggtaccagccactgcaaaaacacaccaaaatataaagaccaatgacactataaagaaactgcatcgactaatgtgcaaaataaccagctagcatcatgatgacaggatcaaattcacacaaaacaatattaaccttaaatgtaaatgggctaaatgccccaattagaagacacagactggaaaatttgataaagagtcacgacccatcagtgtgctgtattcaaaagacacatctcatgggcaaagacacacataggctcaaaataaagggatggaggaatatttaccaagcaaatggaaataaagaaaagcaggggttgcagtcctagtctctgataaaacagattttaaaccaacaaagatcaaaagagacaaagaagggcattatataatggtaaagggatcaatgcaacaagaagagctaagtatcctaaatatataagagcccaatacaggagtgtccagattcacaaagcaagttcttagagacctacaaagagacctagactcccacaagataatagtgggagagtttaacaccccactttcaatattagatggatcaatgagacagaaaattaacaaggatattcaggacttaaactgaactctgggccaagcagacctaatagacatctacaggactctccaccccaaatcaacagaatatatattcttcccagcaccacatagcacttattctaaaaacgaccacataattagagataaaacactcctcagcaaaatgcaaaagaatggaaatcataacagtctctccgaccacagtgcaatcaaattagaactcaggattaagaaactcactcagaactgcacaactacatggaaactgaacaacctgctcctgaatgactctgggtaaataatgaaattaagtcagagataaagaagttctttgaaaccaatgagaacaaagagacagaatatctggaatacaacaaaatcagtgttaagaggaaaatttatagcactaagtacccacatgagaaagtagaaagatctaaagtcgacaccctaacatcacaattaaaagagctagagaagcaagatcaaacatattcaaaagctagcagaagaaaataaataagatcaaagcagaactgaaagagatatagacacaaaaatccctccaaaaaatcagtgaatccgggagctgtttttttgaaaagattaacaaaatagatagattgctagccagactaaaaaaagaagaaaagagagagaacaatcaaatagacacaataaaaaatgataaagggtatattaccactgatcccacagaaacacaaactaccaccagagaatatgataaacacctctacgcaaataaattagaaaatgtaaaagaaatgggtaaactcctggacacatacactctcccaagactaaaccaggatgaaatcgaatccctgaatagcacaatcacaagttctgaaattgagccagtaattaatagcctaccaaccaaaaaaggcccaggaccagatagattcacagctgaattctaccagaggtacaaagaggagctgataccgttctttctgaaagtactccaaaaaatagcaaaagaggaactcctttctaactcatttcatgaggccagcatcatctagaaatcaaaactggcagagacacaacaacaacaaaaatttcaagccaatatccctgatgaaaatcattgcaaaaatcctcaataaaatacttggaaattgaatacaacagcacatcaaaaagtttatccaccacgaacaagtcggcttcatccctgggatgcaaggctggttgaacatatacaaataaataaacataatacatcacataaacagaaccaatgacaaaaaccacatgattatctcaataaatactgaaaagaccttcgataaaattcaacaccactttatgctaaaaacaataaactaggtattgatggaacatatctcaaaataataagagctatttatgacaaacccacagccaatatcatactgaatgggaaaaacctggaagcacttcctttggaaaccggcacaatacaaggacgccctctctaaccgctcctattcaacatagtattggaagttctgtcagggcaatcaggcaagaagaagaaataaagtgtattcaaataggaagagaggaagtcaaattgtctctgtttgcagaagacatgattgtatatttaaaaaaccccatcatctcagcccaaaatctccttaagctgataagcaacttcagcaaaatctcaggatacaaaatcaatgtgcaaaaaccacaagtattcctatacaccaacaatagacagacaaagtcaaatcatgagtgaactcccattcacaattgcaccaaagaaaataaaatacttaggaatacaacttacaagggacgtgaaggacctcttcaaagagaactacaaagcactgctcaggaaataagagaggacacaaacaaatggaaaaacattccatgctcatggatagcaagaatcaatattatgaaaatggccatattgcccaaagtaatttatagattcaatgctattcccatcaagctaccattgactttattcacagaactagagaaaactacttcacatttcatatggaaccaaaaaggagctgtatagccaagacaatctgaagcaaaaaggacaaagctggaggcatcacactacctgacttcaaattatactacaaggcaatagtaacaaaagtagcatgttactggtacaaaacagatatatagaccaatggaacagaatagaggccacagaaataacaccacacatccacaaccatctgatatttgagaaacatgacaaaaacaagcaacagggacaggattccctaattagtaaatggtgccttgaaaactggctagccatatgcagaaaactgaatctggaccccttccttacaccttatacaaaaattaactcaagatggattaaagacctaaacataaaaccaaaaaccataaaaacgctaatagaaaacctaggcaataccattcaagacataggcatgggcaatgactttataactaaaacaccgaaagcaattgcaacagaagccaaaattgacaaatgggatctaatcaaactgaagagtttctgcacagcaaaagaaactatcatcagagtgaacaggcaacctacagaatggaagaaaattttcacaatctgtccagctgacaaaggtctaatatccacaatctacaaggaacttaaccaaatttacaagaaaataaaacaagcaaccctgtcaaaaagttggcgaaggatatgaacagacacttctcaaaagaagacatttatgcagccaacaaacatatgaaaaaaagttcatcatcactggtcattagagaaattcaagtcaaagccacaatgagataccatctcacaccagttagaatagcgattattaaaaagtcaggtaacaacagataccggcgaggctgtggacagattgaaacagttttacacggtttgtgggagtgtaaatcagtaaaatgtaacatatcatataaacagaattaaaaacaaaaattttatgatcatctcaatagatgcagaaaaagcatttgacaaaagctagcatccctttatgattaaaacccccagcaaaatcagcatagaaagacataactcaaggtaataaaagccatctataaaaaactcagccaatattatactgaatggggaaaagttgaaagcattccccctgaggactggaataaaacaaggatgcccactatcacttcaattcaatatagtactggaagtccttgccagaggaatcagacaagaaaaataaatataggacatctaaatctttaaagaggaattcaaactgttgctgttcactgatgatatgattgtgtacctagaaaagcttaaagactcatccaaattctcctagaactgatagataaataaagaaagtgaagtctcaagatacaaaatcagtatacacaacttagtagcactgttatacaccagcaagaaagaagctgagagttaaataaaaaaaaaatcaatcccttttaaaacatcagcaaaaaataataaaataaaatacttggaaatatacctaaccaaggagattaggtacaagatttctacaaggaaaactataaaaaagtgctgaaaaagatcatagaaggaacaaataattggaaacacatcccatgctcatagatgggtagaatcaatattctgaaaatgtccgcactcccaaaatcaatctacaaattcaatgcaatttccatcaaagcactatcatcattcttcacagcactagaaaaaaaaattctaaaattcaaatggaacaaataaagagcctccatatttaaagcaattctaagctaaaaaaaacaaatctacaggtatcacataactcaacttcaaactgtactgcaaggctatagttaccaagagagcatggtactagtatagaaataagcatataagccaatggaacagaatagagaagagaaacaaaaaataaaaccaaatacttacagccaactgaccttcgacaaagcaaacaaaaacataaagtggagaaaggacatcctatacaataaatggtgctgggaaaattggcaagccaaatgtagaagaatgaagctggatactgatctctcaccttatacaaaaatcaactcaagatggatcaaataattaaatctaagacataaaaccataaaaattctataagttaacattgaaaaaaactcttctagacatcggcttaggcaaagagtttatgacaaaaaccccaaagcaaatgcaacaaaaacaaaacagatgggacctaattaaactaaaaagcttcagcacagcaaaataaataatcagcagagtaaacagacaacccacagagtggggaaaaatctttgcaaactatgaattctacaaaggactaataatacagaatctatgcagaactcaagcaaatcagcaagaaaaaaaatcccatcaaaaagtgggcaaaggacatgaatagacatttctccaaagcagatatacaaatggccgacaaacatatgaataaatgctcaacatcactaattatcagcgaaatgaaaattaaaaccacaatgagatattactatactcctgcaaaaaaatggccataatttcaaaaatcaaaaaaataacagatgttagtgtgaatgtggtgaaaagggaatacttttacactgctggtgggaatgtaaactagtacaaccactatggaaaacattatggagattccttaaagtactaaaagtagaactactgtttgatccaacaatttcagtactgggagtcaacccaaaggtaaagaagtcattatatgaaaaagacacttgcacatgcatgtttatagcagcacaattcacaattcaaaaatgtggaaccagcctaaatgcccatcaaccaacgagtggataaagaaaatgtgacatataggtagatagatagatagatagatagatagatagatagatagatagatagatatcatatatatatacatattatatacacacacacatacacacacacacacacacacaccatgggatactactcattcatataaagtaacaaaataattgtatttgcagcaacctagatggagttggagaccattattctaagtgaagtaacacagaaatggcaaatcaaacgtatattctcacttatgagcaggacctaagctatgagaatgcaaaggcataagaatgataaaatggactctgggaactcagcaggaagggtgggaggggggtgctggataaaagactacacattgggtacagtgtacactgcttgtgtgatggatgcaccaaaatctcagaaattaccactaaagaacttttccatgcaaccaaacaccacctgtttccccaaaactattgaaataaaaataaatataaaaaataaattaagtaaataaaataaaaggatggaaatgattaacaatgggcagtgggaagagtcaaggcagcagtgtacaccattttttcagctagataagaactgaaaggaaagtgcgtgcaaggtctgcttcatttaaaaatttttaaaaataaataaaaatacctacacatgtatgtttatcccagcactagtcacagtacaaagatatggaatctgattaagtgtccatcaatggatgatttgataaagtaaatgtggtatataataaaatactattctgccataaaaataacaaagttgtgtgttttacagcaacatgtataatagtggtgatcataatcttaagtgaaattacccataaacagaaagtcaaatatcacaagttctcacttctaggcaggagctaaataatgtatacacattaacacagaaagtggaataaaagacactggggactccgaagggcaggaaagttggaagtgggtgagagattaaaaattaattaatataatgtaccctttcagagacttttctgctatgcaatatatacatgcaacaaatctgcacttgtatctgctgcatctataaaaaatttaaaaacacttaactgcaagttccaaaaccttaaagtgcctttaaaaaacataggaaaacatctctttggcattggtcttggtaataaagtctttgataggacaccaaaaacacatgcctcaaaagctacaataaataagtggtacttagatttgacatcaacaagatggtggagaagctgatatcagtatatatatatatatatatatatatatgtctatcttcaagatggtggagaagctgatatcagcccttatcccctccaccaactatatatatatatacgtgtgtgtgcgtgtgtgtgtgtgtgtgtgtgtgtgtctatcttcaaaccaaaataacctagaaatatttcaagggcttataaataatctaccataataaattagtgcaaaaaaaatccaaatagaaagtgtcactggtgatactaatatacctgagacaccatatgtgcaccagaaataaagaagaaaagttgaggttatcatatcaatcacggggcaggaataactattgtccccatttgcctgttccacagagcacagcagttcttttaccactgaagtaaccaactagcatccccactgcagaaccccagagagggagtcatggcacaccccatttccacataaactgtgaccactgttgagttaatttttcaaaggagtcaacacttcttccaaccccacacatgccccaatcccagagctgtggctgctccaagagggcctactcttgtgtcattattagctagcccattaagaattccaggatagactaaatagtaaggtctaccatcaccaaagaatagctccaatagctggagcagacggcaatatactcaaaggctcaggcatcaatataagggcacgagaatgatgaaatattaggaaaaaaagattacaccaaaagaaaataataatacttcaataatggacccagaagaactaaaaatctagaaaatgactgacaaagaatttagaacaatccttttgaagaagtttagtgcacctcaaaaaatagaaatacaaaattaaagaacatttgaaaagcaattcatgaacaaaattaaaagtttgacgaagaagtagaaacaataaagaaacaaatattacctggttgtggtctttactttctacatttagtgttcctttcaagatttcctgtaaggcaggtctgctggtaatgaactctgtcagcatttgcatatctaaaaaggatcttattcccccttctcttagaaagcttagttcagctggatatgaagcccctgcttttttttaagaatgttgtatataggcctccaatctcttctggcttgtaggctgtcagctgagaggtccactgttagacttttgtaggtgaccttccctttctctctagctgcctttaacattctttttttcattttgaccttggaaaatataatgattatgtgtttcttgaggatgatcttcttgtgtagaaacttgcaggagttctctgtattttcctgaattttactgttggcctctccatcaaggtttgggaagtttttatggatgatattctgaaatatattttccaagtagtttgctttttttccttccttttcaggatgccaatgattcatacatttggcctctttacataatctcatacttcttggaggattaattgattcttttttattcccttttaaaaatgtttttgtcttatttcagagaaccagtcttcaagttctgaaattctttcctcagtttggtttattctgcagaaagtggaataaaagacactggattgatatttgagattgcattgtgaaattctggtattgtgttattaacctctgtcagacccattaggttcttttgtatactgattatttcatcctttagctcccgtatcacttatttcatgattcatattttccttagattaggttttgccatcctcctgaatcacaattatcttcattcctaactgtattctgaattctatttctgtcatttcagccagtccagccttgttaagaagtcctgttagagaactggtgaagtcatttggagaatatacaacactttgaccatttgagttactgaagttcttgcattggttctttctcatctctatcagtgttcctttaactgccgtgtagattgagtacagtcaatagacttgtttcctggttgttttcacctggtctaggaatacagctatacaggaaggaaaaaggtctctacaaagagaattacaaaacactgctcaaaataatcataaaagacacagatgaatgaaaaaacatctcatgctcatggatagaaaaaatcaataacatgtaaatggccatattacccaaagcaatttacagattcaatgctacttttatcaagctaccaataacattcttcacagaactgcacaaaaactatttaaaaattaatgtaaaacccaaaaagagcctgaatagccaacagaatcctaagcaaaaataataaagctggaataaacatgttacccaacttcaaattatactacagggctacagtttccaaaacagcatggtactggtacaaaaaccggtacatagaccaatagaacagaatagagagcccagaaatgaggccacacacctacaaccacctgatctctgacaaatctaacaaaaacaagaaatagagaaagacttacttttcaataaatggtgctggaataactgactggccataagccaggagactgaagctggaccccttccttacaccatatacaaaaataaattcaggatggattaaagacttacatgtaaaatcgaaaactataaaaccctgaaagataacctaggcaataccatcctggacatagagaagtgcaaatatttcatgacaaagacaataaaaacaattgttaaagaagcaaaaattagtgggatccaattaaatataacagcttctgcacagcaaaaaaaaaaaactatcaacagagtaaatgaacaacatactgaacagaagaaaatattttcaaactacatatctgaaaaaggtctaatctcaagcatttatcagggatttaaaaaaatttacaagagaaaaacaaataatcccattaaaaagcagacaaagacatgagcagacacttcttcaaagaatattacatgtggctaacaagcatatgaaaataaaaaaagctcagtattactgattattagagaaatgcaaatcaaagccaccattagcaaccatctcaaaaaagtcagaatctgttattctttaaaatcaaaaaataacagatgatgatgaggttgctgagaaaagagaacacttatacactgttggtaggagtttaaattatttccattattgtcaaaagcagtatgatgatttttcaaagagctaaaaccagaattaccatttgacccagtaatcccattacttggtacatactcaaagaaatataaatcattccaccataatgcacatgcacacaatgtttattgcagcactattcacaatagcgaagacatggattcaacctaaatgcccataaatgacagaatggattaaaaaaatgtggtacatatgcaccatggaacactatacagccatacaaagaaaaagattatgtcttttgtaggaacatggatggagctgaaggctattatcctcagcaaactaatgcaggaacggaaaaccaaatgctccttgttctcacttacaagtgggagctaaatgatgataacttatgaacacgataaggaaacaacatacactggagtctacttgaggatagagggtgggaggagggagagaagcagaaaaaataactattgggtactgcaattaattcctgtgtggtgaaataacctgtacaacaaacccccgtgacatgagtttacctatgtaacaaaccttcacatatacccccaaaccttaaataaacaaaagaaataaatataaattctagagataaagaatacaataattgaagaaaaaaatagaaagctttaacatcagacttgatcaagtagaacaaagagtcaatgaactaaagatatgacatttgaagttatctaatcagaaaaggaaaaagaagaaataatgaagaaggactacatcaacaatgaagcaccatcaagaaaacaaacattgcatagtagaagttccaggagaagcgagagacaaagaactacaaagcaaacgtaaaaataaataaataagcctaaaaattttccagacctgggaaaagatgacattatttgacttcagaaataagattacctcctgtttacctctgctatcaatgttccatgccaccctggtgactcaggagattatgagcctgctcaactacacagtatacctctactacaaatggactttaagtaacactaagtttacttataaccaataaaatcatgcagtatcttcactacttcaaatatagccaaaagcaaagccaaatgccctattcaataaacagcatagtcatatcctcatgaaataaaatgtcttgccccaataaaagtaaatttaaaaataagaagttactgttttttgaggtatgaacaaataagtgtaataccaaaaatatgaaaagtcaagtattatgacccaccaaaagaaacagtatttcttcagaaaaaaaattctaaccaaaaagaaaatcctcaaaattccaaataaatagttcaaaattttaattttaagaaagctcgatgagatgcaagtgaaaactgaagtcaataaaaataaaataaaatcaatgacagatgtaaatgagaaatttaccaatgagttagatatcttttaaaaaatgaaacttctgggaaataaaaaattatagtggaattacaaaatacacgaaaaacatcgataatagactgtaccaagaagaaggagaatatcagaactggaagaaaggtctagcttaattaattaaattaattcagttagacaaaaataaagaaaaaagaattaaaagaaattaacaaagccttcaagaagtatgggactacgtaaaatgaccaaaggtgtaaatcatcagtattcctaatggagaagaaaaataaagtttagaaaacctacttaagtaaataattaatgaaaattctcttactctagcaagagacttagatatccagaaacaggaggcccaacaaaaatcagaaaaaaatacaatttaagatgaaattcaccatgacattacacagtcatcaaactgtgtaatgtcaatgtgcaattaaaaaaaaaaaaacctaaaattggtgaggcaaaaatgcctagtcacctataaagcaaatctcatcagactaacagtggacttctcagcagaaaccatataaggcagaaaaggttgagaccttatatttaaagcagtaaataaaaaacagtgccaagcaagaattctgtttcatgacagaaaaaaactttataagtaaaggagaaataaggtatctcccagacaagtaaatgctgagaaaatttatcaccactaattcagccctataagaaatgctcaatggagttgtaagcatagaaatgaaagatcaatattcaccaatactaaaacacgcagagcataaaactcaagggtctcataaaacaattataaggagaaagagaaagaaattaaatggcaccatgacagaactccatcaaaccacaaagacagagagaaagcaaaagaagaaacaaacaaacaaacaaaaaatacacaaaacaactaaataatactaacaatataaccggaacaaaaccccacatatcaatattaaccatgaacacaaataaattaaatgcccacttaaaaatatatacgggtggaatgaattttaataattatccaattatatacttctaacaagaaattcatattacatgtaaagacaaatataaatgaaagagttgaaaatgataattcatgcaagtggaaatcataagtgagcaggagtagctaaacttatataaaataaaagagaatttaaataaaaaaatggtaaaaaaaaccaacaggtcattacataataataaggtggttaattcagcaagacaatataacaatccgatatatatatatatatatatatatatatatatatatatatatatgcacttaacaatggggcatgcagattcataaaacaaatgttactagacctaatgaaagagatagacagaaatgtagtaagagtagtgtaggtaaggacctcactcatagcagtagaaagatcaagtcagaaaaccaaaaaagaatccttggacttaacttgaactttaggccaaatggacctcagagacatatacagaacattctaaccaacagcggcagaatacacattgttctcaccagcacatgaaaggtattccaagacagactacaagttaggtcacaaaacaaatcttaatacatttttgaaaaatcaagtaatattaagtattttctcagaccatagacgaataaaagtagaaatcaattccaagcaaaactttgaaaaatatacaaatacacaaaaacagaaaaacatgcttcatgatcttttggaaaaaaataaaattaaaatggaaatttaaaactttttggaagtgaataaacatgaaaacacaggtgagtttgaaccaagatggctgctgcagtccatgactctcacggagaagaatgaaaactgagtgaattttgcaccttcaactgaggtattcagattctctcattggaactgactagatgggcagttcaacccacagagttaggaaaagcgggggggtgtaaggaccccacccacccccaccctgccaggaacagcatggagccagggaagcttccattttcagccaagggagacagtgaatggttgtgcaactctgcctgaaaaaccacgcttttctcacagatctttgtaacccacagggctttgggttagaagcacagagctgtgtggagtctcagtggggtggccacttaggactgcatgaagacccaggagttgttttgcatactgtggccctggaaatttccagcaaaatggaagatccatccatgtattccccttggaagggggctgaatccaggaagccaagcaacgtcattctgcaggccgcaccccaatggcatcccacaagttaagactcactggcttcgaattctaggtggccagtggcagcaggcaggagactgcctgagacagaccgagttcctagggggagggacagtggccatctcttcagtttgagtcagccgttctagcctcctggctccaggaagcccagtggttctggagcaattcccccataaaatacagagaatcccaataagatactccaggagaatatcaaccataagatatatatataatcatcagattctccaagtttgaaattaaaaaaaaatgttaagggcagccaaagagaaaggccaggtcacctacaaagcgaagtccatcagactaacagcagacctctcagtggaaaccatacaagccagaagagattgggggacaaaattcaacatttttaaagaaaagaattttcaacccagaatttcatatttggccaaacgaagcctcataaacagagaaataaagtctttttcagacatacaaatgctgagggaattcatcaccaccaggcctgccttgcaagagctcctggaggaagcacgaaatatagaaaagaaaaattgttaatagctactacaaaaacacattgaaatacacagaccagtgacactatgaagcaactacataaagaagtctgaaaactaacaagctaggatcaggatgacaaaatcaaattcacatataacaacactaaccttaaatgtaagtgggctaaatgtcccaattaaaagacacagaatggcaagctggttaaagactcaagacccattggatgttgtcttgaagaaacacatctcatatgcaaagacacacataggctcaaaataaaagaatggaggaaaatgtccaagcaaatggaaaacagaaaaaaaattgcaatcctagtttcttacaaagcagattttaaaccaacaaagatcaaaaaatacaaagatgggcattagataatggtaaaggattcaatgcaacaagaaaagctaactatcctaaatacacatgtgcccaatacaggagcaccgagattcataaaccaagttcttagatacctacaaaaagagttagacttccacacaataatagtgggaggctttaacaccccactgaaaattttagacaggtcatagagacagaaaatttaaaaagatattcaggacctgaacttagctctgaatcaagggaacctgatagacatctacaaaactttccaccaaaaaaaaccagaatgtacatttttttttatcgccacatggcacttactctaaaattgatcacataattggaagtaaaacactcctaagaaaatgtaaattaaaaacccaaaatcatagcaaaatatctctcagaccacagcacaatcatcaaatgagaactcaaagtaaagaaactcactcaaaaccacacaactacatggatattgaaaaatatgcttctgaatgactcctgagttcataataaaattaaggcagaaatcaagaagttctttgaaattaatgggaacaaagagacagcataccagaatctctgggacacagctaaagcagtgttaaaatatatataaagcactaaatgcccacatcaaaaagctagaaatatgtcaaatcaacaacctaacatcacatataaaagaactagacagccaagagcaaacaaacccaaagctagcagaagacaagaaataaccaagatcagaatagaacttacaaagatagaatcataagaatactttcaaaaaatcaaagaatgcaagagctgttttttttttgaaaaaattaataaaataaaccactaactaggctaataagaaaacagagaagaatcaaataggcacaatcagaaatgataagggggatattaccactgaccccagagaaataaaaacaaccatcacatgaactagaaaatcctgatgaaatggataaatttctggacatacacaccctcccaagactgaaccaggaagaaattcaggctctgaatagaccagtaatgtgttctaaaattgaggcagtaataaatagcctaccaatgaaaaagagctcacgaccaggcagattcaccaatgaattgtaccagaggtacaaagaagagtttgtgccatttctactgaaaccattccaaagaattaaaaagaagagactcctccccaattaattttatgaagccagcatcatcctgatatcaaaacctggcagagatacaacaaaaaagaaaacttccggccattatttctgataaacatcaatataaaaatcctaagtaaaatactggcaaaccaaatccagcagcatatcaaaaagcttatccacaacgatcaagtttcatccctgggatgcgaggttggttcaccatacacaaatcgataaataaaatttatcacatttacagaactaaagacaaaaaccacacgattatctcaatagatgcagaaatggccgttgataaaattaaacatccttcgtgttaaaatctctcaacaaattaggtattcaagaaacttacctcaaaataataagagcaatatatgacaaacccacagccagtatcattctaaatgggcaaaagctggaagcattccccttgaaaaccagcaaaaagcaaggatgccttgtatcatcactcctattcaacatagtattggaagttctgaccaggtgaatcaggcaagattaagaaataaatggtattcagataggaagagaggaagtcaaattatctttgtttgcaggtgcaacaaccttgtgtctagaaaaccccacattctcaacccaaaagcttcttaagctgataaacaacttcagcaaagtctcagtatacaaaattgatgtgcaaaaattgctaacattcctacacacaaacaacaggcaagcagagagccaaatcataaaagaactcccattcacaattgctactaagagaataaaatacctaggaatacagctaacaaaggaagcaaagaacctcttcaaagaaaactacagaccactgctcaaggcaatcaaagaggacacaaataaatacaaaaaaaatctatgctcttagatagaaagaatcaatattgtgaaaatggccatagtgcccaaagtaatttatagattcaatgctttctccattaaaccaccattgacattcttcacagaattagaaaaaattattctaatattcatatgtaaccaaaaatatgcccaaatagccaagacaatcttaagcaaaaagaacaaagctggaaacatcatgctaccagacttcaaactatactacaagtctacataaccaaaatagcataggacaggtacaaaaacagacacatagaccaatggaacaaaatagggaactcagaaataagaccacacacctacaattatatgatctttgacaaacccaacagaaacaatgaatgaggaaagtattttctatttaataaattgtgctggaaaaactggttagccatatgcagaaaattgaaactggactcctttcttacaccgtatacaataattaacttaagatggagtaaagacttaaatgtataatgccaaatttaaaaaaaaccctagaagaaaatctaggcaatatttttcaggacataggcatgggcaaagatttcataatgaaaatgccaaatgcaattacaacaaaagctgaaattgacaaatgggatctaattgaactaatgagctgcttcatggcaaaacaaacaaaaaacctatcatcagagtgaacaggcaacctacataatgggagaaaattgtagcaatctatttgtctgacaaaggtctaatatccagagtctacaaggaacttaatatacaaaacaaaaccaaatctattaaaaagtgggcaagggacatgaacgaacacttctcaaaaaaagacattgatgttgttaacaaacatataaaaaaaagctcaatatcactgatcattacatatatgtaaatcaaaatcacaatgagatactatctcatgccagtcagaatggcaattattaaaatttcaagaaacaacagatgcaggtgaggttgcagagaaagaggaacacttttatactctcagtggaaatgtaaattagttcaaccattgtggaagagagtgtggtgatttttcaaagatctagaacaaaaagtactatttgacccagtatcccattatggggtatatacccaaaggaatataaatcattcaattgtaaagatacatgcacacacatgtttattgcagcactattgataatagcaaagacatggaatctacccaaattcccatcaatgatagactgcataaagaaaatgtagtatataaacaccatggaatactatgcagccataaaaagaaaggagatgatgtcctctgcagggacatggataaagctggaaactgttaccctcagcaaactaacctaggaagagaaaaccaaacaccgcaagttctaacttataagtgggagctgaatgttgagaacacagggacacatggtaggggaacaacgcacactggagcctgtcagcagggtggtgggagagagagcctcagaaagaatagcaaatagatgatgggcttaatacctaggtgataagttgattggtgcagcaaactaccatggcacatgtttacttatgtaacaaagctacccatccagcacatgtaccccagaacttaaaatataagttgaagaaaaaatgaaatcattatataacaaaacctttgggtttttttgcactacagtaaaagtagtgctaaaaggaaattacatagtcttgaacgcctacatcaaacacattgagaaaaaccaaattaacaacttaacatgacacctcaaggaactgaatcaacaaagacaatcaagcccaaagctagaagaggaaaataataataaagataagagcaggactaaataatattgagtccaacaaagtgatacaaaacataaatgaagacaaataagaaagaggtggagtaagatagcagaattgaaagccccaccgatcatcccctccacaaggacaccaagttaacaacctacacagaaaaaaacaaacaaacaaaaaacacctttataataaacaaaagtcaggtgagtactcatagtacctagatttaactttgttttcctgaaaggggcactgaagcatattaaaagaaaaactttagacaaattcagtttaattgatttaattgagcaagaaagaaatgaatttgcaaatcagccagcctccagaatcacagcagattcagaaagactccagggatgcttcatgaagagagcaaatttatagacagaaaaagaaaaatgacatacagaaaatggaggtaagtttcagaaacagctggattggttacagtttggtgtttgccttatttgaacacagtttgaacagtcagtgacctatgcgtggttgaaatatggctactaggattggctgagactcagctattgccacaaaagcatactcctaagttaagttacggtttgtccaaaaggactcaagtatggatgtctcaggccgtatttagttcaatttaacaatatcccatttggtcaacctctcaatttacagagattgaacaaaagtttagtcattgatgccactctctgtcaccatcctaaaatagttggtctcagaatggaattcacaagtcttctttagctgcagtatgtagtttacaagtcttgttttgtgtcattatggaatcacaaatcacagctttgtaccaactgaatgattctttgtattcttgctgacctaaagaaatgggtagaatggagtgagaccattcaattcacaatggatggctgcatgcaaaacatttaagacttgaaagaatacagtgcatcaggaggactattatgattatcaagaggagaatatgaaaacgccaaggtgtattccataacaagagttatgaaaattaactgaaccaaattaaacaagataagattcagataatataggcaactcaacaatactagggtctaattggtcatagtccttgtttggaatgtgatagtgattaaggaccatagttcactgtaaagtgacctgatttaaagaagtactcatcttcatcgttactctggtaacacaaatcataataacctggaaacctactaaaagaaatataatgattagaaacacttgaaaaacccaagcttaccatccaccactcaagatgcctgccaaccaactgttagttgctcctgtaaatatatcatgtgttcctttctcctgagcaatttctttaatgtgtttggtggcagtgtctaagaaaacagcagtattaaccacctttttgattaagctttttgtagtagtaaaatcagaagagagataagtacaacatttagttttgttcaacaccaaacatgagcccccagcttgggctaaaagaaaatctaaagctgcatgatattctattatgtgtttttgttgaatatatgtgttatcgtctacattttggggagtagtttctaccagcctgaaaccctgggaggtctgacttgctacaaaatccaaaatttttcccaatttataaattagctgtaaattccatacagctggcaccccactaccaccaaaaatgagctccaaaggaacccattgaggaaatatttcctcagtgaaaacaagtttatcctcatctatttcaaggctagtgataatttcagttattgatcattttgacttccaactataagggctattatgggaataatcaggggaagctattcgaaaggcaggagtgatccaggccaaataacaagatccaaaccaaagaaaaggcagaataaataaacagattctccacagactcaatataggccctcaggggttgaaaaagagggccacctagttacatttgagcaagagtcagtcaggtttgttcatccataaatctgtagctcctgaacaagatcaagtaggaaatttacttttttgtggcccctttatagcatgttgtaagggtgtataacaacatctattaaaaaaaaaagaccaatggatctaatctggtgacaatatacaagcaattacttgtaccaacataggtaatactcaaatcttgagtgtgttatgcctgaaagcacaatatatcttttgcaggcatcacttaaattgatattttatatttggtaataattgagttatcaattgcaaaagagtgttgttcttagtgagtataggaaagcaagtagcagtgatgtttagaatatcaagaatagcttcctattctttccttggagtttagggtgacttttactgggaacacagagaggcatttgcatcagtggaattgtttcctgattttttgatattaagccataaactcaacaattactctggttttgtgctacagcataagcttagcctaaaagcatccactgattatggtcccatggattttcctgtagggaaaatgaaagaattggggtgataaaaaatgagaaaaaaataaagcttttatgatgatagagaaatcttgatctatgatcttgggaaagcggtccaccactaagatgccatctccttctggggagagatttccctggtcatctttaccttaaagtatctaacaggtgtacagattcaggagtctgaaggggccctgctgagttgtgaaatgtggatcccaggttcaaggagctaagaaatgctgtgtttggttggaatttaatagatttttcacaacatttggagcttgcaaattaagttcattttctaagatctgatctgatgaaggttctaccagcttggctgctgctgctactgcttttaaacaatttatatgccttagctactgagcctaatttcatggtgtagtatgcactgggcctatgattactaccatgatcttgggtaaggactccttatgcctaattgttacattcatgaaccaacaaagtaaaaggttttgtgtaatttggaagtcgtaaagctgggggctgttgtaacgtcaattttatttggataaaagcctgatcatgactatcttccctaggtaaagtctctggtacaacatttttagtgagctcatacaatgatgaagccattaagcaaaaaatttggaaccaaggatttgcaatatcctgcaagaccaaagaagcctcttaaatgtcttctggttgcaggccaaggaaaactttgaacagcttttattctcttatttgagagggaaactccttcagtagtcaagtcacgttttgaatactggactttttctcttgaaaactgaagtttttccagtgaagccttgtgacttttatatgcaagttgctgtgaaaagtaaactgagtcaatttcggagtgctctttagtgggagaacataacaatagctcatctacatactaaacgatagtagaattttgagaaaactgtagtgtgattaagtcctgattcaatgcctgggaaaaatataaaatggcttcagtaaacccctgtgccatcacagtccaggtatgccactgatatttccaagtaaaggtaaacaactatttattctctttataaactggaatgctaaaggagactaagtagagatatattacagtacaagtatgcttgaaattagtgagtacattaaacaataaagtattagaatttgggactacaggaaaccttggtattataattatattaattttacataaatcttgaacaagtatctaaccttgtctatttggttttttaactgataggtttttaactggtagggagtgctataaggctattgtagaaaaattatgagtccctgtttaattaaattattttacaattggtgagagcctttgaattcatttgggtgttagtgagtattggggtaatttatgcaaaggtttagaataatctatttggactctcacaagttccacacttttaatttttcctatatcagttgaggaagaggctcataaacttttaggtatttttgaaagattaggggtattacaggcctgagtttcaatcttatcaatttctgcctgtaaatagcataaaaattttggttcaagagtatcaggaaaccctaagattatttctccctttgaggaaaattgtacgtgcccttttagctttgaaagtaaacctcaccctagaaaatttattggagcagcattacatagaaaaaaaaaaggatatttttctgaaaagatccccaaagttaattggatggtttcagttatgggaaccttttgaacttgatttgaaatccccaccacagaaatgacctttttactctgagggatttgctggctcattaaagtggagcttatggtaaatagggtagagctggtatccaccaggactgtacatgactccacatttaacctcctgtataacaatcaactcaagatggaacgaactcagatctaagacctgaaaccataaaaattcttgaagatagcattaagaaaaactcttctagacattggcttaggcaaagaatgtattacttaggacccaaaagcaaatacaacaaaaataaaaataaataaatggggcctaattgaactaaaaagcttctgcacagcaaaagaaatatttaggagagtaaatagaaaacccacagagcagaagaaaacagtcacaaactatccatctgacaaagcactaatatccagaatctacaaagaacacaaacaaatcagaaaaaaaaaaaaacgtataaaaaattaggcaatggacgtgaaaagacagttcacaaaagaagatatacaaacagcccaaaaacatatttaaaaaatactcaacatcactaattatcagggaaatgcaaattaaaaccacaatgagataccaccttactcctgcaagaatggccataattaaaatgtcaaaaaacaatagatgttggcatggatgtggtgaaaagagaacacttttttacactgctggttgaaatgcaaactagtacaaccactatggaaaacagtatggagagtccgtaaacaactaaaagtagaactaccattcaatccagcaatttatgtactgggtaactatccaaaggaaaataatttattatatgaataagacataagcacatgcatgtttatagcagcacaatgtgcaatgacagagatatggaaccaacctaagtgcccattaaccatcaagtggataaagaaaatgtatatatacaccatggaatactactcaggcataaaaaagaaaaaaataatggcatttgcagcaatccggatggagttggagataattattctaagtgaagtaatgcaggaatggaaaatcgaatatcatatgttctcactgataagtgagagctaagctatgaagatgcaaaagcataagaataatataatggattttggggactcaggggaatgtgtaagagaggagtgaggaatacaaagctacacactggagacagtggacactgcttgggtgatgggtgcaccaaaatctcagaaataaccactaaagaacatatctgtgtaaccaaaatccacctattccccaaaaactattgaagtaaaaatttaaacaaaaagaaaaaaaatctgtggaaaactcttctggagttttcattggcctacacaaggaaatcatgattaagacctcagaagcacaagcaccaaaaccaaaacacagataaatgagatgtaattaaaataaaatgcttcagcataggaaaggaaataatcagtagagtgaacagacaacctgcataatgagagaaaatatttgtaaactatgcattcaacaggagactaatatccagaatttataaggaattcaaacaacaaccatagcaacaacaaaacaattaactccaaataaatggttgaaagacatgaacagatatctttaaaaagacataaaaatagccaaaaagcagctgaaaaactgctcaatatcactacatcagagaaatgcaaatcaaaaccacaataagacattgtcttaaacctgtcaaaattatattattaaatagtcaaaaggtagcagatgttggaaaggatgtgaagaaaagggaatgcgtatatactgttggtgggaatataaactactacaacttctatggaaaacagtatggcgatttctcaaagaactaaaaatataactatcattcaatttagcaatcccactatggggtatccacccctcaaaaaatgaaatgttatatcaaaaagataccttggctagaaacagtgacttgtgcctctaattccagaaatttgggagaggcttggtgatggaatattgtctgagccaggattttgaaaccagccttggcaacttacacagtttggacatttgtctcctcccaatcccatgttgaaatgtaattcccagtgttgaagttggggcctggtgggaggtgattggattatggggatggattcctcaagaatgttttagcaccatccccttggtgataagtgagttctcaatcagttagtttacataagatttggttgtttaaaatgttttgaaacctccctcttctctctcatacttccactctcgctatgtgatacaactactctccctttacctttcaccatgattgtaagcttcctgaggccctcaacatatgcaacaccagcatatgttggtgccatgcttcctctgcagcctgcaaaatcatgaaccaattaaacctcttttttaatataaattactagtctcaagtattgctttatatcaatgaaaacaaacacagaaagatagcaagatctcatctctacatgctgggcatgttatttcactcctgtagtcttagttacttgggagtctgaggtgggaagattgattgagtgcagttgtttgaggttaacaatgagctataatcacatgactgtcctgcagcctgtgtgacagagaaagaccctgtgagagagagagaaagagagaaagagaaagaagaaagaaagaaagagaaagaaagaaagaaagaaagaaagaaagaaagaaagaaagaaagaaagaaagaaaaagaaatctgcacttgtatgtttatcacagtactattaacaatagcacagatatggaaccaacctaaatttccatcaatgtttaattggataaaaaagtgatcaatctttgtatctaacaatcaatctatctaaatacacacacacatgcacacacacacacagagacatctatgtatctatctatccaaacacacgaacgaacacacacacacacacacacacacacacacaggaatactattcagccacaaaaaataaaatcatttattttgcagaaacatgagtggaactggaggccattatcttaggtaaaaaacttagaacaaaatgtcaaatatatattcctacttataagtagtaggtaaataacacacacatatggacatagaatgtggaataatagacattggagactcaaaagtgttcaggagtggaagagagtaaagaatgaccttaaaacttaaagtataataaaaaaaagaatgagaaatttcttagtgagtacaatatacatgatttgagtgatgattacacaaaaagcccagattgtaccactatgcaatgaatccatgtgacaaaactatacttgtactccttaaatttctacacaaaaaaaaactttttaaaagccaatttgttttcagtcttttattttttattcaaaagtaggtcaccatgtaaatagtcttgacctgtctcatccttgacaatttaagtcaaataaagtcacccaagtaccttacaacatctggtacataaaaaaagttacaaataccaagtaactcatgcaatttattcagtcccatttctaccttaaaaaagagccctagcaccctgatagtgactcgtgtgagaagtccacacaattcagtagcagaatcatctcccacttaactctcagcaatggggacactaccgctagttctctactggagcagtaaaagttaccttgtgcacaaacttgctgaaaatgggagatccaaccaacacccattctctgccatcattgctctggaactcccaactgcaggatattttcagccagacatcctgaatccaaaaagaactaaatgtaactaatatctatattaaaatttaaattctgatagatttaagagcagtgggtcattttatggactgggttttggtccagtattgccacaaatttattcatgctgtattcactcccacttaaaatgtaatcttcttcatgaagtagtacatttgtctttttctattatttaatccatggcatttagaagagtgtctaaagtactcaatagcttctatttagcgggaatggtaaaatgcaatgatcagctaaatagctccagttgagctgggcatgactgtctacccctctccaacctgtatgttcatagttcctctatgatcttccaccccatttcctggaaacctacactttacactttacctggaagtactaccatcagcactgtgtgcaggcccaaacaagcctccactttattttacttctttcttgtcccttttcgttatttaaattataaacaaaccagtatctattaaataattttttaaaccagaaaacagaggccattacctcatgcagttagtgtgaatatacagtgagccctacatccagaacatttgaaactaccaaaaggtgcatattgcaagttcaaagccaaagctttcaagattctataaatataaacaggtaatataagctaatttactaccctgctcatcttgtgctctccattacccctaaacaatcctggggatctacattgatactgctgcagattaaatccagtcactttttaaggctttggggatcactacctctccggttgatccccaattaattctgtagatcccaatattctgaaaacaaaactggagacatttacaagcttgtattcaaataaggcagggtagaataaagcagatgcccttgccagaacatcttgcagattttaagtacaaaaataacaatgttattacatattataattgtactagttcattctcacactgctatgaagtaatatccaagactgggtaattacataaaggaaagaggtttaattgactcacagttccacattgctacggaggcttcagaaaacttacaatcatggcagaaggcaaaagagaagcaggcacctcttcacagtgtggcaggatggagtgaatacaagcagtagaaatgccagatgcttacaaaaccattagatcatgtgagactcacttattatcacgagaacagcacaggggaaactgcccccatgatccaattacttccacctggttctgcccttgatatgtgcagattatggagattacaatttaatgtgagatttttggtggggacacagctaaaccttatcagttattattatttaaaaatagttaaaatttattaaaccttgactatgctaggaacacttttgagcacttaatataaattatgttttaaatttttaattgtgccaaaatatccatactataaaattgatcattttaagcatgtggataattttaaagatgtaggtcaaaaggtatgaaattgtagttatgtaggataaataagtccagaaatctaatgtactgcatagaaattatagttatattctataatgatttgctaagagagtagattttatgtactcttacccccccacacacacacaaaaataactttttgagatgatgaatttgttaattggcttgatagtagtaatcattttactatgtatatgtatatcaaaatatcatattatacactttaaatatatacagttacaaataaaaatggggagcgcacagcaaaatggtagactagatgcagtcaggaaaaatatctaccaccaagagattgtgaaattgtgaagactgcatggcaagcagatcttgagaagaaaggcattgagagtggacagaggaagtaaacagatactgggctaaagatggaggaagctggaaactttgccaggactacaacacactggcccccagtgattcctgggaaagcaattagtggtacaggtgtggagtgatctactcttggcatggacttctggtatcctagcaacagaagtagccataatctccacaaacacttgggctggcagggagggctccttagagatatggtactgcaggacttcagcctgtgaagagcagacagggtttggtgtaggaacatctgcagtggagcacagtctggaaaacccattccccaaagcttgccatgctctcctagaaaactttagccttaggggaactgttggacctcaacagagcagggcagtcttgctcatgaaatgggtcaagtcagatataagcacccctctacccgaggacctctcctgtggccccattgtggccatgcccacttgaaatggagccctggatgctcaactggcattcttccatagcctgcatcagtttcttcaccagcagattgcacctgactataagagagcatcagcaaagtggcccttgtcaacatatacaagcctaccaacacatatttcccaccacagcctgccccacaccactttgcccacatgcactcatccatagccacctccttcaccactttccccttttatgggcacacagggagacctttcctctccttccacactggcatgcatgtgtgcatgcactgtactgcaccactgacgttggcatgagcacagacctcctcaatgcacaaacattgccaaacaaatgttcacagagaggccagcggcccttctctctgcccaccaagcccctccctgctgccaccaccagcacaaatgcacgcacagaggctgacggccctgagctcaccagctctccatccgcatgccaatgccaccactggtgtaaacacaacatggagattgccagccctgccccacattccatgccactaagtttactcatattaatttgtacatggaggccagcagccctgcacccactggcggcccaccgcagctggtgggtgtgcatcctgccacactgctgccgtagctggcacataccaacaagcatagattccattgccactgccctgacaaagagcactttggctagcgccaccctttggagtgttgtggctagctttctgggaaaccttggctcatccagtgcagcaagttgctaaccttgaagggccagagaacaaacatgggagcccaacaccagtgccacagagttagagttcaaagccagaagtgctgacctgtgccttgccctctaaaatatttaagaaatgaagccagttggctgaactaaccctgtactgcaattaaactcccaagggaatcaaagaagataaaagcaaaagaacccatccaaagtacagcatcttcaagattgactgaacatcagctcatacaggtgagaaaaaaatagtgcaagaactctggcaacaaaaaaagccaaagtgtcttcttacctccaagcaaccacactaattccccagcaaaagtttttaacaaggttgagatggctgaaaagacagaaatagaattcagaatatagataggaacaaagatcattgagattcaggaaaaggtcaaaatctaatcaaagaattctagggaatataataaaaatatacagaagatgaaagatgaaatgatcattttagaaataaccaaactgatctgataaagctaaagaacttacttcaagaatttcagaatacaatcacaggtattaacagcagaatccaccaagcttaggaaaaaaaatcagagtttcgaagaccagttctccaaaataacgctgtcagaaaaaaaataagaataaaaaattaaagaagaatgagcaaaacctctgagaaatattaaattatgtagagataccaaatctatatcacattgggattcctgaaggagagagagagaaagcaagcaacttggaaaacatttgagactattatacatgaaaatttattcaaccttgctaaagaagccaacaatttaaaaatccagaaaatgcagaaaactcctccaagatactacataaggtgaccattcccaaggaacatagctattagattctccaaaattgaaataaaagaaaaaaattgttaaaggaagctatagagaagggaaagatcagctacaaagggaccccaccaggctaacagggaatcttttaacagaaaccctccaagccagaagagattgagggattgtattcagtattcttaaaaaaaacaaattccaaccaaataattaatatccatctaaactaagctttcttactaaagaagaaaaaaaagatccttttcagcaagcaaatgctaagagattttgctaccaccagacctgcattacaagaggtcctgaagaaaatgctaaatctggaaagaaaagattattcccagccatctcaaaacacaattaaatacatagacaattaacactacaaagcaaccataaaaacaagtctgcataatgggcagctaacaagatgaggacaggttgaaatccctctatatcaatattaaccttgagtgtaaatgggctaagcacctcaattaaaaggcatggagttgcaagttggataacgaagcaagacccagaggtatgctgtcttcaagagacccatcttacatgcagtgacacacatagactcaaagtaatgagatggagaaaaatctaccaagtaaacagaaaacaaacaaacaaaaaaaggcagggattgctcttctaattttagacaaaacaaactttaaatgatcaatgatgaaaaaaacaaaaaggggcattacatgattgtaaatggtttaattcaacataagatctaagtatcctaaatacatatgcacccaatattcataagagcacccagattcataaagtaagttcttagaaatctacaaaaatacttatataaccaaataataatagtgaaagtcttcaacacaccacagagtattagtcagatcatcaaggcaaaaagctaacataaagaaattcaggacctgaaccaaattgacctaatagacatccccacaattcattacccaaaaacaacagaatgcacattcttctcatctgtacatggcacatattctagaatctatcactcaatcagccataaaacaatcctgagaaaattcaaagaaaccaaaatcaaaccaaccaaattatcagatcatagcacaataaaaatataaattaatgcttacaagactgcttaaaaccacagaattacatacaaattaagcaacttgctcctgaattattttggggtaaacaataaaattaaagcagaaatcaagaaattcattgaagttaattagaacagagataaaatatatcagaatctctgggacacagctaaagcagtgttaaaaaggaagtttataggactaagcacctaaatcaaaagttagaaagatctcagattaacaacctaatatcatacctgaaataactatagaaacaagagccaatcaaacccgtagatagcagaagacaaaaaataaccataatcagaattgaactgaagaaaattgagacaaataaaaccatagaaaatattaatgaatctaggatttggttatttgaaaaaataaataagacagaccactaactatactaatttaaaaagagagaagattctaataacacaatcagaaattacaaaggaggcaataccaccaaagccccaagaatacaaaaagaccctcagatactactataaacacctctaggtttatttgctagaaaacctagaagaaattcataaattcatgaaaacatgacctcctaagattcaaccaggaagaaattgaatccccaaacaaagcaataatgagttgcaaaattaaattagtaataaaaagcccaccaacagacaaaatcccaggaccagacaaatttccagcccaattctacaacgtgtgtaaagaagagctgctaccattcccactgcaactattccaaaaaattagaaaaatattgtaatagtttcaaaaggaattggacacctacctaacgcattctatgaggccagcatcatcctagtaccaaaacctggcagggacccaacaaaaaaaagacaacctcatgccaatatccttcatgaaaataaatgcaaaacactcaacatatgtaacatgtgcaaatcaataaacataatccatcacataaacaggaacaatgatataaactacatgattatctcaatagatgcagaaaagacagtcaataaaattcaacaccccttcattctaaaaacgctcaataaactaggtattgatgaaacatgtctcgaaatagtaagagctatttatgacaaacccatagccaatatcatactgaatgggaaaactctggaaacattccctttgaatactggtacaagacaaggatgccctctctcaccactcctattcaacacaatattggaagctccggcaagagcaatcaggcaagagaaagaaataaaggtattcaaataggaagagaggaagtcaaattgtctctgctcacaaatgacataattgcatatttagaaaatcccatcgtcccagcctaaaaacatcttaagctgataagcaacttcaaaaaagtctcaagatacaaaatcaatgtgcaaaaatcacaagcattcctatacaccaacaacagacaagcagagaaacaaatcatgagtgaactcccattcataattgctacaaagagaataagataccaaggaatacagcttaaaaaggtcgtgaaggacctcttcaaggaaaactacaaaccactgctcaaggaaataagagaggacacaaacaaatggaaaaatattccatgttcatggataggaagaatcaatattgtaaaaatggcaatactgcccaaagtaatttatagattcaatgttattcccatcaagctaccagtgactttctttgcagaattagaaaaatctactttacatttcatatggaaccaaaaagagcccatatagccaagacagtcccaagcaaagagaacaaagctggagacctcatgctacttgacttcaaactatgctacaagcctacagtaacaaaaacagcatagtactggtaccaaaacagatatacagactaatggaacagaacagaggtctcagaaataacaccacacatctacaaccatctgatctttgacaaatctgacaaaaacaagcaatgggggaagtagcccctatttaataaatggtgttgggaaaattggctagccatatgcagaaaaccggaactggacaacttccttacactttatacaaaaattaactcaagatgaattaaagacttaaacgtaagacctaaaaccataaaaaccctagaagaaaaatgaggcaataccattcaggacataggcatgagcaaagatgtcatgactaaaacaccaaaagcaatgacaacaaaagccaaaattgacaagtgggatctaattaaactaaagagcttctgcacagcaaaagaaactatcatcaaagtgaacaggcaacctacagaatgggagaaaatttttgcaatctacccatctgacaaacggctaatatccagaatctacaagaaccttaaacaaatttacaagaaaaaacaaacaactccatgaaaaagtggatgaaggatatgaacagacacttctcaaaggaaggcatttatgtggccaacaaatgtatgaaaaatagctcatcatcactggtgattagagaaatgcaaatcaaaaccactttgagataccatctcatgccagttagaatggcaatcattaaaaaatcaggaagcaacagatgctggagaggatgtggagaaataggaacgcttttacactgttggtgggagtgtaaattagttcaaccattgtggaagacagtgtggtgattcctcaaggatctacaaccagaaataccatttgacccagcaatcccattactgggtatatacccaaaggattataaatcattctactataaagacatatgcacaagtatgtttattgcagcactattcccaatagcaaaggaaccaacccaaatgcccttcaatgatagactggataaagaaaatgtggcacatatacaacatggaatactatgcagctatgaaaaaggatgagttcatgtcctttttgcagggacatggacgaagatggaaaccatcattctcagcaaactaacacaggaacaaaaaaccaaacactgcatgttctcactcataagtgggaggtgaacaatgagaacccatggacacagggaggggaacatcacacaccagggtctgtcgaggagttaggggctaggggagggatagcattagaagacatacctaatatagatgacaggttgatgggtgaagcaaaccagcatggcacatgtgtacttatgtaacaaaactgcctgttctgcacatgtatcccagaacttaaagtataataataattttttaaaaaacacaatgagataccatctcataccagtcagaatagctgttattaaaaagtcaaaaaataacatatgctaatgaatttgcatagaaaagggaacacttatatcttgctggtgggaatatcaactagttcagccattgtcgaaagcagtttgataattttttgagtaatttaaaacagattcccctttcaacccagcaacctcattattgggtatttacccaaaggaatataaatgtttctgtataaatacacatacactcataggtttattgcagcactattcacaatagcaaagacatagaatcaacctaaaggcccatcagtggtagactggataaacaatgtggtacatatacaccatggaatactacacagtcataagaaagaacaagatgaattcttttgcagcaacatagatggagctggaggcaattatcccatgtgaactaatacaggaacagaaaactaaataccacatgttctcacatataagttggagctaaacccaaagaatagaaaaacagatgccagggcctactcgaggccaaaggtgggagaagggtgtggatagaaaaactacctgttagattctatgtttattatctgtgtgacaaaataatctgtttaccatttccccatggcatacactttacctacgtaatgaacctgcccatgtacctctgaacctaaaataaaagttaaaaataacaataataataataaataaacataaaaacaaccttcatagcaacatccagacatgtttaaacaaatatctggatgctgtttcctagccaaggtgatacatgaaatcaaacatcacaagttcatcccttgtttacctggcacttacatacatcgtattaaattatatttaacatcaaataatgataattgcaagatcatgataccacctaacgtgatacaaccattatatacacaactgaacatacactagccccttctccaggaaaggatgaaaagtcctttagttacattcattcttctacttcatggtctataaattatatactgtgatgtaaagttaacaatacttaaatactatagtataaactcaaaaatcttctaatacacatgcacatgtattcacaacaaattaagaaagaaatactcataacaattacagttctttctgtaactaatgactagccataactgatttttataatttccttcttccactaaacaatccaaattccctttttactcagcaagcaccccagctggccatggctctttacctgatggggtgacacaaactttcacttctgaaaaaccttcattcctgaaagaactgtttaacaaaattacaaatcaacatgccctttgacaaacccaacttataaaaatatattctatagatatactgtcatgatattaattataaatttataagattatttattacagcatttttatagtaaagacaacctaaattaccatgaatggggaactagttaatatggttgtaccaaatgccaataaaattaatggagtaaagacctctaaaaagtctccactcaataaaagctataagaaactggcaaaatttgtcaggacaaactttttccaaattctaaaaattgttcagaggcctgcagcaattttgggagcatttattcaggaaataactttaaattagccattgtaagtacttctaaaggactaaagaaaactgtgtctacaaatctagttaaaatggcatcagtccccaaattaatctacatattcaaggcaatccctatctaaattccaatggcagagatgtggagaaatagaaaacctcatacattgcagataggaacataaaatagcacagttactttaggaaaagagtttggcagctcctcaaagtattaaacatagaattaccatattccacacctagttatatacccacaataatttaacacacatgtctacacagaaatatttacacactgatgcttattatagcattattcataatagccaggaaaagaaaacaacctaaatattaaaacactaataagtgggtaagcaaaaagtagtgtatccatacaaaggaataatattcagcaataaaaataaatgaggtatgatatgtattgcaacatggagaaacctcaaaaacattacaccaagggaaaaataaaaatagccatttatgtatgaattcatttacataaaatgtccaaaataggtaacatcataaatacaaaaagtagattggtggtttccagggactgtgggggcaggggaaaaaatactgagcatgaagtttctatttggggggataaaatattctgaaattagtggtaatgcttggataattttataaatacactaaaaccactgaataataccattctaacggatttttttgatgtatgaattatatcacaatgaaaatattcagaggaaacattaataaattattgtacagccatatagtgaaatactgagcatccataaaaatgaatgacatcatattcattatattgacatcatatccaaaatgcactaagtgtaaaacttaaagtgcagaggatttttacagaaaaagtgggctagggaacatgtacatacatgtatttattatatggatgcatgtacatgtacaatgtatgtaaaaggaattgagaaacttaacattggatgcctgtggcaaggggaactgaataatttgagacatatttgccatggggacttttcaatagacacacttttgttttttttgaaatttaaatatgttaatactttggcctatgcaatactaacaattaaaattcaaattatcaattttattgtcaaaatatatgcagttaaaagccaattataaaacagaaaaatatttgagcagtttatacaaaccaatagtaataatattgacacccaataaaaatatataaaagataacagataatttttagaagagaaaatacaaaagagatatacatttaaaactcttaaacattattagtaatctaaaatcaataaagcaacttatttttatctttcatgtttgcaaagattttaaaaataccaccaatactaccaatatcaataccaccaatgtattcaccaatacagtaaggagtatgaaatctcgcatactacttgatatggtttggatctgtgtccctgccaaaatctcatgttgaattgtaatattcagtgttggagctgatgcctggtgagaggtgattggatcatggaaatggtttctcatagttaaacaccatcccacttggtgctgttatcatgatagtgagtttttgtaagatctgtttttttgttttgtttgtttgtttgtttgtttttgagatgggttctcactctgtcacccaggctggagtgcagtgccttgatcttggctcattgcaacctctgcctcctgggttccagcaattctcctgcctcagcctcccgagtagctgggataacaggcatgcaccaccatgcccagctaatttttgtatttttagtagagacgtggtttctccatgttgaccaggctggtctggaactcctgacctcaggtgatccacctgccttggcctcccaaagtgctgggattacaggtgggagccaccatgcctgtttttttttatttttttagacagagtcttgctccatcacccaggctggagtgcaatggcgcgacctcagatcaccgcaacctccatctcctggattcaagcaattctcatgcctcagcctcctgagtagctgggattacaggcgcacgccagtttgtaacattttttacatttttttcttagagtttttatctctctgcttacattacctatctgttttttcattttgtctactttttctattagaggccttagcatgataatcacagttatttgaaatttccaatgtaatgctttcaaaatttcggccatatctgagtctggttctgatgcttactttctctcttcaaactattttttcctggtaaagcagtttgtaatttcattgttgttgaaagctagacataatgcattgggtaaaaggaactgagttaaataatatttgagtgtgaggttttaagtttatctgtctaagagtaaagctgtgtttaatattttctttacctggaagggtcggatgctaaaatttcctctggtattctagtttttgcacccccccaccttttttgtctttggatttatctaaagattccttcttaaatagcatctgagccttacattctttcatttataattccctattgttatatgggaggcttattggtatgatggtaaagtgtaggggagagaaagtagtctataatcctatgattaggtctccatctttccatcttttagtaagcctgtgcttctggactgtttcgttcacaagttcttcttgactgttccccaacatccagcctcaagttaagtaaaaggctagaaggaattagagttgagtattttctttctcccatgttggctatactctggcaaaacccaccttgcttaggcgctgataaaatactttttttgagggcaggctttttcaagaaaaacagattgcatttttaaaaaatgcttacttttccccttcttctgaccaaagcataaaaggcttttattctaatcttcatggtgagcaccaggtggggacctcctaagacccattacctagaagtttttatctctcaaggtggtccatgctcaatttccagcaattaatcaattatgccttaaaagctcctaccaggatccagcagcaactttttattccaggaagccagtattctttgtatacaccaaattctccagttttaggggtcatgacttgctctataacttcaattctctgacaaatctaagaagagttgctgacatctggttttttcagctgtttgcttgttgtgagaagaggagtgacaactttcaagcactttgcatttcagaccttacccattgtacattttatcagttttatttttctattttaaaaataatgtttctttcaaaaaaaattggaaaaaacagggctcaaacacccaacacaaaataactgtaaacctttccttatttgataaacgttttaagggtgctttatttatttatttacttacttacttactagagatgaggtgtgtgttgcccaggatggagtccaatgactattcatagtgtgatcatagtgcactacagcctcaaacttctgggctcaagtgatgctactaccccagcctcctgagtggctgggactacagggatccatcaccattcctggccagatactttactttttaagtacaaaagaaatatgctcatagaaaaatttcaagtggtacagaaaatgaaatgtgaaaagttaatatcttcctcaattttcttttttcagagataattactatgagcattgtattgtgtgtccttcaaaaattggtcggtgcatacataagtgtatttatcatgttttatatcaaatggattattccatatttagtcttctacaatttgttttttttaaaaaaaattatagttgagattatagcatacttacagatttatattttgctttttaaattttgtattataaatattcctcttcatattttaacccttaataggtatcataatagttgtcttcgttatataaatatactgcaatatacttaagctgtctcgttgagcattcagttttctcttaatgtttgctcttcaatcaatttaacaaatatttattgagtatttatcaggtgccagttcctgtacatgtcactgcaaatacaacagatatatatatctgtacatgtacacgtgtgtttgtgtgtgtgcgcatgtatgtggacttcatgaagcttaaattcaaactattataaataatgctgcaacaaacaactttgggaataagtatgcctctgccatgtctttcttttgcatagctacttaaaagtggaattcccaagttagaggatatgaatattttaaggtttgaatataaattgccaaatatctcgttacaaaagctgcatcattttatgagcttgtacaagttacacaggcagatatcatgtcattcttactatatcactatatttccaccacctgagatagtgcctgtcacatattaggttgttaatacttgtttgtttaataaatgaacaaaatctcattagcagtccataagaaagtggctatctcatttttctttccaatgatgtggttgaatagttgaaggtgtattttggagacagtctacctggatggtatttctcctctgcttgatattagctgataaccttagacaatttacttgacctttctctgtcttagttttcttatctataaagtggagctaataataatataacgttatggggtagttgtaaggattaatagattagaatttttgttaatctattaatacatattaatgcatgtgtgtatgtatacgttcaccaatgtatatttccaatatatattttgtgaataatctatttatgcctatatcttttttcctgttaaaaaaacagtatcttagggtttctcttagtgatttgtataaattcttcattttaaaaaatcaagcaaacaaaccttgggctctgatgtcagagaatcagagtttgaattctgactgtaccactaactttgtgagtttgagagagttaactaaacattctatgtcttcattatgtcatctctatcatgaagattataagaatgtctacctcaaagggtttttataattgttaaattactcatacttacaaagcacttttagaagttccaaatatgtattaatggcttaatcaatggtagttattctcacctcttaccaagataactgtgatcttccttctgtttccaaatcactctccgtccatatttcatcttctatactgctttgagactcatcttccgaaagacagatttgctcattctctttctccatctctactaaataatctctatctcctcatcactactaaattaagtctaaattcagcatagcattttaaggctttccactctcttattacaaattaccctttcagccttgtctacatgaatgcctactcctccaacttgggctccttgctgttttgtgaatgtgcttgtcactttcccttttgtacacacttacttaagctattctttcttgcttgaaatacttctcattttatttctacctagcaaaatttatgcaagtctggctcaaatgccatctgttccaagcaaagtttcttggttcctccaaatggatggatgtgcttagtgcctcacctaaagtaaaactgcagcatttgcatatgtgtgctatcctttatgagacaataagctgcttaaggcaggaacattgtcttttttttctctacagggctaagcactcaataggtgatcaatatcgacttgttaaattgaagccctgatatttataactagaatactagactaattcctaagcttatttcttagaattctttgttaagatactttgattgaaggcaggggactgttgaatgtgtcctagaacaaagaagatagaaagcttgctgaaaatatttttagacatgtatttctttgatcaaaaatatttatggagaacctaccgtgtatgtataaagtggttctttcataagcatagtcttttgtcctaggagcttacaggtttccagtctaatatgtttcttttcattcgacagacaagagagaaagaacaggtaagcagacaagaaagaattaaaaattgctgaaagttttacaaaaatgcaatagagttggagtaaaacaaacacaaaacaaaaatgttactgagatgcccagatacagagaaaaccataaactttctccctttttttccacgtggtagcctaggctgaatcactcgttcatctattatttattcatttgtgctattcaacaaacctttactgggtgactattatgtggagagctgtgcttagtgggtaggaaagacagggagctcatagtctgtgagcttaggtagctacattaataacaatcatacaaggtagacagcataaagagtgtgtattctgggaggtcaagagaagcaggactcactgggctatagcaaaatcacagggaaaagtaaatcataaaggtcatttttgctaccacacggctcactgtgggagttacagaatttattagaggcacctccaattggcatttgggcagtttctgatccttttggccatctattgtcctgttaattgttctccaaagtggcataaaaagcactggagatagcattttagttttgttgttttcattcctaaatttgaattcattatattttttggccatgtttttcctgattctctgattttctcaattttaaagtggtaatcagtcagaaaaatatatttttatatactgcacagctttttttgcttcattgttggtgtttttgtcatttattagctctgtggccttggataatttactttactctcccagtctgcaaaatggagagagtaataacacctgcttcataagattgttttgaaaatttaatggcatgactataaagtgcatggaagagtgtgtacccaataagcatgagttatcttccttctgactcttttcataagattcaaagaagacagcgtttaggagtcagaagatgtcaactacttatgtga

SEQ ID NO: 4769 - DNA, 107 bp, human
ctgcttgagtgcaggcacatgatcacctgcaccaagtgtagcaagcgcatgagcaagtgccccatctgccggcagtatgtggtgcaagtcattcacatgttcaaatc

SEQ ID NO: 4770 - DNA, 104746 bp, human
cacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgcagctgccaggtcgccacactcgccaagcggcgagggagcgcctttgcctaccaggccggagaaccctgttcttcagtcgccttggcaggggcagcccctccttctggcaatgatgtcagctgcagagaggcttggcccggccgatgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaacccagatttggggtcttccctcctccatttcctcctttcctccgcgccccagctctctccctttttcagcctgcaccttcactattcacagtgactttacttatttagcaacattttagagggcaagtgttccagatgcaataatagtagtaactggtgttaaatttctgctgttttctctcccctcgggtgataaaaaagatgtgaagaacggcctctttaaaaaaaaaccccgtggctgctgcttcgcctgtcacagagcaagctctctagaaggcggggagggtcatctttcccacaaaattgtgaggtgggggagggtttgtaaccttaggcgaaagcgcaggctggggaatccccttcacagaaagaagaaactgcaaattggaagttgcggaaaggctctatccactactgccataggggagagaccaccatgctctttatttagagacacgcgctccaaattgggatgatgcaggaataggtttctttaagacggaagcccgctgcggcttcccttttgagcttgctcttatagtcctaaggagcaagcccctgctttgccaaatttgaggctaatctgttttcctgattgcggacaattccttctttagctttggtagaagggccgcagaatgcagttggagaaggttgcacagggcaagagggaggggcagaggcagggcgtgtagaggcaactggcgcctggagcagaattaccttccaaaggaaaaaaccttcaaggggtgtcgcaacaaactgcttacttactgtgttttggtttggacgcaggtgagagatgtgggcaaagggagcagaagcaaagaattactctgttttgtaaaggtaggattcttcccccttccttttcttcttccctttgatgaaaagcttccctttcatgacgtatagctggcagcaaacttaaagttgctgtgcgtctgaaatacaggaatgggaaagaaactccgaccaagcataaaacacactcattttctagagctcagtcatttgctaagggttgaaataaactgtgcacccccactccctgccccttccccctggctccttggcctttttgtcaccggactggattctgaaggacgtccaggtaatgctgggtttcagcagctgaaagccctggcagaagggattgcaggtttcacattcttccttctcttggtattcaaaactttatttttttttttgcgagatagaaattcttgatagagagcttccagactgctggtggcagggaagaaatctggttaagagattcagaaagcagaaaattctttttctctgcgcaagcagtccacaacagcatttagctaggatttataagattcttggtggagcaaggggaggcacatcgacaaaggagagtttatataagccactggctttgagctacattgaaaaaatatgtatggcagccacgttttcttagtgggaaagaaaattattcagggaatgaaattttgaaggctaattctctccaagaatcttgcttcacataatttaaaggaggtgtcatccctgtatttgttcactgaagagtccacgaactttaattagtcacctactgtgccagacaatgtgataaatggtgtaattgaacataatggagagaggaattaatttttgttaagaggttgagaagaggttcataaaggagagagaggtctgtggctttaaaaatagtcattcctagtcagtggctagccaagaaatgtatctggaaggtcatgccctgtacagaataagtaaggaagggcatgagggcttgatgtcttgttacaaagtttagaggtatatgtgtgttttgtagacctagaacatctttgaatatttttttccagcaaattcgttaaagtaacaacaacaaaatagcctgagaaaattgggcaatagatagcacacagtagaaatattattgttgtttgcatttaaatgaagaattgaatacattgatgtattacagtagagagtggaagcaaatatgttaagaagataatgtaacatccagaaaagaggactaatgaaagaatagggcctaaagctaatcagtataactaagaaagaaaagaaggctactttggggaataaaatttctctttaggcatcatcatctatccactcagatctttttactcatctcagtttccccatccagccttcgaaaaattccccatcttccatctatcgagtaaactccgtttgtcctggggagacccccactccttcagccactttcaagcacattcatcttcacctcaccccattttctacacacatccctgcatcatctctgaaccttacatcatgtaacattttacccacttcagccttctttctacaaccagttagagcctcttaatcttgtctttttcctccctttaggcactaacaaatagctctatctcgcttctttttcctcctctaagtcagctattccccgcccctttcccatgcattaattatcctgctaatttgtccactcatttcccccttttacatcctcctccccattagccaccttgcattctcctatctttcattgacctcaaagaagctaaggggaaagaaaagccactctactttaaacttgcttagatttgccaaattttcgtcatcaaggtttcttcctttctgtgtcttttgctgttttagttcacacaagacttttagtggaattccttcaatttgttatatatttttattatgcctgcaaatgtctgttttcctttggttgtggctggggattcaaatattttactttggggagtatttccaacctttctgaagttctcactgacacactcctgacactgtttcgctgcatcccatcctttctgctgtattctcttcccatgggtaattccttttatattttcagtgaaattctttcttatttttattccctcctccccccctcctcctttttttctttttgctttgtgggattggtatagcggctcaagtttaaatattttgagaagggacccccctcagcagaccccctcatcccacacacaggattttaaagcctgtgtcaacgtgtgttcatgtcaacatacagttaccaatcttcagaggcaaaggaacccctgtttgttttattttaactgcactcttagaaaattctttttctgtgtgtatggtaaaggtgcaattctcatatcgttcttctctctacattcagtggaattgattcaacatcgctgggaattgggaagggaagaaagagtacgctgtaaaaatacatttttcatcaaagacatatatacatattacctttgggaaaaataaaatactttggaacatttaattggattggctttatatgacaacattccaaattacatgtcattgtctgagcagagttctattatttgaagactttattgatcattcagtgtccagaatgaagaaaactaggtaagatgtcttgatgttccaaactggcttgctatgttcaaattggtcatatttgaaatggtgttatttttcaatagaagttcttcacgaaggcatcatctctaaaatgtggttatcttttgttaggagaaaacatcaaatgacctatgtgtcatggtcccttaagatttattctctatgcaaggttaattgtaaaataaaagtttatcagatagagaaaactattttagggtgaaactgtcttttgatcttcagttacatctggagaaacactgcattctcattatcaaacagcaccaaaacatgggaaaaagagtatttttcaattactgttttgaatttgaggagtagcttgccagaaattatagatgtacctgttatctttttgcaatctaaaaatcctcaactgttcaaggatttaaactgcccttttaattgtctctaatgtgttatgcactggattaatataatacattttaagacaaagaacatcagtggctacaatttttgtttccagcccaaatctgaaagaatgatttttgtacacctaatctgctcatcttgaacgtgtagatttgggtaaataggaggaaagataaatgaaaggagagaataaattccggaagaatatatttctctgttcaataaaaactgttttaataatctaatataacttttagcatgacaatgataaaattaatttgctgatggattttaattaaactaaaggaaaattcatttcttttaaaaatccttaagtgattagagtgcaaattgagattttagctaattatataattcagttactatcatcacataaaatgaaattaaaagattgttttctgtcacctttattttgattcattctttaactccttcaatatgtatagtattttatatttttatatcatttaaaaagttatattaggatcataaaaattttttgagtagaaaaagaaggcatggttatacccattttgtcaatggggagactgaagttcccgctgatgaaatcagctccctaagaatttccagaattaagaggggaagcttcaagaggattgatggtctttagtctccaagccaggtcttttcccaacatcccttcttgcctctcttttatctttgagtatatgttgtcaaagttctgaatgtaaaaagcaaaaatatataatgtgtcttggattaaaaaataaaaatttcaaagacaagtatattcaaatatattaaaataactttttcagttaattttctactagcattatattctcctatttagtgtctttttgcactaagctttgtaaacattatatgatattaaataaaatggtagaactattgaaatgttaacagtacatgcttatatgcttcttccattttgtttacaaaaataatttaaattatgacccatcataatgacagtccctaaagtttgagtttacttaatgtagcaaatgtttagtcctatatcctactatcctactgtcatttttttagaacacctgtatttttacataagatttattttaggggatgtttgccaatgatttttaggtagtgttttttttcctgacacgacattttggaagcaacatatctttgataatcagttgagtgtgggtttgtatcatatcaaccgaaaggatattaagcccccaaaattcaaatcattgtttgttgtcttcagattacaaactcgtttcaggtacagtgagagcaggggtttatttaaattgtgtgaacacaaggtcttttatgatttatgttttattagtgtctagagagtgaccttgggcaaaaaccttcacctccctggacttcaatttccccaaaagtaaaatgaaggaattgtaagttatttcaaggccctttgcaaagggaaaaaaaatcctgtgatattttacaaaaagcagtagacgtctaggacattctttccttgtcccttggctctgcacgtattatcaatttgactgtattgattcattaaccatcaataactaaaaacctatggcttgtccagcattgcaatactttaaatgttaagggtggcccttaaagaaattttggagagttctgtctttgaaaagcttatattctaatagggctaaaacaatgaacaacaacaacaacaaagtaatatatagtcacattaaattgaattcaacaaatattcgttgtcactctacattacagtacaccaagtatagtgcaggttttatagactctgagagtggaagggaccagaaagataatttagtccaaacccttcattttacagataagaaaaggaaggctcagggatgagatatgagtgctacaggagttcatgtaaggtattgggtgatagcatgaattaatttattccacaaacatacttgttccctgctttccaatgtgtttagaattttaaaacaccatcatgtagggctttttaattacctttgctcaaatttaataatagtatcttatcagaaagttaaatgtatccaaaacttgtttgttttttgttgcagtaaacaatttcccactctgactcagatctagaaaatactgtttcccacattttgtattgaatagagattattaaaagcacctgtattgtgcatattatgttataaaacataaaaagtgatgttttgatatggaaaacaagtgaatggattcaagtatcaatgcattaagtattttattttttttaaaaaatgactggaaaagcccatttacttaaaatggctagaaatatacattcctggaaggatggttttatttttataaatgcatatttactctaaatagttaagtacacatttcctttaagttttaaatataatctggggaagattttgagtgcattctctaaaatttgatgattgctacataatctcattctctatgccagggcatatgtgcgtttgttagggagtatgggtcaggcaaaggtaggcaggaaaattatgccaaagcaaagctttcccttctttcctgagtaatcgtagactgctttattttactttgtgacagaggaagaggggaggagaaaggaaatcaaatagagaagaaagagaactaccagagcgttggatgatagggcctgattttctcttcagtgtgaaatatgcaagctttttgaaactgccttggatagcttctctcttttacttctcatattatatatttagaataccttaagtgttggctggtcgcagcggctcacgcctgtaatcccagcactttgggaggctgaggcgggcagatcacgaggtcaagagatcgaggccatcgtggccaacatggtgaaaccccgtctctactaaaaaaaattacaaaaattagctgggcgtcttgctgcgcgcctgtactcccagctactcgggaggctgaggcaggagaatcccttgaacccgcgaggcggagattgcagtgagccgagatcgcgccactacactccagcctggcaacagagcaggactccgtctcaaaaaaaaaaaaaaaaaaaaaaagaaaagaaaaagaaaaagaaaaaagaataccttaattgttatttgatggttgtttgctaggttgtgagaatcaaaatcttccaaaacatgaatacattaaatttttttaaagagaggcttaagaataggtaatacacacaccaaacacacaaacaggacaaaacctttacatgagagctcctcaggcagaatttcctttgcctttctttttagatcgggaaagaatttgctcagtttgtcagtgacgttttacccttcagtctgcctccacagttcttaaagctttccttgtctgcagcctttcttagtccatgaattcagttttagcatccataaaataaagcagttacaatatgtgctggccattttataatggccatgagtgcaaagcaggattacttaagaaagagcatttgaattcactgaaagtcacagacattctgaatgcctcagaactgcatacaggagtaaacagatatgggaatataaggctaatgttcaaaaattggatagctggcatatataacagaatcaaaacactttagaaagaaatagaaccaatatacaattactaatcaatcagcatcactgctaacgacttgttattttaaactccagtttctaggaaattacattctattcctgtgcttctcaaactataatgtgcagacagatcatctagaaatgttaaaatgcagattctgattcagtagattctaggtgaggctgaaattctgcatttctaacaagctccctgtacacatggaagctgctgcccctcaaactacagttatccaaaaggcgctgatccatagtctggtaaacaagcatgataaagatgaagtaagccaagggtaacaggatttcttaaaagaaaaaagaaacaatttaggtatgtgcaatggatgaaagttttaaattcaactagatttacaattatttgcatttagaggttaaatttgattttaaccttttgtgtgactatattggttgaaactgtagttcagaataacaaccagttgcttgtccattttgcagtcaaatctatttcatggacagtttgtacatacgattataccatttcaaaaatgaaaaccattcatcatacagtgtcaacggtgtaccagtatcttaaaatctttttaaagaaatccaaaagttctgagaagtcttagtatagtatagacccctaaagatattggtttgtaaaatatcagaattgaacatatcagctaatcattcagattttagagtagaatatccaattagattttcatttacctaatttgaaaaacttctttttattttcttattagtacacacattttgcagaacaacaacagcaacaacgaaagacacttggtagagattattttgtatttgctgtctcaaaataaaagtcctcaaagtgggaacaaatggtaaattagacaccatgctaaccactttcctcacaactagacttttatcttagaatacagccgaatagtcacttaatctaagtgaaactttcattcattattagtttaggaaaactttcatagttctcatttctttatgtgcagctcagaaacagtatcaagttaaaacaaatgacattgaaagcaaccattgaaataagtgtaaatgtttaaattgtgcttgctaggagacacggtatagttctagcagggttaggaaaacaactgaaagttttcacttcagcgttggaattcatgtcttaattgtaccattgagattcagaagccatcaccttcccgatgaaactgtactagtcttttctaagctctgatacttacaggaacagcaaagtctgtttagtggtaataatttgaggatctcagtgagataaagggccaattggattaaaatgttcttgtaagtgctaaatgaacttgagtgtctgccaaaattgccttggatttcattactcttaacattacttaataatgttaagctagtgcccatgtgggtatgaaccccaatcttgctaacagttttctgtattggtctgttcttgcattgctataaagaactacctgagactgggtaatttataaagaaaaaaggtttaactgactcacagttctacaggctgtataggaagcatggctaggggaggcctcaggaaacttacaatcatggcagaaggctaagaggaaggagtcacgtcttatatggccaaagcaggaggaagacggagcaggtgcaggtgccacacacttttaaacaaccagaactcgtgagaactcactcactatcacaagaacagcaaggggaaaatccacccccatgatcctatcaccttccaccaggcccctccttcaacactggggattaaaactggacatgagatttgggtagggacccgaatccaaaccataccatttaagcatagactgtttccatgtacctaatggggcacgtatagcagccaaaataccctatatctttttagggtttttttttttttgagagggaaaatccaaaatatacaaaaaggaaaagaaatataagaatcaagacaaaataaacagatagcaaaacatcttcatactctattatcaaagaatagagaagaaaacttactctatggtaaatagaaatatcagttctatgaacacgatcagtacattttttttttttttttttttttgagacggagtctcgctctgtcgcccaggctggagtgcagtggcgcaatctcggctcactgcaagctccgcctcccgggttcacgccattctcctgcctcagcctcccgagtagctgggactacaggcgcccgccaccgcgcctggctaactttttgtatttttagtagagagggggtttcaccgtgttctcgatctcctgacctcgtgatccgcccacctcggcctcccaaagtactgggattacaggcgtgagccaccgcgcccggcctcatgttttaagacaatgagaaacaattgagttaatttacaatggcattaaaataaaaaatcatatgtaattaaatacatgtcaaaaatcagactatctcagactcataactggaaaaaatatgaaataatttcttggcctgatccagcaaatattagaatggttcaaaatattaaacaaaataatgatgtcagagtattccaattcagtttcataactttaagtcatttatatttccagcttcagaatcaatttgagtagatcttagaatgagtttaattacaggaaaatattacataactggatgaaattttaatcataaatcacagacttgaagaatagattttaaagagatggcagtgaaggttgagcaatattagccagaagacaatactgtataatacatactaaatgtctaagtacttaaagtacttacaattgctaataatatgataggatcacaaaagaattagtaagaactttaaaggaaatggattaattatattcattagaaaaaaaattacaattctaagttacaattaggttccaggataaggactgacaactcaaataagcatcatgattcagagaaatggaagacactttgagaacatgatatacagtatttcctttacaatatcattacactttatatatttttatatcctatgccaatgatagcaactattagatcgaagcaaaaataattgtgggttttcccattaatagatcacccaagaacatgctttggttgtaactgaaactactaagtttttgaaacaggtaaactaaaaatcaaagcagatttatcatgaaacttaacacaaaaactaaacaaaatactggaaatagcactttgcagtaactactaaaagcaatatcactaatatcacagattttactatgtaaataattacattatcacttttaaattgctttcattgcattttagggtactctggcagattttttttcatctgaatctcacaacagttctgtgaaacaggtattgcatatattatatatttttaacatatgaggaaagaggcaagacaagtttttctattcttaaaatcacataccttttaggtgtcagagacaataatagatccttgttcttatccctggaataatatttgttttatcagctaatatatgcaccaatttattaggttcaaatataattaaggatatatattaaataacaatttagaatatattatatttacttttttaggagttttaaatttgtactacaaagtttcagtgagcactttttgaatcttattcggcaaaactattgtaatatccctggctttagtaatttaaaacatgtattaacataactatacaattatacagtagtcaatagtggactaggaaataaggatgttatcagattgaacaagaaaggaatactaagttggaaaacaaaattaggatttggttctattttcaaataatttcggaaaccagagtcaaacttcaagggattgtcttctctgtgaagataaaaatatttgaaataataggtctagagggagagtatttgggagcaaaaaggaaaattatggctatgggttggcttagatatagactgttaataatacactaaggtgtattactctggctaagtactggtaatgcttgatcacagaactttggtaggtttcaagtttctaattttatttgaattacattcaagcatttccgtaatagagttctgtaatagtagttaaccatgtggggtgaatagttttatccactgagctcatactttgttttccattggaagaactagattattagaaactgttacaaaaatatattttgctgttagagaagcaaaccctgtttagtttctttagtgaataccatgagttaattagtagacttaaaaatataaatgatgacacatattgtgctgaagtgccactgaatataagaaaaacactatcctttttgtaaagtttccttaaaactacagttctacataaaggtgatatttattcgtgaatgttttcttgaaagaagcctttacatataaccatttaacacttcaaacaaccctgtggattagctggagcagacatttttagcctccctttcttttgtccatttctgtttttcaaatgaagaattgagctagtccagattagctaaatggcttgcctaaagtcatcgtcaatttagttaggagtaacttaagattccatgagcttttcaccattgccatgtagactgagttactggtggtagataatttaacctaggaattatgtagtgatttgagatttttaataaaggaaggaaaagaaaggaaatgtttctcagatatagaatctaggttagggataacatttctttgcagaaaaaaatacaaattgtgatgagatattcagattctactgaattagcaatacactgaggtaaatcatgactagcaatgttttgatgaaaatatacttgtttgctgttggggtattcattctgttctcattattagtggctccaaatgaagaaagtaggaattattgtagtgaaatgcatgtccctaggcattctataataacctggaatttctagtttatttgattttcctgtttttacttaggaaggtgatatggtttggctctgtgtccccacccaaatctcagcttgtagctcctataattcccacgtgttgtgggagggacctggttggggatgattgaatcataggggcgggtttttctgtgctgttctcatgatagtgaatgggtctcatgatatctgatggttttaaaaatgggagtttctctgcacaacctctttctttgcctgctgccatctatataagatgtgactggctcctccttgccatctgccatgattgtgaggcttccccagctacgtggaactgtgagttctccattaaacctctttcctttgtaaattgcccagtcttgggtatatctttatcagcaatgtgaaaacagactaatacagaaggtcatttctgatatttttttgtctttgtgcataacttgtgcttttttggaagtaacttaaaacacaaatactgtttaactatgagctatgaacagttacacctactgacttaacgtgtgttttccagaaggttccattccctttgaagtgacttgcccaaggtcacaaaagcaacttagtggcagtctgaaatggaatttaggtctgcttggtcagtgtgcttttcactatattgtcctgtcacatctttcaccacagtaaaagggcttatgtacatttttttaaatcacatgtataatgatcatatagcccaaaatagtccagtgttaaaactagttttggttatagatttgaatggtaaataccaaactaatgtgtgttaaatagtaaaatggtgactctttttcaacaaattaaagacataaaaatactaactcattaactaattttctgaatgaaacttaaattttataaagcaatgttacatatgttataacatttaccttcttgaatgttagggacgtctcctacatgaggttttatgctacaatttaaactttaaattttacggaaatatcactataatactttactgcaacttagatctctcttgaatccaagaagtttgttttgcagaaatactgtaagaacagttttatagtcatcttaattttagtggcaggtccctatgacttaagaccccaaaatacattaaggtaaagttttaatgttccataaacaataccaatcatccaatttatggaacttatgttttgcttatttacagaaaaataaatatttgccccatttcaaatattttaaaggtgtttgctctattgctaaaaatgtctaacacattagacttttaatagattaatggaatggagttgtaaactattcttcagcaaacatacctttaaaggtcatgctgttctcaaaatataaattaacaagtttggttaagtgcaaggaagtagtataaaagccagcaacctcagttatattttagtcttgttatatttgtttgaatgaaaatttatcttacatagctatctttttttccaaaatgtaaaagattttccttgtgaacagacagcatttgatctaacatagttattggtctattaatttttttgtgttcttttctaccagagccatgtattcctactgcatagtatacatttttagagtaaattcttttaagaaataatttgaacgtctttaattttcagagaaaattttaggtgtagtttttttaattgcataactattttgaaactactatatagataaattttgaaattttagtaatgtggtgaaaaaattcaatgagaaagaatatccttgattcagaagctactgaagacaaataagtaaagttggaaactgttaaaggactaaaagggcagaaaaattgtcaatatcattttcttatctcttctagatatagctgacttgataaactgattattaaaagtaacaagttcacaataactgaaaaacccaagttcattttgaaccaaagattatggttaaaataccaatgccaaatttaccaaaataattacattttgcatactggataatcattatatatatagttggtacaaattaatccttagttatctatatcttagatgtctacttctgtgcctctgtgaagtaggaggtagtctaattatttccatggtatgaatatagaaattgagacttgcctaaatgtacaaagacagtaaatggccccatcagggatcacactcacatctttttcacttcacagtccagatttttaaccagaatgcgaaatataaatgtatttttgtttatattttgaaatatcatttaactatattaataattactatgcacataaacttttcaatttctttttagataaatgtttcatattatatccatttctcagctttattaactgtgttaggagtgcagaacaccgtgccttgaggaaacataaaagtacatcagttaaactgaatattaaggtttttcttctttcttctggacagcttaattgtaggagaaatattctacctataaaattgcctgtcgttaacaattcagttacagcctggtgaatgtgaacacacacactttaagtgtctaatttaaaactagattttctcctttgataattctacttttgttgtagattatataatgagtttaagcaaattaaaattatagatggcttgtgatctttctcatcaaagatgattgcatttttgtttcacttgtattagaaatttgacagatttgatctagaggcatgtacagttttgatttttaatggatttgcttggacaatctcaagttaaaataagaactttcaattctagtctctgttcagaaatcctgactcataatactgagataaatactggagggataaaatgtctctcagcattaaataactaaataacatttgtttgaaccgtaaagggagaattgagtttatttataatccatctgcataatacatctagttgaatcaatcaattattttaactgattttcttccaaattaactgctggttttatttttatgtggacattagccttattgtccaaaaaactcactctatatttctacttaagacaattaaaatgcagcaattccttattctttaatcatatccttagggtatttagtcagaatggaatattatgagtcaaagatattgatcagaagtcagtcgaaatttaaaatatcttctcttggatttattttcttcataactattatcatgcaataatgatgcaaatgcagtacaaacaaaaacatagatgaacacagatgcatttgcttgataagtacagacaaggaaacagcatggtagaaatttgcccaactagactttcattctagtagctaagctttatgctttttttcttaacttgatattttaaaaacttgaaaaaaaaaagaatcagtatcacttctcagccttttggctaagatagagtgtagtatctgttcctatcagtttaatatctgatatatcctctgtccgaggacaatatattacatggatttttggagcagggagatggaataggagcatgctctgtccactccacacattgacctggtattgcagtacctccaagaacggtgttcccctcgggggttaaaacacagtgttacaggccaggcgtgttggctcacccctgtaatcccagcactttgggaggccgaggcaggtggatcacctgaggtcaggagttcgagaccaaccaggccaacatggtgaaaccccatctctactaaaaatacaaaaattaaccaggcatgatggcgggcgcctgtaatcccagctactcaggaggctgaggcaggaggatcacttgaaccagggaggcagaggttgcagtgagccgagattgtgccactgcactccagcctgggcaacaaagtaagactctgtctcaaaaaaaaaaaaaaatcagtagaatcactttcttaaaatataagtacacagatacttttacaaatatatgatacacaatggccttcaaagtggatctagacaaatagaaatttgtttttaataatgtttagaaattatgtttctcttgctaatattcagtatcactttgttacttgaaaattctacttttcacagaaaacaacctatttttgtaggacttaggttgtcttcctgctgttaggatatattaccactacatagcagtgaggttgtaagaactcatttcttgttggaatgtattttactcagacgtggattatttcttcctttaatatatataatatacataatttctgaaattatataataaatcataaaatgtttatattcaaaacatacttttagaaatgaagacttaggtcacatttattctgttttccttatatcatcagctaatacttaatgaaaccctacccttcaccagagattttgaatagcttattttttacctactccatattttctattttccagaattatctcttgaaaaaactcatacatgcataattgaaattaaaattttaggatattccacaaagttgaatagaggttttaactaaatccatgacctcctaaacacaaatcttttttttcactgacattaaaaaaagtgtatctatagataaaatttctattatccttcaattaataataaatcacaaacatacctaattctgttaagtaaaagaccacatgtctattgaggaattgtactaggctcacaagagtgagtgtgagatgattactaagagactgtttgctatgaacagtaaaacacatttttttggtataatgtgatatatgatataaatgagcttgataaggttgtttaaagattcacaaaagaaagtagatttctggcctttcacttgatttactatgaatttctgcaaaactactgagtttcctggttgtgaaataaaaataatgactctttaacaacttgtctgactgtgcaagtgagtgataaaacttgaataaaaatgtattattcagagtagaactgaaaggtgtgaggctctagatgttaaacatttatattcataaattatcataaacactgaacactgatatgtgttcataagtaaataaataagtagggagattgaactgatagtagggagattgaactgatacctcattaaggtttttgtggctggttgcggtggctcccgcctgtaattgatcccagcactttgggaggccgaggtgagtggatcgcttgaggccaggagttcgaaatcagcctggccaacatggcataacgccgtctctattaaaaatacaaaaatcatccgggcgaggtggcacacgcctataatcccacgtactcgggaggctgaggcacaagaatcgcttgaacccgggaggcggaggttgcagtgagccgagaccgcgccactgcattccagcctgggcgccagagagagattctgtctcaaaaagaaaatatttttacataacacttttcacactcttccattttctctccactttctcttttccttctactctcttttttccttcttccattgaattttcactactctttcttcataaagtaagttgttgaaagattaaatattttactgcagttcactctgttttctacttccattcttctacaagtaggcatctatgtcaaaaaataatcagtttgaaaatctcctttattattctgtttttaagcatctctttgtctaaaagtaaaaacaaaacgtacaattaggaatatgtgctttggctctttaaggcaactgcttgccccatactctgactttagccctcaattgtcttggagatgcacagtaaaaggatatatgcctaggagaataaggctttgatgtactgtatatctaaatgttgtctgacaaaattaacacagaaaactatggatattttttcttagcgtttggaacaaacatgatacataatagattattttgctgtaattaaaatgattttctatgtctaacttaatgttcatgtacctagttttggttgtttccatttagcaggtgaggtagcaattgctttcttttgaaaatttagaccctttctactgctatcattgactttggaaaaaaggcaaaaccaaaggcaaattaaccctataataaatatattcagttgatcattcatgttaagatacttgatggcttacatttaatattagggatatttattttacattcaaaagttattcatttttacttaaaacatagaaatgctgttttttaaaaaaaggtttattgctgggcgccctgggcctgtaatcccagtattttgggaggtggagtggggcagagagcttgagcccaggatttccagaccagcctgggcaacatgatgaaacctcatctctaccaaaagtaaaaaaaattagctgggtgtggtggcatgcggctgtagaccaaggtactctggaggctgaggtgggaggattacttgagcctgggaggtggaggctgcagtgaaccatgatcatgccactgcactccagcctgggcaacagaacaagaccctgcctcaaaaaaaaaaaaaaaaaaagagtttattatcccatctaggcttcaagtaaaatgatttaaataagaagggaagttacttattcaactcaaaagaatttaaaaggaaacataaaggattttaaacagcagtattcattttctgcctttgttagtcaacaaaaaagagggtcttgagtcataatgcagacaaaaggtaacatcggctgcatattgtgcctgaataatggagatttcttcaacagaaactgtttgaaaaacatttgcacggaagtagtagattgcctttgattatattcaaggggaaggaaatagccaagcatgattttccagaataaagtaaacttttctttcattagtgaaagttatatttttggagtgatataaacactttaaaacactttatacacaaagtgaattcatatagataaattacatattttaaaactagaaatattttcacattaaagctgaaattatacatgatatgaatgcagtattaattactaatgatttgttttgcagaaagattcttcattgtgtaaatgaattcatcatagactccaaatatcaagctctcagaatgtattaaaaatggcatttgttatcagtcctccaggtgttacatatgactcccagtcacacttagatgacagtatatgtgaaagatgcttaggagaggcaagagtctgaaaggccaacatatattaaataactttatttaaatgaaacaataaaatcctgactgatttgaaagtacactgatgcattatcaatgcactttcttgaagaattggtctcgagagaaaatgcttcactgaaataattcaggaaactgcccttacggcaagtggggcagatactcttcctgtccttcatagcgttctatatgtttaaggagcaatgctgacaatcatacacatgcatctgcatgcacacattaggaaagatggagtaacatgtctatctaagttgttgttggcaatctgtgttccccctcaggggaaatctttcaaattaaatttgggcaattttctttatgtagatactagaaaaggattctctctcagctcatatttgtgtgtcttttgtcattttttcttcacagttacggttacctatgctagtacagtatgctgcacataatttagatcaattaattctgttgactaaaatacacctttttggatcccctgtttcctgcttctcaccaccacacgttgtcttgtctgctgtgcttttaacagctctcaaataagaaatttatctttgcatatttaaacatcctactcctcaccccatattaaagttacattattaagaaggcccacacattctgataatttccatatatttattaatgcccacctgcatgaaataatttttcctgcacacttagttttgtgcttttcccagatatttggaataaatctttacttattgatgtagtgatttgtatggagaattgcatattagtggaaagtctgactaaatatctatatagaatatatgaagtcggactacatgaaatttctatttttcaggtcaaaattggttaaatatcagtaattttatctatttcaaccagtaaacaaaggtcacagttcagatgtactgaaacagagaaaatcataattatcagtggaactatcttctgaatttctcctcacatctgcagatttgtccggacaattacttagtcttaagtaaaaattagtgttggagaagtctttatgaataatgcatacttctggacgaagtgagatttgatcacttctcagccttttggctaagatcaaatgaaagtcagtttataaagttgagacttccgatttaatgttaatatgagttcctgaaaaatgaaacacagttctattaatgcctcagtacaaattacccaattatgcaacataaatttcaatgaaatgtagcatcaagtaaatctattttcctattcaattacttattgaatgaataggcatttttctaataagataggcatttggatcaaatgttagcattttttgtttctgcagatttattgtgtctgcaatttaatatggattatagaaacatacggaatgaagcctccgtataattgtttatcccattatcagaaattttgcaaaatttgattcctgagaaaaaggtaaattaaagccatttgccatcagttatctttttcatttttttttctaaactcggatttcaaacagaagagctcttttttgggtgatgtccttaataattacaatctagattctgattccaaaactttactaagttttatttatgttagtgtaagtgaaaaataaacatattttgtattgtttaaagtctgtgtagtagctaagggcttaagctttcgactcatataaatcttctttcaaattttagttgtataccttaataggtctgtgaccttgggcaagttattgaaacttttagagtctcaattccctcatatgtaaacggaagtcacaataacagtgcatatatcataagactgctgtattaaatgcacttagcacagttcttggcatgtaataagaattcaataaatggtagctactattattctaataactgattacattctttggaaattgtattaagatgaccccagctgcttagtgaatcactgtatttgtcagcatagtaatttgcagaaacatggatctgtatttcctttatatatatttttaataggattaggacttgcaggagtttgctagtgtgtatatgatcttggcagcaggaatccaaatagcctgagtagaaaactgaattttcccacattttttcaatcacatagggatagagataatccccactgttggctaaattgtggaagttttacgcttcttgtattggtgggttgctggcaacagtagtctacaaataaagaatattgtttcttaatagcttaagcaatgttaacatgatacattctctctttttaccaaaaagtcttttcaaactcttagcaaaattaaacattttaaaaaatcatcgagttaattaaaagaatattgtatccttaaaatatgccattttaatggaaattttttttggtcagtgagaatatgatttatttacaataatgccacaaaatatgaagtggcagttttatatttcaagtggttctggtcatttttaattaaccggagaggaagtgagaaaaaaataaagactgtttaaaatataattaattagattaaaattttaacttttgtttatacagtctttagtaatgtatttattggcttttctgaggaatctggtatttctgaggaaattctatttttaaatacatgctactttaaataaatgttacttcatcatttgcaaatgactattcaatcaacatgtataaaagttgtggatttctttgcttttatgacaaaagtggtattgtatttttaaactgatcactttattaggtcagagagggtatagttcaaagtgtaattatttattgttaaattgtatatttacaaacattttagttttgaaccattagatatttatgtaatttaagtatgaaagtttaaaaatggttcatataataataggcatgtgataaaatgtcatgataaaagacagccaaataaatattatttcatcctacttagaaagaataattttccagaggaactttactcagttttagagagaaatccaagaatagtgttcttctttcatttttcaacatgatataatcagagaatttggaaaactggtaaatataacctatagtaaaatggtcaggaaaaatactcatttccatttatgataactgaagtgacaaaaagactcctagaagttacattttccctttgtggtatattaaagaacaatgaatataccacactttattctaaaaaggactttttttgtgaatgtaaaggataatgatcagatttaagtttctttctacaaccacttctaattctattcacgtgatctatttaaaaattccttacttcaacatatttaaatgtagtagccattttgaaacattttagtccctcaagatacagaaatatacaaaaaacatacaagtttcagatccagaattcagtttctccctaaagggaaattcatcatccaatcttctggcgttctttaaactagacactagacccttttcatctagatattgcatatctcatatatattatacatgcatacatgtatgtgtatgcgtgtatttttaaaatcagtatttgtagtaacatatcaaaaaggaatttctaatattccaaggttctaatgttagaatagaaacatattcacaatagtgtttaccagtttcatatatttagagtagtttcacactaaaatgagtgattaggctaggcacggtggctcatacctgtaatcctcgtactttgggaggccaaagcaggggggcttgcttgagctcaggagttccagaccagcctggggaacatagtgagaccctgtctctacaaaaaacatttttttttttaaattagctcctcacagtgacacgtgcacctataattccagctacaggggaaactgaagtgggagtatgacttgagctgaggagttagaggcttcagtgagccatggtggcaccactgcactctatcctgggtggcagagtgagagcctgttgcaaattaaaataagtgattaggacaaaaaagatatagggccaaataaatagaatgcttacccacctcaaataaaaagaaaataatatttgttaatatgaaggtgatactggataagtgaagtgcctaggacttttttcttaaataatctagtatattttatgtgaataagggactataaagtagggagatcagcaggactgtaaaagtgggtgtgggagaagaaagtttgctagtcaaacttggtttaaattgactgcctttgtaatagcatgtggctgaatgttttgatctatttataatgaatattttaaggatttgctaatttttgaaaattggcaagaaatactcatttttttcctgtcttgaggtatgccaaaaataaaacttgctagaataaaaaaaaatgaaagtgaaggaatgtcttgtgtgtgctaaaacacctccacttaaagagtttgatatccactagaaaatgttgtttctttaaaaaggggacaaagggcatttgatgcttctcacctttcacggttgtgacaattctcttagacatcttaaattctctaagtggagatttcttatattcttcacagtacacctgtttaaaaattgtagtccacagaaatctgaaactacaaaagaaacttttctcaagatgataactcacaaggagtgtaaattacagttacttcatttgtgggagttttcctatcacttttcaattaataagacaccctggttatgggaattttagtctcactgaaaaactcaatttttctatgcaaattaaatttgcgtatgcaagttacaatttgagtttaagcttaggcctacgctgatggagggataacaggcaaactggaatgtggtacttgaccatacttagtcagtgcaggaaaaacaacaaaaaaatcttcagaaactttcttaccattgacaggggctagtgtcgatattccttgtggttttcccttattgactgtatctacgccatcacatagcaaaatgtacacaacagcagaaagtagacattttactcatagtttctgcaaaatctgaataaagataaagtttttctattataaataatgccaaagatgtggtcttatagatgtatgcattctaaggatcagggaaaggctgtgaaataaaactctaagttgaacaaaattcaagtagtttatcttttaacagaaatatctccataaaccatatcgatataaaggtgaacaggggttggacacagtggctgaaagcccataattccagtgttttgggaggccaaaatgggaggatggcttgagaataggagttggagaccagcctgggcaacatagaaagacctcatctctacaaaaaaaaaaaaaaaaaaaaaaattagccaggtctgttcatgtgtgcctgtagtcctagttgggaggctgaggtaggaggattggtcaagccccggagttggaggctgtagtgagctatgatcgtgccactgcacttcaaccggggtgacaaagcgaaaaccgtgtctctaaaaaaattaaaaataaataaaggtcaacaggaagaatcaataactaaggcagcaactggaattgacaaattaatatcaataagcttgaatcaactaatgaggatggttttgtgtgtgtgtgtctgtgagggggagagagagagagagagagaaatattggtgaagtagtattttaattcacccaccaacattctattgggtggccaaattcatagaggtattttattagaatcagaaatttcagaattttagaatctatgtgttagcaaactgtgtattcataggttcaaaagaggttcatgacctcttgttcctcataaatcattctaggaggaaaaaaatactaacatagctgtagcccctaagtcatgaagtgcatctgactgattcacaaaatgttaaatataaagggttacagtttttcaattaaaaattttttatgataaacattaatgggaaaaaacacttatttcaataaaatttatggaattcattattactttcaaagaaataacacccttatctgttagctctgtcgatccagggatgaaggttcagctagaaaaataactttaacccattattggactggtctttattaaaggcagagatataaccctaactatctcccactcttctgattatgtatttgtattaaatacctgattatttatttaaaatttatttactcaaactatggaaacattattcaattcttcctttgtttgcaaagaaagattttctggtcaaaataataaacattaatccacagaggcaaagcaaaaataacaaagatctctgtagataatattaacttttattcaaatttcacagttgttaataaatgtatattcaaaaggaatgtgtggctgggtgcagtggctcatgcttgtaatcccagcactttgggaggccaaggcgggcaaatcatgaggtcaggagttcgagaccagcctggccaacacggtgaaaccctgtctcaactaaaaatacaaaaattagctgggcatggtgacgggtgcctgtaatcccagctactcaggaggctgaggcaggacaattgcttgaacccgggagacggaggttgcagtgagccgagatcatgccactgcactccagcctgggcgacagagctagactctgtctcaagaaaaaaaaaaaagagaggaatgtgtgatggatctggtcattgataaatctatcactaaggttctatatttatggcatttgattagctatccacatcacattatgaggatatctactttctcaaagtattttgatctttgcttctagattaataaaaaatgtaatagtggctgaagtatttaaggcactcccctgggacatgaaaaaaaataataaaatttaggttatctggcactgcccaaataattgtatacagaaagtaagagaaaattcatgtatgtttgtgtttatctgcacttacggtagctgtcttaaactttagtctttaaatatagaagccaatatggaaggttaaatagatgattaatgctcatcctttactagaagtctctttaagcatatcttatttccacgttgatcatatttatctttagtaaaattataattaacgtataaggtttgtttaatggctacaatttcagctcatttgtaattaaagtttatcgcaagtaacttttataattaagtaacttataaaatctcagattaaagtaaattatattacttagtctcaacattttcttataaaacatattcttcttctgtctttgccttatctgttcttggcactaacttcttcagtcattcacacttcaaaagctttggactatttcctcttccttatacccacattccagattaaactttagacttttttatcttgcaatctcttactcttccaatctttcttcctacatcttccagctatttatcaaaaacatttaaagagctacttctttcatgaacctcttcttaattccgttacctcaaagtattcacattcttcggtactatcatatcactttgctctgtcctttgtcacttagcctatttagtataatatttatcttctacaaatcttgtgttatctcccccactacataaacttaacatgtgctttatacacagagggtgcttaaaaagtacagatcaactggatggatgaatggatggaagaggatggaatatcttaacaaaacacattttccttaagtaaattcatgcatactccaaataaaatacagaatgtgaagtatctctgaactgtgctgttgaatatggtagctactagctacatgtgagtatttaaattttaatttattaaattaaattaagaatttaattcctcagtcgcactagccacatttcaagtggttaataggcacaagcggctaccatattggaccatgcagattattttaataaaatatttttatcattgcagaaagttctattggatagtactgctctagaaatttttgctggaggaatggatgagagaaacacgtctatggaattcgagggagatcataataacaaataataaggcataggattaccacttcccatataaaaagtatgattcatagccatttataatacaagcaattacccctcaaagttgaagatttatattagtatcattattatcacttttcatttaatccatactttttgcaacatcgataatataaaactcaaaataattcatgtaggtaggaagatgtcatattttccacataaatatgcattaaatgctttaacaagtctggcttaattagaataagaatacaacagactaggctggcttttcaaaaattttaatagcttattccctgttaaagctaagaaataccttccagtataccctacctcccaaagtatcagggattttttgttttttaatccaagagagatttatgagatcataaaacacaatctttatgttctttgcttcccttttcccaaaatctaaaattattcagaaatatttaacctattcttgatttgtagccattacagctaattggaggatcctgccataaaatgatggccctctgtcatgtgttgcctacttgtttaatttagatttgtggtttcttgaaagccaactgaaagtgttttacccctcataggaaaatcctgttgcgaataagaaggattccacagatcacataccggagaggttttgcctcagctgctctcaactttgtaatcttgtgaagaagctgacaagcttgggtgagacaatgttttgctatcctccttaaagaattagaaattgccgcataagagagtatgaattgataacaagaggcattatagctaagatcaggttcataactgaaaaatttgaaatagatatgtaggtaatcaagcatttttagtgatgtatattatgtgattgccgttcaaggcaggcataaccattttcctcagtcaggaaataaataccactagccaatggggctaggatcacacctattccatataaataaaactttgaatctatcctgtctactgtttgataagcctatgcagattatcaattttatgtgttaggtttataaaactgttataatgatccaaggaataatagcagttggtggggagggtgtttttatttaagctttcattagcagacaaataaggatagcagagacttcactccagttttaattcaaaaagtattttgtgcctacatttcagaatcctggatgatttgctgctaacagcactctgaggtcctgccatggaacctcctatctagtgcagcatttgggttattgaagccctatcttttcagtgcatctatttcatttaagtttaaactgattacaatgtactggaggcaaagacctttttcttcccctccctctttttatcccccactcaacagctgattgcagagcactatgaggactgaacgacagtgggttttaattcagatatttcaaggtgagtttcatatatattaaatatcatatacgtctcctttcctctgggtcttttcaggagtagtaattttgtctgaactccaatttttcatgtttgaagctttcattttcttaaaagatttgttttgagtttaaaatgttaacagtgagattggatgagaggaaggggaagtctatattccaatatactgatatcatgtagggagagatgtaaaacaacaacaacaaaaatcccacaaattatagtaagcataatttacctggattggcctggatggccacacatgttgtccgtggattgacaatttctaaagaattgacagtttactgacggtaaacaatgaagttgtaaaggcccctctggatcgtgcaaagatgtctttaggaccatgagttatcagtgtactgaaaaattccagaagtgcctattttcagaacaaatacttgttctgaatactacaagcaccctaggtagagagactgttcttcctcagttttgcatttccaatgcgtggtgtacagaacatactttacaaatagacaccaaactaacaaacaagagagtattctaatgaataaatatatagactttattgcacttgtaggaatatgatttgatttaataaactaataggctatccccccaaatctccatttagatgaataaaaaatgtttaggattctatttaattaaaccaaatttagaagtagtgttcagtttcttgcttgggaggttttgatttattcaaaaatcatttaagtttgtccacttagtgattagcgtgtactccagtgcacccccacaactttgtcacaatactccaataatgtaatacacttaaaaataatatatttaaattatttgtcacaaatactcattctcagtttctcttgtccatgtggcagaagatactgaaatatgttccccttgacattgctcaaagaagaaatctcttaaaagttctaatcactgttaaatttctcagacattttaagctttagagaagaaaagatttaaacaactttttacatgattctttttcttgttcccttctattccctccattactcctctgtcacttccatcattctctccaagtacataaatccactctttatggtgcctgggacctcccagatccagtaaatcttcccatcctctccctctacctttcattccttcaagttttccgttcattgaagtcattctcagttctgttagttttcccagatttctccctgttctctttgtgtgtctataattcttccaagtctctacccagtttttaagttctccatctttgttgtcaccatagttttccccagttaagttttcataacagcttgttgctcagactctatgagtacttcttattttgttagttcgtctcaatgctcaaaatcattccttacctctcaatcatcccttttctctctttaataccttcatcctttccaagttttctctgcagtcttttccatatcctctgctcctaccagtttccccttgtgcctcgcagttcttcccaaattattcaagtcccttgcaggtagttggaatataactcatcacattatttccatatttaggaacaacttaaatttacaaactgccatgaataaaacagtctgtagcttaatcattgacagtttaatataatcttattctttattgcggcattatatatacaccacattttatagacctgttatttgtaccaggtttggttttaagagaacttgagatagtagaggggagatacaaaaaattaacattcaggtagtaaagccaaattaagccaaggtgaaaatttcttattcaacaagacattcagcccattcagttcaaaacaatattctgtgtactttttaaggagtggaagaaaaattgacgagtaatggaatatgctaattgaatattgatgagatttgtttccattttaaagttaaaaaaaacaaaactgattgctctaagactttttcttgctgactgccatcacctcagttgtcatattttaaccacaaatcccgtaagcacttacatttaaccttatcgttactcttatgcttattcaaattttccccatgtgatgctaatctgaaaatttcttagaggaaatgagttttgaattgctctgaagtagatgatgacctttgatgaccagagaagatgtggaaaatattatggctagagagtagatgttggctcggctgaagaggagaggtcatggattataaattaaagagaaagatatttcttagaagcagctaattgaggaccttgaatgctaggcctcagagtttagattctatagatttcgaaaggtaataaacatagtttttttgctttcagtttttgttgttgttgttatcggtttggtttggttgttatatataatgtttatcaaaataatgaatacttatttttcaacaccataaaaacgtggaagtagaccacaaaaaaagtactggttggatagataatatatttggaaatgctttgttttaaaaaaacccttttcttctgaataaaaatagagaggagaagcagttcttacgtgaaatctctctttaacagttcctcttgaaaattagcagctgtacttagtgaaaaattatgaaggtgcaatgttgttgtcagctgtaacaggttttaattatcttttttattttaaagtcatcaaatttagagatgtcaaatttttattattttcaggacaaaatcatgatgccatagttcacatattttagttgcaaatactgtttcaaaatgcacttgattttgtgaggtgtttgctttaatattttcaacacagtgctggattacagagtttcaagatatattgcacgtatccaattaaaataactccccactttccctaatttatacttgttctttaaaaatttaaatattaattaaaatcttctaataagttaacatgttccctgttttatcaaaaacattcattgttcagtttaagcgtttgaaaaccaatcataatatctatagataaatgtcactgggatgtgtctttctcaaaaatgttatgaagggttataaaattttgaaaaaaaattttattaccaaaatattaccaaacataccttgaaagctgaatataatcattcgtcttttaaaataagctttttaatctaaattacatgaaaaaaaatttgttgccaagctgggaacaattataaaatcactaactacctaaaacagagcacacagtctttaaaccttataaacataattttaaatctgaagattatatgaaatattcatttgatgaaaagacattttgacttcgcatgtggaattgtgatgtaagatcttttaaagctgtagcattgctcataattgagatccattatgcaaatgattatgtatttatgattaaaccttctttcaatcacagatggctagaacaagaaaagatcttagagataaatcccaacgctactcaccctcagtgagtaaaatgaggcacagaatgactaaatgacttgtccaaagtcacagatacctaaaggcatagttaatactagaattcaagtccagttagtttttcccacaggattagacttgtctttgtgagtgcaggatatacaaatacctttgtttattatttttttttagtttataataacaatatcaacaattacaaacacatgtaacattaatgttccaggaactgttctaagtactttacatatattaactcatttagtgcacaataacactataaggtagacacaattgttaaccctgttttacacaaagatacagagaatttaaataacttgcataaagtcacacagctagtgagtggtggatcttggatttattataaaacaagaccatctaactccatagctcatgctaggacttctttaaaaaatttaaattttttaatgccaggatagtttatatttggatataaaaacattttatgactttactttttcagtagggtataaaaacattttttagtattggaaattaatgactgtctcaatttccatatcatatacattttgcaatagctttaaatgaatggtcttgctacaatggatgtgaagccctgaatggtttatctgaaatcatcaatattgttcattaagacaattgcaaaaaaatgatctctatggagtctttcagttcattctatgtatgaaaaaatttttcatttatttttaaaactagaaaatcaaaccgaaagtatatttaaataatgtctctatgaaatgtcttctgtgagaatggtaaaatgagctatcaactaattattttttcatatacttggtaatgactatgtgaacaaaattgattttgcattttctcattaatgtggcacacaacacagaaataaaagtcctatttttttctagcttgttttagtctgtgggcttaattgctagtttgaaagtaatattaggtaatatcttactctgtaagaaagcatattttgacatgttgacgtgttaatatattgacacatgggaaaggaataagtaaatgtaaatgaaaactaattaagcaacattatatagtggatatgggaaaggtaaaaaaatatcccagcactttgggaggccaaggtgggtggatcacctgaggtcaggagtttgagaccagcctggccaacatggtgaagccccgtctctaccaaaaatacaaaaattagctgggcatgatggtgggtgcctgtaatcccagctacttggtaggctgaggcaggagaatcacttgaacccgggaggcggaggttgcagtgagccaagattgcaccactgcactccagcctgggtaatagagcaagactcagtccccacacccccccaaaaaaaatctccaatacgcaaaatgcctatataagtttgttttatgtataattatgtaataaattctgaaaattatcataaaattaaaatattagaatataagatcttccatacattgccccaatttgtttattccgttcaaatagaatggaaagacaaattaaaatggagaagggctgactcataagaaatagcaatgaattccttttcttttcattttttagggaagaaagggattgggaacaagactatatgttgtatagggaacattgaaggattctatttccatttcagtgcttaatggcttttactagttatttaacttttttctctacgtttttaaaactctcagagtctgtggcttcattaaatattatttctttataaaacatatatgataatacgaaaagtgttaaatcggtggtattcattaagactgtatccagcactgtggagaacttggaggtcaagggaaagtctgcacaaaagtagaaatatgaggaaatttgtgaactgtgttagccaatgtatattagtgctctgagcatatatttaaggaaggatgaggcaatgtggactgagggacattggagatggattaagagtgaaagggtaattggctatgttagaaaacagtggcttgcattgcatgattctgtatcacaggtacttatttatagtgtgcatgcatttctgatattgcataaagcaagacagtgatgaagttacatagttgtctattaggatatttgccctatacccttcagttttctgtttgaggtttttgaaggattcatgatttctatcatgcatcatattcttcatactatctgtataaggattatgatggtgataaatgagaagaacatggtgagtattccaaactcctatcgaccctacccaatatactaaagattatcaagtggagagttattttggtatattaccacttcataatttttatgtctcagatacagtacatttatttatatagcatatcacataggttttattgggatcatataatgttttatgaaataattctattttaagatgctatttactcataactataaaactgtgcatttttgttctctcagaggatctggaacagtgtgatttctaacttaaaatgaggggagatttgattgtttcttcttgagttaacaagttaccaatatcttaaaaatattcactgcctaatagtttcaaaatttagaatcataaaatactactcattcctaaatgattcaagaatacattttactgtactatttaattttataccttttttgtcccctgcctatgaattggatattctagccatcatttcactgtcctgggtgcaggcatagttgaaggttactgaccttctgatctagattagtactgtccaacagaactttctgtcgtaatagaaatattctaaaatctgtgctgtccagtgcttaagtccttagccttattggacaattgagcacttaaaatgtgcttagtacaactaagggattgaatttttaatctgacttaaatttaattttaacagctacacacagcaagaggtactatattggactgcacagctctagatgcttatagtctaaatataactattgtatggaaaagagagttcttttttcaaggcataatcaatcaccttcgtttctaattttgttcttgtgctatctataaatcaagtcctgatgcaaagtaatttcatcatgaagagcactggtctttattttccagggttgacaggttatataaagaattaatgtaccctgtgatcgcaatttcctagagtgagtgccagttttagcaagtgtaaaatagttgtgtttgttgtagcttcttctatgatatctattaaggagttggatatctctgaaaagaaaatataaaatatttcagcatttctaatattttctggaataggaaaatattttacatttatcagctataaagaaatcataatttaaaatgaaatactggccattttcacatattttgtactctgtgacaaactgaaatcattacagagtatgttataattctaaaaaccaaaaagtctcccaagtaataggagcctctagtacctaatcaaaagaatggtgtctttattttcttttttcgtaatctctttttctaaaccaatgtgagatcaaattacgttttttataagcagtgcaatagctaaataaaaataacaataaccgcaaatgcatgaagaatttttttttttatctgaatgtattactcacttaaaactgcattggtggactgggcacgatggctcacgcctgtaatcccagcactttgggaggctgaggccggtggatcatgaggtcaggagatcaaaaccatcctggctaatatggtgaaaccccatctctactaaaaaaaaaaatacaaaaaattagccgggcatggtggcacaagcctgtagtcccagctactcgggaggctgaggcaggagaatctcttgaacctgggaggttgcagtgagccaaaatcgcaccactgcactccagcctgggtgacagagcgagactctatctcaaaaaaaaaaaaaatgtattggtatggaaggcaatgaaagttctattttggggctgccttaatgtgagattaaccctgatcacaccacttgcatttcaactattgtttagtatgatggcatttcaattggcagttttccttacagtgatctgtctacacatgcacgcacataaatgcacacaagggcatatgttcacagtgaaacacaaagattattattttaaacatacaaataaagcatctcatgaatatttctcaattacaagttggctagtgtttgttagtccagcaagcaatactgtatccaactctgtacaggcagaacttgtatattcttgatttcccatttgatggttacttagaattgttttgaggttaatgcacttcttgatttataaataaaagtggggttgcatttcattcttcttccaatatactattatattacccctttgaaggcttgttctttacttgtggtgagaaggcatggaatatgctgaatgaaggctaatgataaatcatttttcatttcttaatgagttggagtggggtttgtggttgtcctaagtgagaaacagaaaaaaaaatttaaagaagaggaatctaaaaatattgtgaaaacatgtaggattagttaaattaatttaaatattttacttactaatagtttgaaaaactgatttcctaagaaccacttagtataatttgtagtgaaaataactacaggtgaagatcatgcataaaatatactcttaccagaaaattttaggtttttgaataaaatggaattcataaaataatgaatactccaagttattataaatcactccgattatttcttgaagtctttgctggttgttgtagtcatatattcttggaggaaaaggtttaaaacaaaagaattggtgacccgaatctccagcaagcatttctttttttttttcctttcttttttttatttttatttttatttttattttttattattatactttaagttttagggtacatgtgcacattgtgcaggttagttacatacgtatacatgtgccatgctggtgtgctgcacccactaactcgtcatctagcattaggtatatctcccaatgctatccctcccccctcccccaaccccacaacagtccccagagtgtgatgttccccttcctgtgtccatgtgatctcattgttcagttcccacctatgagtgagaatatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttctttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcatcgtagattctggatattagccctttgtcagatgagtaggttgcgaaaattttctcccatgttgtaggttgcctgttcactctgatggtagtttcttttgctgtgcagaagcactttagtttaattagatcccatttgtcaattttgtcttttgttgccattgcttttggtgttttagacatgaagtccttgcccatgcctatgtcctgaatggtaatgcctaggctttcttctagcgtttttatggttttaggtctaacgtttaagtctttaatccatcttgaattgatttttatataaggtgtaaggaagggatccagtttcagctttctacatatggctagccagttttcccagcaccatttattagatagggaatcctttccccattgcttgtttttctcaagtttgtcaaagatcagatagtcgtagatatgcggcgttatttctgagggctctgttctgttccattgatctatatctctgttttggtaccagtaccatgctgttttggttactgtagccttgtagtatagtttgaagtctggtagtgtgatgcctccagctttgttcttttggcttaggattgacttggcgatgcgggctcttttttggttccatatgaactttatagtagttttttccaattctgtgaagaaaggcattggtagcttgatggggatggcattgaatctgtaagttaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctgtgaagcaattgtgaatgggagttcactcatcatttggctctctatttgtctgttgttggtgtataagaatgcttgtgatttttgtacattgattttgtatcctgagactttgctgaagttgtttatcagcttaaggagattttgggctgagacaatggggttttctagatatacaatcatgtcatctgcaaacagggacaatttgacttcctcttttcctaattgaataccctttatttccttctcctgcctaattggcctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgagtatattgaaccagccttgcatcccagggatgaagcccacttgatcatggtggataagctttttgatgtgctgctggatttgttttgccactattttattgaggatttttgcatcaatgttcatcaaggatattggtctaaaattctcttttttggttgtgtctctgccaggctttggtatcagaatgatgctggcctcataaaatgagctagggaggattctctctttctctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgcagaggtgtttatagtattctctgatggtagtttgtattcctgtggatcggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattatgatactagggtgtcaattttggatctttcctgctttctcttgtgggcatttagtgctataaatttccctctacacactgctttgaatgcatcccagagattctggtacgttgtgtctttgttctcattggtttcaaagaacatctttatttctgccttgatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggagtggagagttctgtagatgtctattaggtccgcttggtgcagagctgagttcaattcctgggtatccttgttgactttctgtctagttgatctgtctaatgttgacagtggggtgttaaagtctcccattattaatgtgtcggagtctaagtctctttgtaggtcactcaggacttgctttatgaatctgggtgctcctgtattgggtgcatatatatttaggatagttagctcttcttgttgaattgatccctttaccattatggaatggccttctttgtctcttttgatctttgttggtttaaagtctgttttatcagagactaggattgcaatccctgcctttttttgttttccatttgcttggtagatcttcctctatccttttattttgagcctatgtgtgtctctgcacgtgggatgggcttcctgaatacagcacactgatggatcttgactctttatccaatttgccagtctgtgtcttttaattggagcatttagtccatttacatttaaagttaatagtattatgtgtgaatttgatcctgtcattatgatgttagctggttattttgcttgttagttgatgcagtttttttctagtctcgatagtctttacattttggcatgattttgcagtggctggtaccggttgttcctttccatatttagcgcttccttcagcagctcttttagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggcttgtagggtttctgccgagagatccgctgttagtctgatgggcttccctatgagggtgacccgacctttctctctggctgcccttaacattttttccttcatttcaactttgatgaatctgacaattatgtgtcttggagttgctcttctcgaggagtatctttgtggcgttctctgtatttcctgaatttgaatgttggcctaccttgctagattggggaagttctcctggataatatcctgcagagtgttttccaacttggttccattctccccatcactttcaggtacaccaatcagacgtagatttggtcttttcacatagtcccatatttcttggaggctttgcttgtttctttttattcttttttctctaaacttcccttctcacttcatttcattcatttcatcttccatcgctgataccctttcttccagttgatcgcatcggctcctgaggcttctgcattcttcacgtatttcttgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccatcttctctcagctcgtcaaagtcattctctgttcagctttgttccgttgctggtgaagagctgtgttcttttggaggaggagaggcgctctgctttttagaatttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgtcggagtaccctgcagtgtgaggtgtcagtgtgcccctgctggggggtgcctcccagttaggctgctcgggggtcaggggtcagggacccacttgaggaggcagtctgcgtgttctcagatctccaactgcatactgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttggagcttccgggctgctttgtttacctaaggaagcctgggcaatggcgggtgcccctcccccagcctcgctgccaccttgcagtttgatctcagactgctgtgctagcaatcagcgagactccgtgggcgtaggaccttccgagccaggtgcaggatataatctcgtggtgcgccgttttttaagcccgtcggaaaagcacagtattcgggtgggattgacccgattttccaggtgccgtccgtcacccctttctttgattaggaaagggaactccctgaccccttgcactttccaagtgaggcaatgcctcgccctgcttcagctcgcgcacggtgcgcgcacccactgacctgcgcccactgtgtggcactccctagtgagatgaacccagtacctcagatggaaatgcagaaatcacctgtcttctgcgtcgctcaggctgggagctgtagaccggagctgttcctattcggccatcttggctcctccctccagcaagcatttcttaagcacttactgtgtatttggtacagtgcccatgaactgctcagttaaatataatgtcttaaaattgttggtatatatttggaatgattcatttgctttgagttgagattcataatataaaatattatggatctatacagttgtttacatttaaaactgatatttatagagaataaattttatatctaaattgttatttttgaagagctcaatctttgtgtattacgtagggagttgtcttgagaaacgtctaatttttaccgctcatctttttgcactttcaaatatactaatacttttgaagcaggacccaacaggccttctctaaaattaagttttctcacatgtagcaaggttattttgaatgcccaaattgaagtttaaatggttaatattacatttatatttggagttaaaatgtattaagacacagttgaaatagtaactcattgtaagtatgaagaatattgctaaatagagaaaacattttcttatgtatttacctagatgaaagagaaaggaaaaattatacaaacactatcatttataccttatctttgtaagaacatcttgtaaatacatttgaattttctcttatagatgctattccttcctgaaaaccaggctgaacccagtacatgcttttatagtgaagtaaagaacacacaagaagtagggtttattttaacttataaatgcaaattccattttacttattttttaatgggaaaaatatttactttatttctttaacttttattttaggttcaggtatgcatgtgcgggtttgttatataggtaaactcatgccacaggagtttgctatacaaattatttcatcacccaggtactaagactagtatgcaattttttttttctgctcttctccctcctcccacgctccatgctcaattagtccctagagtctgttgttcctttttttgtgtctatcagttctcatcatttacatcccacttaaaaatgagaacattcaatatttggttttctgttcctgcattagtttgctgaggataatggcctccagttccatccatggtcttgcaaaggacatgatctccttagtttttattgctgcatagtattccatgatgtatatgtaccacattttctttattcagtctgttattgatggacatttaggttgattctatgtatttactattgtgaatagtgctgcagtgaacatttgtgtgcatgtgtctttatggtaaaatgatttatattcctctgggtagttacccagtaatgggattactggtcaaatggtagttctagttttacctctttgaggaatcactatgctgcttcccactatagttgaactaatttacactcccaccaacattgtaaaagtattctcttttgtctgcaacctcgccagcatatgttatttttgacttgttaatagtagccattctgactagtgtgagatgatatctcattgagattttgatttgcatttctctaatgatcagtgatattgagctttttttcatatgcttgctggccacatgtaagtcttcttttgaaaagtgtctcctcatgtcctttgcctacttgttcatggggttgtttttttcttgtaaacttaagttccttataaatgctggatattagacctttgtcagatgcatagttagcaaatattttctcccattctgtagactgtctgtttactctgttgatggtttgttttgctctgcagaagctcttaaatttaattagatcccatttgtcaattttgcttttgttgtgattgtttttggcatgttcatcatgaaatctttgccacttcctttgtccaggatggaattccctaggttgtcttccaaggttttatagttttgggttttatggatatttaattcattttgagttgacttttgtacatggtgtaagaaaggggtccagtttcaattgtctgcacatggctacccagatgtcccagcccgatttgttgtgtaaggagtcttttccctattgcttgttttcttcagctttgtggatgatcacgtggttataggtgtgtggccttatatctgggctctctattctgttctattcgtctatgtgtctgtttctgcaccagtaccgttactgtagccctgtagtatagtttgaagtcaggtaatgtgatgcctcatgtttcgttctttttgcttaggattgccttgactatttggggtctttttttgttccatatgaattttaacatagtttttttctacttctgtgaagagtgtcattggtagtttcatatgaataacaatctgtaaattgttttgggtagtatcccattttaatggtatttattctttctatccatgaagtagtgtttgattatacttattaatgcaaattccattttaaaaggcagaattctttttttttttttttttgagatggagtctcgctctgtcacccaggctggagtgcagtggagcgatctcagctcactgcaagctccgcctcccgggttcacgccattctcctgcctcagcctcccgcatagctgggactacaggcgcccgccaccacgcccggctaattttttgtattttttagtagagacggggtttcaccatgttagccagaatggtctcgatctcctgacctcgtgatccgcccgcttcggccaaaaggcagaattctttatcattttttctactctaagtgtatcacaactgaagattcgaaatatggcttgtgggtgtcacatttatggttcagttgtttttctattcatttattaattaatgttgtcatttttaattggttatccatttttttggttttgaggtgacacaaaacaaaaatcacagaaataatattaaaatatgtgtaaaaaactgagaactaaaaggagaaggaatattgttgaacctttaggctgaggcatctgttattaggcagttgataaaccaagtcgtaagattggttttaaaaggttgctatgtcatttttgcttagcgttctaagatgtgtagttactgattatggattgtgcaactccaaagtcgtcttaataggaagagcttcattgtctcacggggtgaatgaatgcaactattaaagtcatttctctgttccttggaacaataagttgatggatataattcattttctgacgactaatatcttaccttgatttgttttacagaccatcaacttggatcttgtttttagccatcacttccaagattctagtgctatatctcatttgctttcaactgttgattttactgcattgtaatttgataatttagaccccaacacaaaaaataaattaagtcatgctagaatatgcaccatacgtatataggggagtaatctgataaagtgctttgtgcagatattgcaattagtactgaagtttggggaggtgtgcaatcaatagtaaaatattaattggtctttctacatagataatttaaacactaatatgatagatatattactacctgttttcctgtactgttttattaattcatggaatagtgactaatagaagtattatttagccttatatataaaactcatagatataatactgttttgtgtactgttttattaattcatggaatagtgactaatggaagtactacttatccttatatataaaactcaaaataggcttttcaacaaatacccagtgaagacacaaatatatatattacacacacacacacacacacacacacacacccacaattatatatatatgaagaaaccacatttgttaacaaatgactaaaattgtcatgcctgaaccctccattattgaacatcacctctccataccccttgatctctttaattttgtgatgctataccacctccataatttcacccacgaataatagattccaagcccatcactttctgtttctttctcttttcttttgcaaacacttttcctttacacgagggacctttggttaccttcttaaaatgtgatcatctagagaatttacagaatgtgaaattaatgcctatttgataaaaaatatttaatatataaagcaatgcctacagatatgtatatatatcacatagttgttatacagattaaatgaaataactgatttgaaatcacatagagcaattcaaatactacaccaagtggaaattatcctttgaactttgatgaatttaggacttatttattatgataatctggtacttgttgacaaagtacagtaaaataattattagatactgaaacaagcaatattacattcaccctgaggcaatagaagaatgtgtgatgatagacaaacgttatatttttgccatgaagaatgagtctcttgcttgattattctgtaaagccatgtttcaaatgttccctaaatcatatatcaaaaatccagaaaaattaatatagaagagcaacctttagaatttgtcttattaagtgctatttgagcttgattattatcagattttgaaaccctgttagagaacaccacactaactgttgttggaatgctagaatgaatcagcaaacaataaacaatttggagaaggaagcagcattgatggaatccacttctcagagaagtttagacccaaatgtgaaaaattagacatgtacaataagcacagtaagcaagctgtttgtggaataaaatttaacaaaccagtcttataattactgtgccttattaaattttttattttgacatctcaagtttcagaatacacaggaaataattacataaaattggacagccaatgcccttgcccgcctctgcttgctgtggtcagttcctctgaaaatactaggtttatcggttgctccaatttgtctttctcccaatgtggttacttttattgcaatgttctagattcctgtcaacctcaagaactaccttattgtttacccaggctgtgaaagaagctttgcttgtatttgagaccaagaacacaacagtagtgaccacctaatatattatggctgttaaatggtgtatttttgacttaatgaatcattgaaataattggaatgatgagatttaagtggagttaggataatgggcagcagatagatatttcttatcttcatgtaatacttaaatttgtactattgtagaaattgtacaaaaattgtagcatataaaccattcactcatgtgtttgttgttctagcatatgattcagtaattcacatagaattcatttaaatatattacaaatgaaaccagcactataatgaagaaaaaatttaaaaaatatcaaggaaattatgccttgaaattcttctgacaaagcatttgaacattaattgtgtggtttgaaatttctagaattgcatatagtagatgcctagctcccttacctactcagagatgataaaatgaacttccatttttgctttatacatctttaaattttcagagatgcttattttatttctgcttttgctttctctaattgtcattattgtgtccctctaaatacaactattgcttacccaactgtgatgtcttgctgataaagggcatcacttaaatagcatgggcactactggaacttgtcaaaaattttagttctttatatcttcttttgtgttgtttcctttatcaatttccaaactaacattaatctatagtaggagtgggttgtaggagaagggcaaagaaatttaaggttaccttgtcacatttttcatgagacagaaaaattagaatgtaatttacatacattaagatacgtatgtaggcatattttccctggatatctgagttaaatgtgccatgcttccataagactaagcagtgattatttatatccgtatttagtagctaaatttctgtactgttcattcaaagaattaaactcagcattttcaaagaaaacttaataaattttaaagataataaattttcaagtggcaaatgtgagagttgaaatcaaaatctggagattgaggttacttaaacatgcatgttcacatcctggtagaagcagagatgagttcattatacagtaattgaacactgaattaaagacatactagaatatattatcaaatataaactctgttttgttcactgatgtaccttcagtgtctagaactgtgcttgacatataaaaattgcttaataagtatttgttgaataagtggctaaacctccatgagttcatttcatctcaaactctttattaactagagggtgaatattccttctaggttggcaacatatatattcacttaagctttagaaatggtattttttctcaatatttcttccccgtttttaaaaccactgaatgaatttccagttatgaaacacattttaaaatgttttatatgatgatggtattgtggaagacagtgtggcaattcctcaaggatctagaactagaaataccatttgacccagccatcccattactgggtatatacccaaaggattataaatcatgctgctataaagacacacgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttttaaggacaaggatgaagctggaaaccatcattctcagcaaactattgcaaggacagaaaaccaaacaccacatattctcactcataggtgggaattgaacaatgagaacacttggacacagggtggggaacatcacacatcggggcctgttgtggggtggggggaggggggaagggtagcattaggagatatacctaatgttaaatgacgagttaatgggtgcagcacaccaacatggcacatgtatacatatgtaacaaacctgcatgttgtgcacatgtaccctagaacttaaagtataattaaaaaaattaaaaataaagatagagtagaacagatttagaatggattgagggagggtgacttcttggaactagatcgctctattaattatgttgtgtagagatattgcgacatgcatgcaatgcttttatttctttagtttgctttattttgtttttcattttggggggttatcccaggaattcaaggttgttttatcttatttttttttaatttaacttttattctgagttcaggggtacaagtgtaggtttatgtaagtaaacctgtgtcatgggggtttgttgtacagattatttcgtcacccaggtattaagcctagtacccattaatttttcctgatcctctccctcctcccatcttccaacctccaataggccccagtgtgtgttgttcccctgtatatgtccatgagttctcatcatttagctcccacttataagtcagaatatcctgcaatgtttttaaaaacagtctgtagtattcttctgccagttgtaataatgtgtaatacctaagggtaagataagaatagagcgataattttaattccaattgtcactgccccatttttatttctgcttatgtttgcatgacatttataaaatcacataaacatccaaaacttcttagatatgctagattcacagcatatagaatacatatatgtgtgcatattagctggtagtatcaatggggtatttttaatctcaccttcataacagagtataaaaccaaaaattcacaagactgaattttgagcgagtttttatattatgtaatcccaatgcacatcattgtacaaatgatgctaaaaatactataccacaggcaacagtgtttttgtgttgtttactaggataaataatgtcttcagctctagcattactcactatcataactaacatattttatgtatgataccaactgcttaacataggaaagtcattgaattcatagtatatatttttaaaatgttgtgataaaaattaatgagatattttaagtctactcctgacctaaactatcttgattgttgcaacagatgcatttatttgattattgattgtaaataggaagatttctttttttccaattttgtgtattccaacattggcatatgcatagtttaaaaaatgcggatgtgcagctatgcaatgggacagttatttcatataacacattgcttggcataaccagagcacaatatccataacaagttatttatatcatatgtagtcctcctgtttttagaacaattactaaaacttgttgatgttatcgattaccaataaatattgagaaattccttaactggatacctatatgcattaatacatttctggaatggaattttaaataaccatctgaccactgagttttcaaaactgctaaataccttaatagttgcattaaccttcatttaattataaaagtatgacatctgataggctttagctcagtgtgatacaaatttaattttgtttatataatatatcatctacaaatactatccagaagaagcacattagaatgtttaattatactagagattaaaagatatttaatatataaacttgagaataaataaaatagagaataagaattgagaattacgaaaggaaactgaagataaaatttgcagattttaagaaaatcaaaattcctcattgaattttgtcagaagagttcaagaactgaaataattttaaagctttcagtgagtgaaaaataatagggagaagtagcaagagagattgatttttgactcactttcaactcggtactgtttttaaatgcctttcttattttcaagcccttctcaagctgttccttgaagttgtataattcctgttagtctatagatgtgaaaacccatttttatatgaactaccttctgcgttctataaacataaattctcagggttgggatgtcttctagtctaactctcccattgaatgtttggacgtcatctaccaaatccatatatctaaagcaaatatagtagatctaatctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaaggtgcgttttaaaatcactttgttaaagatatcatctcattttttaaagagtaaaataaaatgatattaatgtatttcaaattttgagtaagccatcaccccaatttttcaaaatttatgtaatttaaagcatagtggagaaaattcatcaatgcagtttttgcaattacaggtggattatgaattttcatggtatgtatattcattttcaaacagctgtgtttccattaatctataaagggatcagacaaggtcagccctgctacttacaaatcagtagtttgcccagcttcattcttttaatctgtccagtcatgcttctgccaaaaacttgatataagcaaatcattaagaatgaatccataaatctgattatcaatttttcctagtgattactttagatacacaaattttatcttgccatttgatatggtgccaaataaatctatttgagaggtgactagaacaatttaatttattactagcatttctgaacatatatagataaatatttttcatgaggatttcaaggtaaggcaaggtctttagcatatcctgtatcatcaaattgagattaaattttagtcaatattctgttaatgttaaatattttcatttttttacaattatttgaaaacagagtgttcatttgttgtaaagggtaagtaagccttttaacaaaaaagagtcaatcagttaatttgaataacctactctggcttgatttgggtcttaggatggagaagttagagagaagaatagatagaatatttggtattcttcaaaatatgtgcagaggggccacatttatcaagttaatgatcaattcttttaaattacttatatgatataaagagaaatagataactcagatttgggtatgtgaaatagtacaatgcacttgaatgatcttggaaaatatatgttaatgaaataactaatgtgcatgtttcagatagatatgttcaggggattttcacacttttataaatattctgccaaactatgatctatataataactagtgttaaaaatatgccccaaaacatataaataagacattctgatatatatcatctgaaggttttgacctggaggatatataatatgggaaaatttctcaactaatgctgatctattgtaaagatatatttatttataaattcattcaggaatggaaggctacaaacctcttgagcaaatttcagtgaaatgcagatatgtttgagtatatgaagtgaaaacagaaagagaaggatttggaaagaagggaactcttgaatactgttggtgggaatgtaaattagtacaaccactaaggagaacagtttcgaggttcctcaaaaaaactaaaatttagatgatttttaagtgagcactttggggtgaagttcctgcaatgacatctccttatctgatgaaatggaaaaatattcaggagtcagatagatatggatcacagttttatgcttacctcttaccagacatgctactttcagcttaatctttttgacctttaatttcttcagtcataatatgaggatgataattatcacaggggcagaattgggaagaataagcacttagtatggagtagacatacctgcatagaagatttttgaacatgctttaagacatttaagtacttatagaagtgtgaggcttatcacttgacataataaattgagtaacagagtggacagtctctctctaaagcaacacttcacaacagaattttctgcaaggacggtaatctgtgtgagaacaatgcagtagccaccagtcacacgtagctgtagagtccttgaaagtacttagtagctagtgctactaaggaactaaatgcttaattaattccattttaattttaatagccacatgtggttagtggctatcatactgcacagcacagcctaaacaaataaaaaacgtttatttggacaatacaaattaatagataaaatcaaaatgagaccttaccaagtttaaatcagatattagcaatagggtctcttcaactgaccatcttgacaaatgtgttgttttaaaacgtagtgctttattcaaagaataattttgtcgtgtctcccttagggcagcttaatgaacttccaagaaatttctgatttgtcttgaaagctgcttaactaattcaaataaaacaaataagcctgctggcataattttagctttgttaaaatgtgctttcatttgacattctttgaaagattgtcagcaaatgacaaaaagtctcactacaggttcttagatgagtcttagaaatgctctaaaatttctttctgttttagaatgtgtgataagcctaaagtaactatatgatgtgcctaaagtactggggcatttgtgtggccccgtggacaaatactgttttgactgcttgttaaaaataatgagaatggaacacaaagcatagccccaggcatgcagagggccatgacatgggcgactttaactgaatgcactttgactcgcaaaaaggccctgtcatgaaagtggcatatatgctatgggaaaggagacttaaagaaaaacagagaaaagaagcatgtgttgattcatccataaactttagtaaattttacaatgtgaaataagtaggccaaccataataatttcttttaaaaatccctttgtcctgcagaataggatgagaatttaattaatattaatttgctctacttttgttgaatagacaagaatagaaaaatcaccatttatcctaactaggctaatataaaatgtatatgaatagttcaaatagcaaagggagagaagggagaaatatagagaaaaattctaggaaaaaagctcaatttaaatatttaaataggtcaatttatacatgaaggtgtcctactatttactatttgatattaattaactgaaattaaaggcattggtggaaaatatttattaaatgtttaaaatgtatgtagtataaaatttcataagacttaaaacttagaatatttatttctaaaactaatatatacatatattaatttagcttacgtttttatgagtttcagtataccttggcacaaacagggaaagtattatttcacattttaaatatttggaaaatgagtttcagagtgataatgtattatgcttatcatcatatgactggtaaatgatagaggtaggaaccagagtgcagttcctgactcctaatcaacagacagattgtagatggatagataaccttcagagcaggatcactgcaagttcatgatacaaaacgaaaagagtgaaagaaagaaaaaagactgggcacagtagctcacacctgtaatcccagcactttgggaggctgaggcgggtggattacttgaggttaggagttcgagaccagcctggccaacacagtgaaaccccgtctctactaaaaaaatacaaaaaaaaaaaaaaaaattagccaagcatggtggcgggaggctgaggcaggagaatcacttgaattcgggaggcagaggttgcagtgaatcgagattgcgccattgcaatccagcccaggtaacagtgaaagactgtctccaaaaaaaataaataaataaaattaaaaaaattaaaaagggaaaaagtgggggaatgaagtgattaccaagtaattctgcttgtttaaaaaataagtaaaaataaaacttatttatgtgactttgatgcgattaattttcaactttttaatggatcatgttactctttaaagaaaaaaaatcatctataagagttcttgatgttattaatagttaccacttaaaaaagaatccagatttgaaagcttctcttttctctctttcaagtaaaatcatactgcaatgctaattccctatatacatatagctatttacatactcacacacatcgtactacacattgcagtatttcgaagaactgttgttcaggagtaggaaatcacagatctctttaactttcactttttaattcagatggcctgttatttataaagctttttaaaatattgtaagtattttttgacagggaagccaacattttcacaaatagaaacatccctcaagcacccagtctgactcagaatatgtatataaaccacagggacttccttcttttctcatggtaggaactcaggggaaattagtttatataatgatgttacagttatttttattttctgcttcaaatttccatcttccctggcatatatcaacagtcacatttctgtactagcccagtgacagtgtgctgattgatttccttaaggcaggcatgacagtgtttcaaaggttgacaatttttgttgacagaacatgaagatcaactttttctcaggttagtgatcctactcaaggccttcccttgtttctacccatcccataaggcatcctcatcttttccatgaatctcaaaagatcatttaaactggggtagtcttttaacatagtcaagatgtttgggcccttgtttctattttaagtaaacatcttccccattgatcaagagctggactggatttatgaaactaaggttagaattagatttgttttgcgatctggggttagaaaatctaaattgtgaaaaatctcacctaccacaagatttagaaatcttgatttaaattgccaagaatgagacatcaaataatacattgtgaagacaaagagcaagcaaactttgttgttctgaagaaattaatattttttaacattatgtaaccataactcaaagtgatgtgtaacattagaagtgagtaaagattcattgatgtcagtgcagagagaatatactataacaatgagtataacaattttagaaaacttacttagtttatttgcctccaagaggctcagaagagtttgaatataatgatttcctcattttttcaaatataaaatgaagtttcacttaaaatttctccatttcagctttaagattacttgattttatagtctctgaattctataatttgcatattaatatttttgatctaatgttaaaaagcaaaagagatgacaatcaaatgctaacgactatgaggtttctgaaagctggggttattatcaaagtacacttccactggggaaaaaatgacaacataaaactcattgtcttcataaatgaatctttattaatgctgtcaggtcttaacaaatgagagtgtgacactaataggattaagtaacttttgacttcattactattatcagagtcttggttagtgttcatcgtccactaatgccttttgttaaatacatctgttattaaaaatcccacagtatggatggacacttatggaacgtaagttggacatcgtaaatagttcaattctggaatttataaattgaggctctgaagaacaaatgtgttcccaaatctgagtgatctactcacatcatgcctcttaacttaatattaccaactaactataagaagcaccactaaattttatgttattagatacagatgtattgatctgttatttcattgtccactgtatctaaataaaaataaatttgaacttaatattattcttgccaaaggaaatgacttaaatcctaaaataaaaacatatttttataagacaaaattaattggtatagaattatttaatgaaaacatgaggttgtattacacagatctaattgtctttaacaattttgatcaatgctaataatctaagattataaatatcccaatgtgggtagttttcttggcataaattattctttttgtctacactgatttatattgattatataacaacactgctgtggagacactctcttagtgaactgaagtgtgatctttcaatcttagataaaataaattgatggattggtaagatttctgtatcagaggtgatgacaccttgtatgagaagtgatgataaaagcaataaggtcattctgcagaaaactttctgagtttgtttgagttttatctataaaataatgtatctatcttcatgattttaccagggtatgagtttggaccagtttttgatggaattggtctttagcaaaaactataaagtgcagatgaaaactaattctcacttaaaaatcaaatactgaagaaattaatattctcccttttgtatttatcagtgtacagtcatcttcacaaaactaatcaagaatgaataattaaataatctagtagcctaatagaccaaataaattgctttgaccacaaattaaattttagcagattgttgttcaagtgtctttcaatttcccagtgcaggtagatgtcactggaggaaggaaaatattgagtctaatttaattaaataacgcagaacttaattttcttaattatttttgaaatgtccttttttcattggtcttttgcttgcacaaattatatcttcaccaatctattctacaaataggtaataaagtgttttatccataaaatgttaaatatctattactagagcactaagggcatcaaaatagaatacatgtggacacacactttttagcaattaaaactataaaaatatcgctagttatctattttgtatttcctttgaaatagaagaggtacttctaggtgaacaatcataagaaacctattgcttattctttatacattggaagagtatttagtggtagcatgttttaattgctgcatgcacatatctctatacttgctggtaaactgaggaaagtagtataacgtcatatataggaaacatattttaaaagacatattttgcaaagtaagtgtgaattttgtttcattaagcaaaacaaaggattttaaaagttgaaaatcataaaatgaagttttggattttctaacctaatttacatttgtctttgcgatctcacttaatctggaattttattttatgtagagtattatcatgaatatttctcatccttttacttattttatatatagaatttcattattttaagcttcttcaatacaatgaagtgaaattctaaagaatgaaaggctgttctattaaattttgtctagatgtaacaactgactgctaactaatatcttagtctaattccagtaatctaaatttaacacatatttaatgagtgctcaatgtacaaagtcttgagggataaaaaatgtgtttggaaaacagtcagtgtccccaaggagattaataacaggcattatcaggattatatttttgctctaatgatagtaaagaggaaagaatatttattttatatatacatacatacttatgtgtgtgtgtgtgtgtgtgtgtgtgtgtgtgtgtgtgtatcttttttctttctttttctttgtgagacacagccttgctctgtcgcccaggctagagtgcagtggcacgatctcggcttactgcaacctccacctcctgagttcaattgattctcctaccttagcctcccgagtagctgggactacagacgtctgccacaaagcttggctaattttgttgttgttattgtatttttagtagagacagggtttcaccattttggccaggggctcaaactcctgacctccagtgatcctcctgcctcggcctcctgaaatgtcatggttacaggcatgagccatcacacttggccatatttattatgttataagaacattttatcttaaattaatcatgctgccattaagaaaatggaattatttaaagttttattgtctcagaaaagttaaaattttatatctatttttagtagatttttaccaagcactctcattaacttatgatatcttattttgttactaggtttgcaattatggcagttaatactttttgccaacatttatctgcacaatcattttgagactggaaataaaaccttttgatgacaatggtaattcttgtgctagttgtggtaattacctaagtctttctattatcttaattctcaaacttgttatctgtgcctacaattcctctcctatataatagagaaaattaaaattatccttatgtagcatgcagggatattataaaagctaatgatgtaagtaaaatctataaagtttgctgagtaccctgaagaaaactgttctgtaaacaatagttatgggttttactctgtaggttgaggttaattacagtctttcacaatttttctaagagttgatgcttcatactccttaaaaagcctattttacgacttaaacttagttttccatacatgttttatgtatgtatacagagaaaaatatgacaacattaatctatttcttgatcagtgccactggctctacatttttttctggacctagttcagtttttgttttgttttgttttgttttaagtcttccacttaccctctttggcttatctcttgaatcaaatgtctcctcttcatttgtctttgtctcctcgtggccctccatatgacagtgatactgctaatatgagtactttctcatatactgcctctaccatctggaattgctttatttacatctcattcatatgcccttatttttttaaaaaagatttcctctcttgtcttttgttttttcaagctgagaacttattttcctatcccctttctaagacaatcacgactgttttttttttccagtagattttgtagaacaggtgtgtaataacatacttgaacttttttatttttaattattctaaattaaataggtcttaaaatatcctttttcaagcagaagatttgctataacaagcctttcctggatgctagtatgtttttctggcttataagagagccaagatatcctctgaggacaagagttgtttagaagaattcatttaaaatagtttgaccagggaaatatagcagaataaacagcctgcatcctaaggacagtggaacaaggggagcattgctgtcagtaatgcaaataacaaagtaaatggttaacagaagaacgaagttgtgttctagataatcatatactgcctctacggtctggatgcatgaattctagagaaacaatttaatggactataaataaattaagaagtttaagactttatggattacttttagttgaacagagtgctttatttaagtcactgaatgattatatggatgaattttagattgcgtatagatatcaaaaagccaaagaatatgatcatgcttagttacaaactaatgcatattcaattaactcattaaactaccttcaataaataagtaaatataaaatgaaggctacttacattgtttgaatacacaatataataagattctgatgctgattatttgattttgtgtttagtggtttcatactgctttggcttggaggatgtaagtatttaacagatcctgtgtgtttcaggaggcatttaaatcttttaattttgctgtgaggaaagttattcctaagggatcagtcacagatagctatattacccccatcaaatgcatcattttcctagattccaaaccctatgtagaaatctccaagttgaagaagtaacaatgaccatgctatcaatgtttaatcctttggaaaccatagtaatggtataggaatgcacctttttaactagaagtactcatgggcctggaaaagtgaagatgacctcattggggaatggatatatggccctaaattggaaagtcattggctggcttctgtataggctatttatagcccatttattcatctgcagcttttaagattctaaacatttctctataatctattttccctatagttagaggttaattatactctgtttatctatatgtttaagatcaattacctaactgctaaaatgaaagcattttcatatagctagagctctcacacagaaaactagtttacgtgtaaggtaaccagtttaataaaactgataatctctttagctcttagaaattggattttaattatttatctaatagacaagacttcttaagctatattttctactcaaatatactaatggaaatgtaagtaatttaaaatttttctccaactgttttgtggatgttttgtaaattgtaatctcattgtaactatgtctggtgttctacaatctagactataaaggtgtgaagcaaaaaaaaaatgatttctttctgaaataatgttttacattactattttacaccacaaaatagtgactggccttattttaggtattgattaatgtaaaaaatggcattttacccaataaccttcctgttattaccaggcaactatggaatttagtgacacaattatttttgtttctttttttcatcttaaggaacaagttcttaattagattagatacagctataagtaaacataaactatgttcttatgtaacctcaagagttattttaggccgggcgcggtggctcatgcctgtaatcacagcactttcggaggccgtggcgggcggatcacgaggtcaggagattgagaccatcctggctaacatggtgaaaccaagtctctactaaaaatacaaaaaaattagccgggcgtggtcgcgggctcctgtagtcccagctactccggaggctgaggcaggagaacagcgtgaacccgggaggcggagcttgaagtgagcccagatcgcgccactgcactccagcctgggcgacagagtaagactccatctcaaaaaaaaaaaaaagaaaaaagttattttaaagtgtctccatgccttgttacacagttcattgacaattgtttaatctgttgctgctgttaagtttccttaaatttgtgattatttcaatgagttagtgatagtttattcacccatatttgtggtgcattgccacaaggaattattgacacttctttttactgacaacagcttttttgttttgtgtttacagtgtgatgttgagagttttgttgtttcctcacaaataactgactgcataactctatgctttcctacatggttagcaattgctatttcatgaataattggatttgctttcctagttgcagttatcagtcggtgcttcttaaaaagatagctgtttattttgatgactgcttaggcaatatttattattaagtattgctttctcaaatgatttttcacagaggcagtggacaaatggtttgacctgtacagtgtacagtgtacaaagattcattttgtagcttaaagaatgaattatctttgtgtcctttgtgtgtgtgtgtgtgtgtgtattatagagacagggtctcacagtgttgcccaggctggagtgtagtggctttgcacaggcacaatcatggcatgctacagccttgaactcctgggctcaatcaattcccctgcctcagcctccttagaagctgagactacaggctagcactaccaggcccaacgttttttgtacattttttaatatgtattttatcctcttatgaatttttgttatctatttgccctgtataatattaggatgggtatatcatttatcctccaaattaagattaaacagggacattaaattaaattaaacagggacaaccagaatatatagtcacaatatttaaaaccccaaatttctacagtaattccttcttttccattttacatccttcttctgaaggtctcgtctaccttgagccagagagctgccatcttctgcaaaacatcattggggtcaactattacttgcacaaacttgaacttcactctgttttaatttagcagagcgactctcaggctgacttggttctgttggcaaaagactagcttctgaagaattgtctaacagcagaaacgctgtcatcaagcttacatagggtgaatttttttctgagctggcattgttcatctaatgtagtgttttctaaagctaaattttacacacacaaaaaaaacagacatggaaaacaggcataattgcatttagaattatgttacttttggacataagatttctatttcctttgatattattcaaataggtgaagactatgtcgtttgcttctatgcactgatccacaaaatgtaggaggtattaaatgtcttgccaagttactaaacaagtaaagttttcagaagctcaatgtgtgaccgagtttctccttttctacacatatttccctaaatagccatttgtctacaggccatgtgagtatagcctgaagacaggatgagatacagagccacttaagcagctttccaaaatgaggttttagattgtggagccaaagctctgagtggtttttgtaagagaggaattttttttttgttttttttttttcttgagacagagtctcgctgttgcccaggctgaagtgcaatgatgcgatctcggctcactgcagactccgccccatgggggttcactctattctcctgccccagcctcccgagtagctgggactacaggcacattctttatgactgtatctccatggacatattcttcataaatatttagaacagcttatactgtcttctattatactggcttgaagataattgataccattgatgcaggatcaagtgttgtctgtctttgttcatctacattacaaaacatggtgtcaccaataatctaattatttttgttatactttcctgtgttactggtttgaagataatcgataccattgatttgggatcaaatttgtattttgctgtttgtctccattcatcaacaatacaaaatgtgctgtcacccataatagtttatttttgcatcatatgttttggatttctacattcatttgcctgaatttttcactcagggttttggatattatatatttcatatgcagcatgtatcatttgatggtgacttaaatgcctgtatcctattataacagaactaatcacttttctaaagataagtataagtttggtccacaaaaaaatttctacgtacattgactcattgaacctgctacgatgaagacttctactttacaattcaactatgcatatcaggattactgatttctttatatgacattacttatgaaaagaagtaattttatgaattactaaacactttccaagtatgtttattttgaaacttgcctttaattaatagagatagcttgaatatttagcatagtccctaataaaaataattgaattaaatttaagtatctagtcaatagaattaatagcaattgctataaacctaaataattatggtgataataaaaatcaagttaaatacaagatgtggtatagagttcagttagcttaataatctaatgttttactagtccacattcaattttagagtaatgatgttgaaaatgcaaattacttattattaggttccttaactttactatttacttactttttagtttttttaaagttttattttaggtttaggagtacatgtgcaggtttgttatataggtaaactcctgtcttgggggtttattgtacagattaattcatcacccaggtactaagacaggtaagtacccaatagttatttttttctgctcttctctctcctctcaccctccaccctaaagtaggcccaatatctgttgttcccttctttgtgtccatgagttatctttatattaattatttttatttcactacttggcagtttgccaaatcagaaacttgattttgataagagaaaaatgtctatttcagaagttaaaaatccgtatttaccaaatgtttaccagtctactatcattgatagggttcactatatttcaatatatatatcccagtgttgtcaaatttttgaggtattgtgattttattagtgtttgataatgaaaacataacttcaaagtctattacctgagcattgctttaatatccaggattctttgtacatgccattatgttcctgaaagtacatttagcataatatgtatagctaatttatttgaaaacatagccaattcttcattattcagaagttaataatcaaatttcatgaatcatatccctccccactacatcctactacatttcattttccttcaaaatactttaaaaatacttcctagaaattatctactttagcaaatgcatttcaagattctcagaaaatattttttaatagtccagaattattcataggattagataagctcaaatctccattagatgttcttttctgttattagtaaactcccctctttagtttagttcagtgttgtagcacccttattcttggtttctattacatttagagtatcttacaaggagcagcatctgttactcttctaagagattaagtcaaaccaaataggtgtgtctatttagaataatagggatttttaagagaattataattggatcttgtaggtgtcacaaacctcagtgtaataggcatcattgataagagattcctcttttaactgtttattttggcattgctacattcgttttgaagattttcttggtagccttgcatacattttaaaccatttttcttacaattagatgctgtgataacatatagaggctgtggatacctacaattttaacttctgctttgattcccagaaggaaagtataaatattatactggctctgatatattagaactttacattaatttttagacaagataaaaagtatttttaaaatattttctaccatattgctcaattatcatccttttatcatagcaacttatcaatgttacaaaacgtttttgtgggcattatagtttggaactcaattttgagaacattgtcttaaaaatcttatcaagatatgactttccaaatacaacatttgtattacaattagatgtataccttgttcttttttcacttttaaattaaaacatgtggctgctcacggattgaaaacaggtttacctatatatgtccttaccaattggtaagcattattcaaagtagatcataaaaaggagacaaaagccttgatattcccaattaaaaagatttaaactaaaaactccttctgctaactgtatactgttgaagcatttattgtataacccttaactgtcaagaactgccacatcttttgatatttgtgacagctattttaggagaataagggagatgcaatgttataataggtaagggatgaagatcagcttcctggtagattacaaagtagtgataattctgctttcatcctattgtgttttttttctgcactatagattgaattacatattattgctcaatgtgatgctgattaattaagatgtagggagctgtggaaaattatccatattttgtcataaacatgtttactgactgtacatcagaaaatcactaaataatgcatgaaattataaaaattacattaaaatattaaaattacctgtaaaacctaggtatttaaaccactgtagtttttcatatgatattgtcagatcaaatacacttgccactttcatttaagaaataattaccaatattagatgtaacttaaacataaaataaaaagagttggacatttattcatatcaaataaatagactaatgtcttctatggatacgtactcttttccatatttttagttgttcttcttccatttttaatttttatgagtacatagtaggtgtacgtatttgtggggtacatgagatattttgatgcagtcatacaatgtgtaataatcacatcagggtaaatggggtgtcctcagttctttgtcacctgtggttttagctctgattaagaacttgtcttggaacctaagtcaaagtttgattttaaatttttcgttgaaattgacaggtcggctgaggaaatgaagatttctccagttctgtagtcaggtggtctgatcgttagactaattggatttacataaacccaagtattatattttacatatgcattgatttttatcacctctattttcaagctgttgtataaatgttgcagctttcaggccctacttccattggtaacaaatagaaactggtttgctgctattctgtcctggcatacaaataatctaagtcaaaagctttgcttttcatgtttttctaggatagtgagaggaaaaaaaaaatttctcctactcaaagcatttatttcatttctattttcataaaattaggaattctttttttttttttttcttttttgagacggagtttcactcttgttgcccaggctggagtgcaatggcacgatctcggctcactacaacctccgcctcccgggttcaagcaattctcctgccttagcctcctgagtagctgggcttacaggcgcccaccaccgcactcagctaatttcttgtatttttagtagagacggggtttcaccatgttggccaggctggtctagaacttctgacctcaggtgatcctcccgcctcggcctcccaaagtgctgggattacaggcatgagctaccatgcccagcccaaaattaggtattatttgttaatgacttacgggtttttaattagccacaagatacgaaagtctaaacaaaagtatgttttgttatagtcagtttaatgccctaaaaaaatgatgtttgcacaaatgattctaatgcacaaatgttattagtttctatacatttatattttctcagagtcttttctgattatttgctggaccctacatttataattccatttatgccgatttcagagtaaaatttctattggggtacaatttagtctttttcttctaggattgcaattttcattgtgttggcctagggcttctcaaccttggcattattgacatttgaagctagataattcttccttgtggggtggtgtgagagctgtcttatgcactgcaggaagtttggcagcatctctggcctctaccaaatagatcttagtggcactctcttgcccaattgtgacaagcaaaaatgtctccagagtttgacaaatgttttctcgggttgcggtgggggccccaggaatttcaacaatagaaaaccattgctttagctcacccttacacatattcataagagaggattttgtattttatagaaagattttattaactccaaaaaggagtcagacttgaaaaccttcaaaaaccttcaaatgatgagcattctcagataaaatatttcagaaatgttgaaacaataaatgctatttgaataacacatactttagtggtcataggtgaaatagtattaggacatatatcaagtcctttgataaaaagatattttatgaagtaatagtgccttttaacaaattcataatatgttataatttatcgtaaatgtagaagttactttcttatctgtgtgactgaaggggaacacagtgctaaatgataaaacagagtagcctgaggtggttttcttctaatttcaggtcagatttacatttcactaattgcacaaaagtttttcaatattaattttgttttatatatacagaaaacatatttattattagcactagcaaaatcttatgtaatgaacccacttcataaatagaatatttatgttaatcaaatatgaatgttttgccaacctaatttcaaatcttaacataaaaaattggaatgagaaaattgatacatatgagtatattggtatatgtattataaatgattcaacctcagctagtaaaggaagttttattattttcaatagtaaaatcattatttttctaatttgatttcatagttatgtaagaattattagcaattttaaaataataaactttgagcgaaactatttcctgattgttaatggataagaaaaagataaaaattgacatctagaattaggcaaaggaaaaactaatggaagattcaatatatgaatgagacacaaaagttgatagtggtgtgtgatagaactaattacaagcgttttttaagcgaatatttttagttatagatttatttatgaaaaattgttcttagctcttgaattttatagtgtttttaaatttttaatgtatttacttttttcttttttcttttttctttttaatttttgttagtacatcataggtgtatatattcatggggtacatgaaatactttgatacagacatgcaattgtcatgatcacatcgtggtaaatgggacatccattccctcaagcatttatcctttgtgttacacacaatccaatgatacttttagttattttaaaatatatgattaaattattattgactgtagccaccctgttgtgttagcaaacgctaggtcttattcattctttcttttttggtacccattaatcatccctacctcccctgcctaccaacaacccttgctagcctctggtaaccaccttctactctctgtcttcatgagttcaattgctgaaatttttagctcccacaaatatgtgagaacgtgtgaagtttctctttctgtgcctggcctacttcaattaacataatgatccatccatccatgttgttgcaaatgacaggctctcattctcttttctgaatagtactccattttgtatatgtaccagatttcctttacccattcatctgttgatgaacacttcagttgcttccaaatcttggctactgtgaatagtgctgcaaaaaagcctgggagtgcagatatcactttgatatacttatctcctttcttttgtgcgtatacccagcaatgggattgctggattgtaatggtagctcaattcttagttttttgaggaacctccaaactgttctccaagtgattgtactaatttacattcccacaaacactgtacaaggattcccttttctccacatcgttgccaacatttgttaccacccgtcttttagataaaagccagggggtgagataatatcttattgtagttttgatttgcatttctctgatgattaattatgtcaaacatcttttcatatgcctgtttgccatttgtatatcttatttcgagaaatgcctattcaaatcttttgcccattttttattacaatattagatttctttttctctagagtgatttgagctctccatatattcagattattaatcctttgtcagatgggtagtttgcaatattttctcccattctgtgggttgtctcttcactttgtttttgattgtgtcctttgctgtgcagaagctttgtaacttgatgtgatcccatttgcccatttttgctttggttgcctgtgcttgtgaggtattgctcaagaaatctttgcccagaccaacatcctggagattgtttccaatgttttcttgtatggtataatagcttgagatcttaaatttaagtatttactccaatttgatttgatttttctatatggtgagagataggggtttaatttcattcatctgcatgtggatatcaggtttttccagcaccatttattgaagagattgtattttccccaatgtatgtttttggcaaccttgtcaaacattatttcactgtagtagtgaggatttgtttctgggttatctgttctgttccattggtatatgtgtctgttcttaagccaataccatgctatttggttactatagctctgtagtataatttgaagtcaggtaatgtgattccttcagttttgttctttttgctcaggatagctttgtctatactgggttttttgtgtggttctatacaaatctgaggattttttttctatttctgtgaagaatatcattggaatttttattgggattgcattgaacctgtagattgctttaggtagtatggacattttaacaattttgattcttctaatctatgaacatggaatattttttcccttttttggtgccctcttcaattgctttcatcagtgtttcatagttttcgtgattgagattttttacttctttggataagttaattcctaggtatttaattttttgtgtggctattataaatggaaataatttttaaattctttgtcacattggtcgctgttggcatatagaagtggtattgatttttgtatgttgattttggatcctgcatctttactgaaattgtttatcatttctaatagttttcttgtggagtctttagttttttccaaatataagaccatattatctgtaaacaatgataatttgaattcttcctttccaatttggataacctttatatctttctcttatctgatggctctagctaggactaccagtactatgttgaataatagtggtgacagggggcatccttgtcatgttccagatcttagagggaagaatttccatttttccacatttagtatgatactagctgtggatctttcatatgtgactttaattgtgtttagatatgttccttctatccccagttttttgagagtttttgtcatgaagggatgttgaattttataaaatgctttttcagcatcaattgaaatgatcatatggtttttatccttcattctattgatgatatctcacattgatttgcatatgttgaaccatccttgtttaccaggggtacatcccacttggttatgatgaatgatctttctaatgtattgttgaatttggtttgctagtatttttgttgaggatttttgcattaatagtcatcagagatatttgcttgtagttttctctttttattatcatttttaagttccagggtacatgtgcaggatgtgcagttcattacataggtaaatgtgtgccgtggtgatttgctgcacctatcaacccatcatgtaggtattaaacacagcatgcattagctagttagctgatgctctccttccctaactggcctcagtgtgtggtgttcccctccctgtgtccatgcgttctcgttgttcagatcccacttataagttagaacatgtggtgtttgattttctgttcctgtgttagtttgcggaggataatggcttccatctccacccatgttactgcaaaggacatgatctcatttctttttgtggctgcatagtattccattgtgtatatgtaccaaattttctttatccagtctatcattgattggcatttgcgttgattccacatctttgctattgtgaatagtgctgcaatgaacatacatgtgcatgtatctgtatcgtgcaataatgtatattcccttgggtatatacccagtaatgggattgctgggtcaaatggtatttctggtcctaggttatattagtctgttctcatgctgctaataaagacatacccaagactgggtaatttataaagaaaaatagggttaattgactcacacagttccacgtggctggagaggcctcacaatcatggcacaaggcaaaggaggagaaaggcaggtcttacatggaggctggcaagagagagcgtgtgcaggggagctcctttttatgaaaccatcagatctcatgagacttattcactatcacaagaacagcacaggaaagaaatgcttccatgattcaattacctcacaccaggttcctcccatgacacatgggaattatgggagctgcaatttgaaatttgggtggggacacagcgaaaccatatttttctgcccctggcccctcccagaactcatgtcatcacattttaaagccaatcatagcttcccaactgtcctccaaagtcttaacttatttcaacattaactcaaaagcccaagtccaaagtctcaggtgagataaggcaagccccttccacctatgagcctataaaatcaatagcaagttactttctggatacaatgggtgtacaggcattgggtaaatacacccattccagatgggagaaattggccaaaataaaggggctacaggccccataaaagtctgaaatccaatagggcagtcacatcttaaagttcaaaaatgatctcctttgacaccatgtctcatatccaggtcatgctgatgcaagaggtaggttcccatggtcttgggcagctccacccctgtggctttgcagggtacagcccctctcctggctgatttcataggctggcattgagtgtctgtggcttttccaggcacatggtgtaagttgtcaatggatctaccattctggggtctagatgacagtggccctcttctcacagttccactagatagtgcaccagtggggattctttgtggaggctcccaccccacatttcccttctgccatgcccttgcagaggttctccatgagtgctctgcccctgtagcacacttctgcctggacatccagttgtttccctacatcctctgaaatcttggtggaggttcccaaacctcagttcttgacttctgttcaccctcatgcccaacaccacgtataagccaccaaggcttggggcttccaccctctgaagcaacagcctgagctctacatcggacactttcagccatggctgggatgtaggtcatcaagtccccaaactgcacaaagcagcaaggccctggtcccagctcatgaaacaattatttttttctcctaggcctcccagcttgtgatggatgggagaggctgccatgaaatctgctgacatgtcctggagtcattttcccattgtcttctcgattgatatttggctccttgtttcctatgcaaacttttgcagtcagcttgaatttctcctcagaaaatggctttctcttttcaatcacattgtcagactgcaatttttccaaactttcatgctctgccttccttttaaacataaattccataagttcaaaaccatattgtagtgaatacataacactgaatgcttttgacaataccgaagtcatttcttgaatgctttgctgcttagaaatttcttctgccggataccctaaatcatctctctcaaattcaaagttccacaaatctctagggcagggacaaaatgccaccagtctcttcactaaaacatagcaagagtcacctttgctccagttcccaacaagttcctcatctccatctgagaccacctcagcctggactttattgtccatttcactatcaacattttggtcaaagtcattcaacaagtctctaggaagttccaaactttcccacatcttcttgtttatttaggatccctctaaactgttccagtctctgcctgttactcagttgcaaagtcatttccaaattttggggtatctttacagcagcaccccactctaccagtaccagtttactgtatcagtccattctcacatggctagtacagacatacccgagactgggtaatttataaagaaaaagaggtttaatgaatccacagtttacaacaacagtgtaaaagcttttctatttctccacagcctggccggaatctgtattttgtggacattttaataattgtcattctgactgtcctgagatagtatctcattgtgattttggtttacatttctctagtgatcagtgatgttgagctttttttccatatgttttctggtcgcatgtatatcttcttttgagaattgtctgttcatgtcctttgcccactttttaatgtttttttttcttgtaaatttgtttaagttccttatagattctgtatatgagacctttatcatagggatagattgcaaaaattttctcacattctgtaggttgtttgttcactctgatgattgtttcttttgttgtgcagaagctctttaattagatcccatttgtcaatttttccttttgttgcagttgcatttgacattttcatcatgatgcctttgcccttgcctatgtcctgaatggtattgcctagattttcttctagggtttttatagttttgggctttacatttaattcattcatctatcttgagttaattttggtaaaaggtgtaaggaaggggtccaatttcaattttctgcatatggctagccagttctcccagcaccatttattaaaaaaggaaccctttccccattgcttgttttttttttttcaggtttgtcaaagatcagatggttgtaggtgtgcagtcttatttctgagttctctattctgttgcatttgtctatgtttctgtttttgtagcagtaccatgctattttggttactgtagccttgtagtatagtttgatgtcaggtagtgtgatgcctccagctttgttgttttcgcttggaattgtcttaagtatatagtctcttttttgattctatatgaattttaaaatagtttttttttctaattatgtgaagaatgccaatggtagtttaatgggaataccatctataaattactttgggcagtgtggacattttgacaatattgactcttcctatccatgagcatggtaaggtatatttttccatttgtttgtgtcctctttgatttccttgagcagtcgtttgtagttcttcttgaagaggtctttcatttcccttgttagctgaattcctaggtatttgattctctttgtagcaattttgaattggagttcattcatgatttggctctctgcttatctgttgttggtgtttagggatgcttgtgatttttccacactgattttgtatcctgagactttgctaaagttgcttatcagcttaagaagcttttgggctgagacaatggggttttctagatttaggatcatctcatctgcaaagacaatttgacttcctctatttctatttgagtatattttatttctttctcttgcctgattgtcctggccagaacttccaatactatgttgaataggagtggtgagagagggcatccttgtcttgtgccggttttcaggggagatgcttccagcttttgcccattcaatatgatattggctatgggtttgtcataaatggctcttattattttgagatatgtttcttcgatagctagttcattgagagtttttaacatgaagtgttgttgaattttattgaaggccttttctgtgtctatttagataagcatgaggtttctgtctttagttctgcttatgtgatgaattatgtttatttatttgtgtatgttgaaccagccgtgcatcttgaggataaagctgacttgatcgtggtggataagctttttgatttgctgctggattcagtttgccagtattttattcgggatttttgtattgatgttcattaaagatattggcctgaagtttcattatttatttttatttttttggttgcatctctgcgaggttttggtataagaatgatgctggcctcataaaatgaattagggaggagtccctccttttcagttgtttggaacaatttcagaagaaatggtatcagctcctctttgtacctctggtagaattcagctgtaaatccatctggtcctgggctttgtttttttggtaagctatttattactccttcaatttcataactcattattggtctcttcggggattctatttcttcctggttcagttttgggagggtgtatatttccaggaatttatcgatttcttctagattttctagtttatttgcatagaggtgtttatagtattctctgatggttgtttgtgtttctgtgggtaggtggtgatatcccctttatcatttcagattgtgtctgccccagtgagatcagagttctgtccataaacccctgactggagttgctgatattcctgtagggaggccttgcccagtgaacagggatagatccaggtcccacccaaagaagcaatctggccacagtctgtcacagccactgtgctgcactgtggagaattcctcccagtcgaaaccttccagtctgtcaggccctggcagcagaaaatggctgtttggagccacagggatggctgccgcacctccccccaggaacttggtcatcttagtcagtctccagcctgctacctaccgctgggtccaacccaaacggctgctgagattctgcacaattctgtgcttgggacccaaagtcctggtggcataggctcacaaaggaatctcctaatccctgagttgtgcagatcggttgaaaaagcatgatttcctgagcagagtagcacaataacctcctcccttggctgagggtaggaacttcccttgccctgtgcaactagcagatgggccatcactccaccgtgcttttctctctgcatgggttgcatcaactgcctagtcagtcccaatgtgagaacctggataccttagttgatggtgcaggatgcactagctttttttgttcttcttggtgagagctgccaaccacacctgcatctaatcagctttcttggcaccaccgccactcatcttggccccgccaacacccagttttctttttttgatgtgtcttagtctgatttttgtatctgggtaatgttggtctcatagaatgagtctggaaatattctctcctctattttttgcaatagtttcagtagaattggtattagttcttgtttgaatgtttggtagtattcagcagtaaagctatcgggtcccaggcttttctttactgagaggcttttttattacagctttgatctcactactagttattggcctgttcaggatttgaatttcttcctggtgaaatcttggttggttctatgtgtctaggaatttctctattttcttctaggttttccaatttattggcatatagttgctgatagtagccactaatgagcctttgcatttctgcagtgtcagttgtaaagtctcattttttcatttctgattttatttatttatatcctctctcttttttcttagttcatctggctaacagtttgtcaattttgtttaactattttaaaaagccgctttttgtttcttcaacaatcttttttcattttcttcatttcaatttcattttattctactctaatctttattatttatttccttctactaattttgggtttggcttgttcttgcttttctacttattaagatgaattgttagattctttatttgaaggttttcctcttttttgatgtaggcactaatagctataaacttccctcttggtactgcttttgctctaccccataggttttggtatgctgtgttttctttattatttgtttcaagaaacttttcaatttacctcttaatttctttattgacccactgatcattaagcagcatattatttaatttccgtgtatttgtatagtttccaaaattcctctctttattgatttctaggtttattctattgtgcttagagatgaggcttgatattatttcaattttttgaatgttttaagacttgctttgtgacttaacatatggtctattcttgacaatgatccatgtgctgaggaaaagaatgtgtattctgcagctgttggatgtaatgttctgtaaatatctattagatgcatgtggtgtatagtacagattaagtctgatgtttctttgttgattttctgttgggaagatctgtccagtgctaaaagtggggcattgaagtctctagctattattgtacttgggacaatctctttttagctctaataatattttctttatatatccaggagctccagtgttgggtgcatatatatttaaaattgttgtatcctctgactgaattgaaacctttatcattatatactgactttctctcttcttaattgcttttgtcttgaaatttactctgtttgatataagtatagctacacctgctcttttttgttttccattggcatggaatatctttttctctttttcattttcagtctatgtgtgtcttcataagtgaaatgtgtttctcataagcaacagatcactggttctcattttttcatccatttagccattctttgtcttttaattgaagatgttatttcatttacattgaataatattgataagtaaggacttactcctgccattttattatttgtttcctggttgttttgtggtcttctcttccttctttctgtccttcctgtcttcctctagtgaaggagattttctctggtgaaatgttttagtctcttgcttgtcattttttgtgttttcattttatgttttttggtttgaggttattttgaggcttgcaaataccatcttataatgcagtattttaagctgataatagcttaacattgtttgcataaactgacaatcaaaaagaaaactaataaaaattctacaccttaacttgatccccaagctttttaactttttgttgccgtactgactatgtcttgaaaagtggttgtagttattacttttgattggttcattgtttattctttctacttaggataagagtagtttacacattacagttacagtgttataatattctatgtttttctgtgtacttgctgttaccagtgacttttgtacctccaggtgattacttattgctcgttaatgtctttttctttgtgtttgaagtactccctttagcatttcttgtagggcagatctcgtgttgatgaaatctctcagcttttgtctggggaaatatttatttctccttcatgtttgaaggatattttcaccagatatactattttaaggtaaaagtttattttccttcagcactctaaatatgtcatgccactctcttctgatctgtaagatttacactgagaagcctgcttccagacgtattggagctccattgtgtgtgtgtgtgtgtgtgtgtgtgtttgtgtattttccctctcttgctgtctttaggatcctttctatatcattgatctttaggagtttaattattaattacctgaagtagtctttgcattaaatcttcttggtgtaaaacttccttttactttgatattgatatatttttctaggtttggaaagttctctgttattattcttttgaaaaactttctacccctatctctttctctacctcctctttaaggccagtcactcttagatttgcccttttgaggctactaatatttcttagatcctgtgggcatgcttcgttgttttttattctttgttcttttgtctcctctgtgtattttcaaataccctgtcttcaagctcactaactttttcttttgctagattcattctgccattaaaagactctgacacattcttcagtatatctattgcattatttaacttcagaatttctgcttcattatttttagttatttcaatctctttgttaaatttctctgatagaattttgaattccttctccacattatcttgaatttctttgagtttcttcaacacagctattttgaactctgtttgaaaggttgcatatctctgtttatctaggctttgtcctgggtgacttatttagttcatttggtgcgatcacgttttcctggatggtgttagtgctaatagatgttcttcagtgtttaggcattgaagagttaggtatttattgtactcttcactgtctggaattatttatacccatcctttttgggaatgctttccaggtatttgaaagggctttggtattgtgatctaagctgtatgtgctttagggtacactccaagcccactaacactgtggttcttgcaaactcacagaggcaccacctcaatggtttggacaagatccaagggaattctctgtattaccaggcagagactgttgttctgttcccttatttttctcaagcagagtccctctctgttctgagccacctaaggttggggatatggtaacacaagcaccactgtggctttcaccactatgactgcacctggtcagacctaaagccagctcagcactgggtctcacccaagttcaagctcagcactgggtctcacccttgttcaaggacctgtggctctacagtcagccagtggcaaagccagccaggtctatgtctttcatttcagggtaacaaggtctctctgggaccaggtgggtacagaggtgccatctggaagtgagggactacagtcaaaaaccttagaagtctccctgctgttctattgtaccgcgactgagttggcactcaaaccacaacatgcaatccttcccttgcttccctgtactttccaaaggcagagaagcctcatcctgtagccactgccaccccaggccacaaggagtcctgccaaactactgctgatattcccttaagacccaaaggctcttaagtcagcttgtggtgattgctgcctggcatgggactcacccttcagggtaatgggctcccctctgttccagcacaggtccagaaatgctacccaagggtcgtgtcctggaattgaggaccccaaaagcccacttggtgctctgctcccctgttgccatgctggtacctgaagccagctgtctagaaatgtcatctgggagctagggcctggaatgggggcctcatgactctatccagtgccttatcctgctgtggctgagctggtatccgggatgtaaaagagagacctcctcactcttacctctcctttccctaagtagaagaaaggtgtctcttttggagccatgaactgtgcagccttgggttaggggacaggggatgcttccccagctgatgtctcagtatgctgcatgccaccctagtccactgtcctatgcccagttctgccttaggccttgcctaagagttgtagtccttatggtctaggctgccttttaagtttacttagagacctagagcactttggcccttggtggcaaggtttgtgagaattcaaatttggaccactgggatcagtggttccccaccagatagggctggtttaaatgctccctctgtgggcgattgtcagctgcgtttggtctggtatttctttctgctctaacagaacagcactgagttcaatggctcacaattgctgtattcttcctcccccagtgcccagagaagctctctgtaccatgaggccactgcagcagttgggggaggagaagtggcttcggtgattcaactttttttttttcttttaatctcttcagtgcctcttttggggtatgaggttcaaactaagtactatgagtgctcacctgattttttcattcctatgaaggtgttttttctttgtagatagatgttaaatttgtgtccttgtggggaggatgatcaatggaagcttctattctgccatcttgctctgtctttcattatagtattttttttcttttagtattgtggcatatgaaaaaatatttctgaccaaccacccataatcatttttatctaaactgctatcagtcattaaaaatgtctgtgtttcattgagcaaaactgggaccagtgtctttaagcttgtcacttgctgggtctgtaaagaattggttagttggatattaatggaaattttagttattcgaatgacttacatagttgctgaatattgtgccataaaatactggttctgactttcaatacatcattttaattaattttggtgtaatttcatacatgttattaatctctggatggaggttagagattatattgtattgatgccctgattaaagtgtgttatattcactgcacttgaagaaaaaaatcactagtagtacaaaaatatcattgtttctcttaattcaacttgatcccaaacataacttaaatcactcctagcttcgttgctatggggcatagtatcttaactagaaatattaaatacttctagtaaatttgagtaggtaaagactccctaaatatataaacagtagttatgcttacagaaaattggtggcatttttcctatcaatgagttgttttaagatgagtcagagctaatgaagagtcagaaatcatctcagaagacatggtactttcttctaaaacaaaaacagaaactattaggacaaatggcaatgaattctgcctccccctaaattaaagcaggaaagtatgagtcagaggtaaggcccttttaacatctccagatatatcccatggtgtcaggccaactggatagaccttataaatggacttacctgaagctttctttagcccctctgtgcatggcctcgtattttctgccctaaacttttctctttttacttcagttatcacttatcccggatacatatcacgactatcccatactccccattccttgactagtcttacctccaacaaagaagaatatgcactttagttaaaatccagatttataaaaaaagacacgtctatgattcccagtcctttgcctccactgggaaaaaattttttgatctgtttgaaatgttcaagggaaaaaagacccaagtttgctgcctctcccatgccatccttcagcttcacagccctgcctgtggaggtttgattctacttgggctacatcctacttctcaaaaaccaggtcactgagaaatctgggactttcattcatatatgtgtccaatgttttagtgaccaaaaataacaacaacaaaaaatctaccacaagattctgtcattcacccactatagcattaatgacttccaattattcaccaaggacttgattagaatgagccatctctgactagttactgccaatttgaaagtatttacattaaagagcaaaagatacgaactattcttacaatgcttacccatttccaaaagaatgtgatccacagacaaatttgtcatttaccaaacttctctcaccaaaatttgccaccatctttattatgacgtccatttaatcaatagtcagaggccatgggacacagaagaaatggccttctcatgtgatagagaaactgaaatcttcttttggagaaaaggagatttctggactttgatgatagtagatccaaaagaaactggttgaggtcttttatcaatttagaaggtagaaccaatcagagttagaagcactcaagaagccctgagacttaaaagataaaacaccttcatatgatcttaaatttttagcactattttcccttcttgaagttgtattattactgacttcctttacctgaggttttctctgacatacaatgaaccagaagcaactttagttttattttcctgatattaataagcaatcagttaggtttacagcagtgtctattagtgaaagatcatattttcatttttgattactgatttttttaaagtttaacctaatcacaagttttcattaaaatttaccattagatcattaccctgcttctttaaaacaatagttcagataaagtacacctgcaacataaaaagcttttggacttttcttagaatgttcttaaaggacctttttacaagaaatttttaagaaaatcttctaagaaatgtaaaatactttataccagctattgaagaatagtaacggtgaattttgttttgagaacctgactcaatttatacatagaaataatagcactcaatatttattcatattcttaaatgagcaagttaaaattgtatttaattatatactcttaaaattttagatggtatttctttggtttcttttttcaataaacattacttttaggggtggtagttttgaagggagcagggaagaaatctttttatcagtagctcaatattctgggatcagaaaacacaatagtttttgttttgtttttgctctttttgggcagtaattacctgataagtttctcatactgagagctctccagaatacagagttcttgccagcatcaaaaggacttccttttgagaagtaaccatatttcagtgaaaaaatcattgaactaaaaactaagagacttggctttcaaatcgggttctgcaataaaccagctgtgtgatcacgggcaagtcacctaaccttactgtgtcttagtgtccttttcataagaggagaagtaaggctagatgatatctgaagtctgttctagtactagtattcagtggttgaatatactatatttttgttatgaatgcagctcatctaacttaagcacaagagagcagctgctaaaaagagctgattagcaacaattaggagtggcatttcatttgtattgcatatcttcccaattaaaagcatttagtgattaaaattacatgcttgaaatacagtctttaaaaggaaatattttcaaataaatgaaatctctgggtcaaggccaatttgtattttaaacatttgcataatattaaagagttttgctgtagtataaggcatgcttagccattgcagtttttagaatctgaagcgagacagagatagagtcaaagagcgagatagagaatgcaagtgcacgtgtgagcacaagcaaatgaaacaagtaaaaaagagaattctgaattattatgcatgctagtaaaaaatgattggttcctcctaggatgtttacagaattaatcagattatgtcttgtgtttcatttctatacttcacattaagtcatatgtttaagattttcctttatttctgaaagccaaaagctgacttttcaaaatcaagggaagaatagactaaaaaaaatggacctgaaaaatagatgtgcttcactgttctcgtggatataacaaccctgatgtcttcaattaaatctcctttgttccagcttaaaacattgtgaatttaaattaacactttaagacatttcaatctgagtgcacattccaaataacgtaataaaatcatctgattgttctctcagatggagaaaccagagtagtgatagtgaacacaaggccagaaaaaatgaaatggtatttattatatattttcttataaaaacaaagttgggggaagtacacattaaaacagaacttagtacaaaaattctatcattttcaagaatcttcctgagtgcctactcttttgtcaaaagggaaaaacaaagactgttcttaattttgaaatctgacacaatagggaaaaaaaaatcaatgacagaaattcctattctttggactaacatttaaaaaaaagaaccacatgctatgaatagtactgttctacaaaataggttttgctaagtcctagtgggaaaaaaaatacatgtataatatcttaaaccttgtatgtggctttatcaaaattaacaatactattattaatattttaatgtaaacttatttcttcctaagagacatagtgttttcttacccaaagggagatggtgttttcttacccaaagagagatggtgttttcttacccaaagagagatggtgttttcttacccaaagggagatggtgttttcttacccaaagagagatggtgttttcttacacatcactctcctttccttagtatgactttaaagtagcgagggacttggtgacattagggttatcggcagatatgtgactaacggcttgggacattttattgtaatccgttttttattgtatttcccttgacaaggctacaaatgaattctgaaataaatgttctagaagtagtgcatagactctaaaaggtaccacagtattgaatatataagcaacagttgcttttccccctaatagttttagacagcctatagcaaaccaagaatttttagtggaatgaaagtgaatttatgataatacttattatatctgtattgagaatattcaatgtgtattaaagtatttccttaatgttttctaaaacagccatgttattgtagtgttatccatttgaatctatgttcttgcattcctgtggcccaaagatgtatcagtaatactaagagaaaagtgaaaaaaaattaaatatcaggttagttattgataaatcaagcagtggtgaaagtcagaaataaattttgagtctttccaccagcattcctcgatctaaagagtaaatggcttttaatcagttttagaactagatctctttggaactatttttagtacttactggcactgtatgcattttctgggcaactgtaccagatttatagctctaaaagtgctgtgttatttattgccttccaataggcaatgaagtggtgtcttgcacatgcatgtgtcaaaaatgttaaagttttctccagttgtctcgttaattctttcccaggacaatagacaaaatatatggctctctatttggcaatgaatatcctttatcaattttttaaaagaaaaaaaaaacttctcttgcaaatttcacatccaacgtcaactttctcttttttgattttacaaatctccacaaagaattaaagtctcagaagggctttatcttgcttatttcagcagtttttgtcttgggtttgcaatcctaaagtttatttttgaatttaggaagaaatatcactcacaaatgaaggttattaggatgaggttattagaaagtccatgcatttttcatgacctcaacctgaattggcacttttgtatactagagatcaatgccatttcagatatcagaatccaaaaatcaacatatcatgtgtaaattattcttgcatgcagttcttatatattattttcttccctgatttttgttttctttgttgatcacacgtatccatgtttgacagatgtagggttttgcatcttttcaataatgcactggctacataccacacttagtatttgtcataatttattctgaaaatcaagttttacaactaggttgtaaaattttactagcaattgacactttggcttttattacatttttgaacagaaaagaagtagttgtttcaggaaataattttgaaattgttttctggacagttttattaaaataaaagacaaaaaaaaaaacccaagtcaacaattatagagtattcctgtgcctatacagactgagaattaagaacaaccaaattctgctcttcttttatcttttaaaataagagccactactttaattcatgcatttatttatctaacaaatgttttctgaatgtgttcacatatgccaggtgctatatctttagagattatacatttaaacaaagcttcatgccatattaccctacactcacattatttagtatatgaaggcgtacctagagatatacacatagagagtttgcccctatacacagaaataaataattttaagtggatttggaattcagggtagtgcaggtcaattcttccaaacttttaacttttttgtatataaggatgtgtcggtgctgaagatagggagatgatgaattaaggagccatacgttttatcttctttttcatttttctcactgtcctcctgtcatggtcaaacatatggcaaaaggcttcagttttttaattgctcatgtggatgtgagctcagttgaactaactacatttggggtaggactgatgttggattcatgtgttagttattctttattcctgaaggagattgaacagaaaacagtcttggaatcatcattcagtaataatagtaagctcatgttggcactatactttgacgtcaacttagatatctcaccaaaattttgttgaaaattatttatgtcttaacctgtgggcaactcctgttcaaatcccgtggacaatattaagtttaaatatgtttgctcagcaagtctttgtagaactctaaaaatctggaaaaatgggggttatgcatgcaatcacctggctaatcatagattctttttaaagaaaaacatgatgtcttaggatagtacagttcaatagaatttgtgcaataatgaaaatgttctacatctgcagtgtccaacgtagtagctactggccacatggagctgttgagaacttaaaatatgggtagtgcaagtaggaactgatgttttaaattaatctaattcatttaatttaaatctaaatttaaatgctcctttggggctaattaccatcatattgaacagagtagttgtgaaagacagaatagcaatggtgacattatccattaactaatatgtacatttcattatcaccttgagaattagaaaaatatatttttaagattattgccatttcacataaagtaattaaaagacagtgagtatgctgatcttggatttttcatctgacacaagcttgccttaatttgctttggaaagcaaaggccaactcaaaattcagacaaacacataaaagtaaaaactaaatatataaacaagaaatgcacaaacataaatacataaattttaaaattaaaacttacatattcgttttcccagatgtattgtattcataaattggataattggctccgaaacttaagaactttggaacattttccttgttctttttatattatattatctttgtttctgtttatgcaacctctaataataacttacaatttccccatatagctcttattaaaaatgtagtgattctcttaatgtaaatccgttagtgtcaataccatcattaaatccatagttattgatttttctttcaccttaactagaacttaccttttatcacattagtaaaatatgtttactcaccaccatgaccttggcatctaggagaatgctctcactatattagccactcagtattggaatgtcaaggattaaaagaatagtattaagtgccatggattttatgaagtacaatttagaaactattttttctacccataaatagacattttggatttgaaccttcctaaaaacctcttggaatatcattacaaaaattaaattatcattaatcactaaatttgtttagatcaaattataatagtatgttatggtatttacttacattcaatgttgtcatgaaattctattttttcttaaaatatgcagtatatcaaataatagattttgcttgctaattttcaaatataaatacgtataacatgaaaatgtttttcttactatataatcaaggaaaagccaggttgattattgctctgagtaaaataggaatagaatgctcacgtttattgtatgaattaaaaacaaaataactaatatactttggttagctcttgtgaaatttttttttaaataacgttggaacaaactaatgattttaattaatatttctgaaatgccatcttaaattttgtaataaacatctaattcctccacaaagatatattatggcactgcatttgaataaaagtataagtgaatctcagcacccccccaaaatctgaaagtttgcagaaatatcttcaagtaattcataagaggaaaaaatgagatgcatttggatattgtttaagactatatataggcaattataagacaggtaaattttttaaagataatgtgattgaaatacatttataaactgatcatatattctagcagtctctgaaaacctggtattatttattaggttctaatttttaggatcttgttttagacagtggtatgacaaaactataacctcagatcttatcctgttcttttatgatacagcacataaatgagagatcaataaccaatccatgccacttgtccagaacatgtatgttaaaaatgtagtagagaattaaaaattatttagatgtacatatgtgtatgtgtgtgtgtgtgtatatatctgttcataaatcacccatgaataggaatcttaaagtcctcctccgatcttttcttcataccctccagtacctttttatctcattcatctctgtcataatgctgcaagtaacactggacaggaatcttcctctctcatttctcctcggtaagctggcaagatcactacgtttgtgtgtagggatcatcttattgtagtacagggaggggattttttttttttttttttttttttgagacgagtctcactctgtcgcccaggctggagtgcagtggcgccatctcggctcactgcaagctccgcctctggggttcatgccattctcctgcctcagcctcctgagcagctgggaccacaggcgcccgccaccacgccaggctaatttttttttttttgtattttttaagtagagacggggtttccccgtgttagccaggatggtctcgatctcctgacctcgtgatccgcccgcctcggcctcccaaagtgctggaattacaggcgtgagccaccgctcccggccgaggggattgttttttaaatattcccatactgtgacttcgtgggcatgaattgaaaataggtcctatccgaagctacctttttcaatttgaggtcttgacctgtgaattttagttcattgtgcttgcatgttaaaaaaaaaacagtaagaaaataacattgcattgttaatctctgagataatttcattttaactgtgtgttcctatgggaaatattgaaattctttgtattttatacaaatttatattttaaccagtttgtgtattttttttccatctgctaaaggttttagctgtatttattagatatgatacttatgatgttgtcttggaggaatatttttattttggtgcttactttagtactgaaaaagcatcttaggcaactgaaatctacagtaaaaaatattttaattcatttggaataatcttggataattcgcttacagcttcatttatcttgcaaaaatttagtgacaattctttttaaaatatacttttttcttttgaaaacttaaatagttcgaaaaccaaacattgtgtgttctcactgatatatgggtgctaagttatgaggacgcaaaggcataagaatgatacgatggacattggggacttcggggaaagagaaggaaggtggcgagggataaaaaactacaaatatggtggtgtgtatattgctccagtgatgggtgcaccaaaatctcacaaatcaccactaaagaatttactcatgtaaccaaataccacctgaaccccaataacttatggaaaaatgaaataaaaaattaattaatttaaaaaaactgaaatagttcacataatttaaaaaaacttaaatagctcacataaatgagttacatatattaccataaaatgctacaatctgaagcctcctgtccccagaacatcttctagtacagttctctaattttacaaatatcaagaaaagtaaagtaacttgtttgtaatcacgatatttgttataggcagagttgagacttagaactgaagtcttctggcacctatttctgaactgatcccattattttatgtggcttcaagaaactgaaaattgttctcattagataagctaacataagttaaattatattttattattcatattaatattaatatattaatttatattaacataagttaattctgtttcattgcatgttttccagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattcttaaaagataataacttttggaaaataaaatgtttgctttctctaataggcacaaagaaaactgtgggcatgttaagacccaagaaatctgtgcacaataacttaaaacccaatacatttatgaaagcaagagtttatccagtgccttttatcagtgttccatgaagaaatgaatacaaatttatccagaaactcttaaatgttgaatgatttaaatataattgttccctttaaaaagacaagcaatggaatttacccacatttttttctcgaagtcatgctacatgttgagtttattattttgtctgtgttaactcttaaaaaagtattaatcttagtttcagggaataaagtcttttgaacacctattcaggcttaacaaaatagtagcaatgtgaaaatcaaaactgattttctttcaccaaaagttcgagatattaaagaaggctactgcattcaagatagcaatgcaaatagtttaccataactttggaaatgggtttaagaatggaggtcattcaagcataagcgcagttatataatacgataacattaacttttctctctgaatcacacaatgaacgtaaggtactaattcagatgtgggtgcatttttgttacagtaggtacacaattaaatgctgtttcaaaaggtaaactagaaccctagtgtctgtatagagagcttctgttagactttaaaagaatttacgctgcagttgttatttctacagtttagatgaatcccatattttacatagttagtggatctgggatgggcaacaaacgttaagagatgtcgaacatctccacagggtgtgtttttgtttatatttaaccattaaaaagggcactctcattttcaaattcttattgctattctgcttattggataagtttctcaacataaaagtatcttttatgactaacactacatgatttgggtataataacattttttcctgggtttaatttgtgactttctttaagaagtgtacaaagagtgggtttgtgaattacatatgtagatcatcatttttaatagatttaatgaagttaattaataaagcaagttctggtttcagtgctttttgaaggcacagagatattttatgagctagactgattttacttgagtttatgaacacatagcaaggagggcatggatgaagaacaaaaaactgaagtatttttcaaatatcctcacttttttgtttttttaaaaatattttgtaatcctaaaaagtcattaaaaataataaacctttttccatgacgcattttatatcatataactaagagacattttctgaatcataagaattagtcaaaatacaaaaaagtaaatgctaatgagaatcagttattggttgttatcaggtttttattaactgaaaggactatcttagaatcattgaattagcagatgacttatttatttcacagcttaaaaagtaaataaattatatattttattattggttcacagttgtttcatattcattactaaatatcttcaagacatgaattggtgaacttaggcagactaatatgatactaaaaataatttgaatctttacattttgtgctacatttgcaatgttctttaccttttctatatgctcttcaatttgtgtttaatgttagggtgttcaatgatgttgcagaatgctagcaaaataagtgagcactgaaaaagaaattatgtatttaaaaattcaaatgcagtaggtgtcttctttttaaagaaatatcatacaaaatgggagaagtgacagccaatacaatacaaattcattgttccttaaggaaatacttagagtggaataaaatattactgttagcagaaggcagaattattccaatttattttaaacagtgagaaatgcattttcaaaatgagggtttggggaatatttacatttagttcattactcgtctgaatagaaacaggaaagtggaaaataaaatgttctagtagactataagagacaagggaattcatctgaaattttatgttttataaagggaatcaaatactttctagttctcataatttctcattctccttgatcattctataggttgtttttctgacttggatgttctgaaaatatatggaacatttattagataggagtacatatattgcataaagccatctatacctggggaatataatggtcgtctttggcatacgtttctacatgtattatggaaggcatttttgtatacattgtagtagaaattttaaaaacatgaaatttgagaggatgaggctacacattatcttctattaacacctttcaaaacaagcagatagcaattggttgttatgacactagagaaaccataagtataaataattattttaaaatcacttttgatcaatgtcatataaaagagataaactgccaaaaccaagtcttgcttaatacaattcacccattaaatattgtgaagactatacattttaaaaaaatagagaggagaataaaaatgaaagtagaattttttgaaggtcttccagtcactgtctaagacaagtatttggggtacatcattttccaaaaaacaaacaaacaaacaaaaaaccttacaagtttctgtgatttgagttggaatagtctttcagtttcagaaatgaggtgaatgaatggtgaaaactttagacagttctaattcatgcatgaaaccatcctgtagatatgatacatggatttgaaatgataattgcagtctgagttagcttggaataggattggtattcactattgtaaaattcagtaactttgactctgcatttatattttggtaatgcaaattttaaccatgaagcatgcttggcaaatgaaactcctagaacacaaccatctgattttgataacgtgttatttttcttgtcctagactgattccaggacatcaactattgaaatctgcagtgagatataactttctaggaacaacaaaattccattccccttccaaaaaatttcaatgattgtgatttcaaaattaggctaagatcattaattttgtaatctagatttcccattataaaagcaagcaaaaatcatcttaaaaatgatgtcctagtgaaccttgtgctttctttagctgtaatctggcaatggaaatttaaaatttatggaagagacagtgcagcacaataacagagtactctcatgctgtttctctgtttgctctgaatcaacagccatgatgtaatataaggctgtcttggtgtatacacttatggttaatatatcagtcatgaaacatgcaattacttgccctgtctgattgttgaataattaaaacattatctccaggagtttggaagtgagctgaactagccaaactactctctgaaaggtatccagggcaagagacatttttaagaccccaaacaaacaaaaaacaaaaccaaaacactctggttcagtgttttgaaaatattcactaacataatattgctgagaaaatcatttttattacccaccactctgcttaaaagttgagtgggccgggcgcggtggctcacgcctgtaatcccagcactttgggaggccgaggcgggtggatcacgaggtcaggagattgagaccatcctggctaacacggtgaaaccccatctccactaaaaatacaaaaaattagcctggcgtggtggcgggcgcctgtagtcccagctactcgggaggctgaggcaggagaatagcgtgaacccgggaggcggagcttgcagtgagccgagatggcgccactgcactccagcctgggtgacagagcaagactctgtctcaaaaagaaaaaaatgttcaatgatagaaaataattttactaggtttttatgttgattgtactcatgctgttccactccttttaattattaaaaagttatttttggctgggtgtggtggctcacacctgtaatcccagcactttgggaggccgaggtgggtggatcacctgaggtcaggagttcaagaccagtctggccaacat
